US008871488B2

(12) United States Patent
Dauner et al.

(10) Patent No.: US 8,871,488 B2
(45) Date of Patent: Oct. 28, 2014

(54) RECOMBINANT HOST CELLS COMPRISING PHOSPHOKETOLASES

(75) Inventors: Michael Dauner, Claymont, DE (US); Lori Ann Maggio-Hall, Wilmington, DE (US); Jean-Francois Tomb, Wilmington, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 116 days.

(21) Appl. No.: 13/161,168

(22) Filed: Jun. 15, 2011

(65) Prior Publication Data

US 2012/0156735 A1 Jun. 21, 2012

Related U.S. Application Data

(60) Provisional application No. 61/356,379, filed on Jun. 18, 2010.

(51) Int. Cl.

| | |
|---|---|
| ***C12N 1/20*** | (2006.01) |
| ***C12N 1/00*** | (2006.01) |
| ***C12N 9/00*** | (2006.01) |
| ***C12N 15/00*** | (2006.01) |
| ***C12P 7/16*** | (2006.01) |
| ***C07H 21/04*** | (2006.01) |

(52) U.S. Cl.

USPC .............. 435/252.3; 435/252.31; 435/252.32; 435/252.33; 435/252.34; 435/252.35; 435/254.11; 435/254.2; 435/254.21; 435/254.22; 435/254.23; 435/254.3; 435/160; 435/320.1; 435/183; 536/23.2

(58) Field of Classification Search

None

See application file for complete search history.

(56) References Cited

U.S. PATENT DOCUMENTS

| | | | |
|---|---|---|---|
| 7,405,068 | B2 | 7/2008 | van Maris et al. |
| 7,851,188 | B2 | 12/2010 | Donaldson et al. |
| 7,910,342 | B2 | 3/2011 | Liao et al. |
| 7,932,063 | B2 | 4/2011 | Dunson et al. |
| 8,530,210 | B2 | 9/2013 | Sun et al. |
| 2005/0059136 | A1 | 3/2005 | van Maris et al. |
| 2006/0040365 | A1 | 2/2006 | Kozlov et al. |
| 2007/0031950 | A1 | 2/2007 | Winkler |
| 2007/0190629 | A1 | 8/2007 | Wahlbom et al. |
| 2007/0259410 | A1 | 11/2007 | Donaldson et al. |
| 2007/0292927 | A1 | 12/2007 | Donaldson et al. |
| 2009/0155870 | A1 | 6/2009 | Donaldson et al. |
| 2009/0163376 | A1 | 6/2009 | Li et al. |
| 2009/0171129 | A1 | 7/2009 | Evanko et al. |
| 2009/0269823 | A1 | 10/2009 | Bramucci et al. |
| 2009/0305363 | A1 | 12/2009 | Anthony |
| 2010/0081154 | A1 | 4/2010 | Flint et al. |
| 2010/0120105 | A1 | 5/2010 | Anthony et al. |
| 2010/0197519 | A1 | 8/2010 | Li et al. |
| 2011/0124060 | A1* | 5/2011 | Anthony et al. .............. 435/115 |
| 2013/0252296 | A1 | 9/2013 | Maggio-Hall |

FOREIGN PATENT DOCUMENTS

| | | | |
|---|---|---|---|
| WO | 2003078643 | | 9/2003 |
| WO | 2007050671 | A2 | 5/2007 |
| WO | 2007086608 | | 8/2007 |
| WO | 2009013159 | A2 | 1/2009 |
| WO | 2009046370 | A2 | 4/2009 |
| WO | 2010151832 | A1 | 12/2010 |
| WO | 2011041415 | A1 | 4/2011 |
| WO | WO 2011/090753 | A2 | 7/2011 |
| WO | WO 2011/130378 | A1 | 10/2011 |
| WO | WO 2011/154503 | A1 | 12/2011 |

OTHER PUBLICATIONS

Schure et al. Pyruvate decarboxylase catalyzes decarboxylation of branched-chain 2-oxo acids but is not essential for fusel alcohol production by *Saccharomyces cerevisiae*, Appl Environ Microbiol (1998), 64: 1303-1307.*

Rado et al., Phosphotransacetylase From *Bacillus subtilis*: Purification and Physiological Studies, Biochimica et Biophysica Acta, 1973, pp, 114-125, vol. 321.

Voloch at al., "Fermentation Derived 2,3-Butanediol," in Comprehensive Biotechnology, Pergamon Press Ltd., England, 1986, pp. 933-947,vol. 2, Section 3.

Wach et al., "New heterologous modules for classical or PCR-based gene disruptions in *Saccharomyces cerevisiae*", Yeast, 1994. pp. 1793-1808, vol. 10.

Chinen et al., "Innovative metabolic pathway design for efficient 1-glutamate production by suppressing CO2 emission", Journal of bioscience and bioengineering, vol. 103, No. 3, Mar. 1, 2007, pp. 262-269.

Panagiotou et al., "Induction of Xylulose-5-phosphate Phosphoketolase in *Aspergillus nidulans*: the Key for Efficient Production of the Acetyl-coa Precursor Molecule", Internet Citation, Apr. 2006, p. 203, XP002477270.

International Search Report and Written Opinion of corresponding PCT/US2011/040608 mailed Oct. 21, 2011.

Akada et al., "PCR-mediated seamless gene deletion and marker recycling in *Saccharomyces cerevisiae*", Yeast, 2006 pp. 399-405, vol. 23.

Albert et al., Site-specific integration of DNA into wild-type and mutant lox sites placed in the plant genome, The Plant Journal, 1995, pp. 649-659, vol. 7, No. 4.

Altschul et al., "Basic Local Alignment Search Tool", Journal of Molecular Biology, 1990, pp. 403-410, vol. 215.

(Continued)

*Primary Examiner* — Iqbal H Chowdhury

(74) *Attorney, Agent, or Firm* — Andrew P. Baraniak

(57) ABSTRACT

The present invention is related to recombinant host cells comprising: (i) at least one deletion, mutation, and/or substitution in an endogenous gene encoding a polypeptide that converts pyruvate to acetaldehyde, acetyl-phosphate or acetyl-CoA; and (ii) a heterologous polynucleotide encoding a polypeptide having phosphoketolase activity. The present invention is also related to recombinant host cells further comprising (iii) a heterologous polynucleotide encoding a polypeptide having phosphotransacetylase activity.

48 Claims, 8 Drawing Sheets

(56) References Cited

OTHER PUBLICATIONS

Bellion et al., Microb. Growth C1 Compd., [Int Symp.], 7th (1993), pp. 415-432, Editor(s): Murrell, J. Collin; Kelly, Don P Publisher: Intercept, Andover, UK.
Bianchi et al., "The 'petite-negative' yeast *Kluyveromyces lactis* has a single gene expressing pyruvate decarboxylase activity", Molecular Microbiology, 1996, pp. 27-36. vol. 19(1).
Boeke et al., A positive selection for mutants lacking orotidine-5'-phosphate decarboxylase activity in yeast: 5-fluoro-orotic acid resistantce, Molecular General Genetics, 1984, pp. 345-346, vol. 197.
Chang et al., Brenda, Amenda and Frenda the enzyme information system: new content and tools in 2009, Nucleic Acids Research, 2009, pp. D588-D593, vol. 37.
Carlini et al., "Guerbet condensation of methanol with n-propanol to isobutyl alcohol over heterogeneous copper chromite/Mg-Al mixed oxides catalysts", J. Mol. Catal. A: Chem., 2004, pp. 215-220, vol. 220.
Deshpande, "Ethanol Production from Cellulose by Coupled Saccharification/Fermentation using *Saccharomyces cerevisiae* and Cellulose Complex from *Sclerotium rolfsii* UV-8 Mutant", Applied Biochemistry and Biotechnology, 1992, pp. 227-234, vol. 36.
Durre, "New insights and novel developments in clostridial acetone/butanol/isopropanol fermentation", Appl. Microbiol. Biotechnol., 1998, pp. 639-648, vol. 49.
Evans et al. Induction of xylulose-5-phosphate phosphoketolase in a variety of yeasts grown on D-xylose: the key to efficient xylose metabolism; Archives of Microbiology, 1984, pp. 48-52, vol. 139.
Finn at al., The Pfam protein families database, Nucleic Acids Research, 2008, pp. D281-D288, vol. 36.
Flikweert et al., "Pyruvate decarboxylase: an indispensabe enzyme for growth of *Saccharomyces cerevisiae* on glucose", Yeast, 1996, pp. 247-257, vol. 12.
Flikweert et al., Growth requirements of pyruvate-decarboxylase-negative *Saccharomyces cerevisiae*, FEMS Microbiology Letters, 1999, pp. 73-79, vol. 174.
Goldberg, I. et al., Organic acids: old metaboltes, new themes, Journal of Chemical Technology and Biotechnology, 2006, pp. 1601-1611, vol. 81.
Goldberg, M. et al., [90] Phosphoketolase, Methods in Enzymology, 1966, pp. 515-520, vol. 9.
Groot et al., "Technologies for Butanol Recovery Integrated with Fermentations", Process Chemistry, 1992, pp. 61-75, vol. 27.
Guo et al., "Pervaporation study on the dehydration of aqueous butanol solutions: a corriparison of flux vs. permeance, separation factor vs. selectivity", Journal of Membrane Science, 2004, pp. 199-210, vol. 245.
Heath et al, Pentose. Fermentation by *Lactobacillus plantarum*, The Journal of Biological Chemistry, 1958, pp. 1009-1029, vol. 231.
Higgins et al., "Fast and sensitive multiple sequence alignments on a microcomputer", CABIOS Communications, 1989; pp, 151-153. vol. 5, No. 2.
Higgins et al., "Clust Al V: improved software for multiple sequence alignment", CABIOS, 1992, vol. 8, No. 2 pp. 189-191.
Hohmann, "Characterisation of PDC2, a gene necessary for high level expression of pyruvate decarboxylase structural genes in *Saccharomyces cerevisiae*", Mol. Gen. Genet., 1993, vol. 241, pp. 657-666.
Horton et al, "Engineering hybrid genes without the use of restriction enzymes: gene spicing by overlap extension", Gene, 1989, pp. 61-68; vol. 77.
Ishida et al., "Efficient production of L-lactic acid by metabolically engineered *Saccharomyces cerevisiae* with a genorne-integrated L-lactate dehydrogenase gene", Applied and Environmental Microbiology, vol. 71, No. 4, Apr. 2005: pp. 1964-1970.
Krogh et al., Hidden Markov Models in Computational Biology, Journal of Molecular Biology, 1994, pp. 1501-1531, vol. 235.
Langley et al., Biochemical Genetics of the a-Keto. Acid Dehydrogenase Complexes of *Escherichia coli*, K12: Isolation and Biochemical Properties of Deletion Mutants, Journal of General Microbiology, 1977, pp. 263-276, vol. 99.
Li et al., Clustering of highly homologous sequences to reduce the size of large protein databases, Bioinformatios, 2001, pp. 282-283, vol. 17, No. 3.
Ma et al., "Plasmid construction by homologous recombination in yeast", Gene, 1987, pp. 201-216, vol. 58.
Methods in Yeast Genetics, 2005, Cold Spring Harbor Laboratory Press, Cold Spring Harbor, NY, pp. 201-202.
Mnaimneh et al., "Exploration of essential gene functions via titratable promoter alleles", Cell, 2004, pp. 31-44, vol. 118.
Nakamura et al., "Codon usage tabulated from international DNA sequence databases: status for the year 2000", Nucleic Acids Research, 2000; vol. 28, No., p. 292.
Nevoigt et al., "Engineering of promoter replacement cassettes for fine-tuning of gene expression in *Saccharomyces cerevisiae*" Applied and Environmental Microbiology, Aug. 2006, vol. 72, No. 8, pp. 5266-5273.
Nystrom et al., "Reduction of organic compounds by lithium aluminum hydride", J. Am. Chem. Soc., 1947, vol. 69, p. 1198.
Pearson, Comput. Methods Genome Res, [Proc. Int. Symp.] (1994), Meeting Date 1992, 111 20. Editor(s): Suhai, Sandor. Plenum: New York, NY.
Posthuma et al., Expression of the Xylulose 5-Phospohate Phosphoketolase Gene, xplrA, from *Lactobacillus pentosus* MD363 is Induced by Sugars That are Fermented via the Phosphoketolase Pathway and is Repressed by Glucose Mediated by CcpA and the Mannose Phosphoenolpyruvate Phosphotransferase System, Applied and Environmental Microbiology, Feburary 2002, pp. 831-837, vol. 68, No. 2.
Romanos et al., Direct selection of stabilised yeast URA3 transformants with 5-fluorouracil, Nucleic Acids Research, 1991, pp. 187, vol. 19, No. 1.
Sambrook, J., Fritsch E F. and Maniatis T. Molecular Cloning: A Laboratory Manual, 2nd ed., Cold Sprind Harbor Laboratory: Cold Spring Harbor, NY, 1989, particularly 9.50-9.51 11.7-11.8 and Table 11.1.
Saitou et al., The Neighbor-joining Method: A New Method for Reconstructing Phylogenetic Trees, Molecular Biology Evolution, 1987, pp. 406-425, vol. 4, No. 4.
Sauer, Functional Expression of the cre-lox Site-Specific Recombination System in the Yeast *Saccharomyces cerevisiae*, Molecular and Cellular Biolooy, Jun. 1987, pp. 2087-2096, vol. 7, No. 6.
Senecoff, et al., DNA Recognition by the FLP Recominase of the Yeast 2 u Plasmid, Journal of Molecular Biology, 1988, pp. 405-421, vol. 201.
Sonderegger et al., Metabolic Engineering of a Phosphoketolase Pathway for Pentose Catabolism in *Saccharomyces cerevisiae*, Applied and Environmental Microbiology, May 2004, pp. 2892-2897, vol. 70, No. 5.
Sulter et al., "Proliferation and metabolic significance of peroxisomes in *Candida boidinii* during growth on D-alanine or oleic acid as the sole carbon source", Arch. Microbiol., 1990, pp. 485-489, vol. 153, No. 9.
Tamura et al., MEGA4: Molecular Evolutionary Genetics Analysis (MEGA) Software Version 4.0, Molecular Biology and Evolution, 2007, pp. 1596-1599, vol. 24.
Ullmann's Encyclopedia of Industrial Chemistry, 6th edition, 2003, Wiley-VCH Verlag GmbH and Co., Weinheim, Germany, vol. 5, pp. 716-719.
Thompson et al, The CLUSTAL_X windows interface, flexible strategies for multiple sequence alignment aided by quality analysis tools, Nucleic Acids Research, 1997, pp. 4876-4882, vol. 25, No. 24.
van Maris et al., "Directed Evolution of Pyruvate Decarboxylase-Negative *Saccharomyces cereyisiae*, Yielding a C2-Independent, Glucose-Tolerant, and Pyruvate-Hyperproducing Yeast", Applied and Environmental Microbiology, Jan. 2004: pp. 159-166, vol. 70, No. 1.
van Maris et al., Overproduction of Threonine Aldolase Circumvents the Biosynthetic Role of Pyruvate Decarboxylase in Glucose-Lim-

(56) References Cited

OTHER PUBLICATIONS ited Chemostat Cultures of *Saccharomyces cervisiae*, Applied and Envirnomental Microbiology, Apr. 2003, pp. 2094-2099. vol. 69, No. 4.
Waterhouse at al. Jalview Version 2—a multiple sequence alignment editor and analysis workbench, Bioinformatics, 2009, pp. 1189-1191, vol. 25, No. 9.
Yu et al., Double-joint PCR a PCR-based molecular tool for gene manipulations in filamentous fungi, Fungal Genetics and Biology, 2004, pp. 973-981, vol. 41.
Zelle et al., "Malic Acid Production by *Saccharomyces cerevisiae*: Engineering of Pyruvate Carboxylation, Oxaloacetate Reduction, and Malate Export", Applied and Environmental Microbiology, May 2008, pp. 2766-2777, vol. 74, No. 9.

* cited by examiner

Phosphoketolase Pathway

This pathway enables cells to generate acetyl-CoA in the cytoplasm via intermediates of the naturally occurring pentose phosphate pathway (PPP). An example of an gene encoding XPK (xylulose-5P phosphoketolase) is xpk1. An example of a gene encoding PTA (phosphotransacetylase) is eutD.

□ Phosphate Butyryltransferase (PTB)
● Phosphate Acetyltransferase (PTA)

| # | Species | GI |
|---|---|---|
| 1 | *S. enterica* | 56412853 |
| 2 | *E. coli K12* | 58182943 |
| 3 | *V. parvula* | 227371784 |
| 4 | *C. kluyveri* | 153954816 |
| 5 | *C. Acetobutylicum* | 15895913 |
| 6 | *C. thermocellum* | 196254811 |
| 7 | *M. thermophila* | 88192943 |
| 8 | *S. pyogenes* | 48435285 |
| 9 | *B. subtilis* | 58176784 |
| 10 | *L. fermentum* | 227514417 |
| 11 | *L. plantarum* | 28377658 |
| 12 | *L. sanfranciscensis* | 11862872 |
| 9 | *B. subtilis* | 58176784 |
| 10 | *L. fermentum* | 227514417 |
| 11 | *L. plantarum* | 28377659 |
| 12 | *L. sanfranciscensis* | 11862872 |

pRS426::GPD-xpk1+ADH-eutD map

RECOMBINANT HOST CELLS COMPRISING PHOSPHOKETOLASES

CROSS-REFERENCE TO RELATED APPLICATIONS

This application is related to and claims the benefit of priority of U.S. Provisional Patent Application No. 61/356,379, filed on Jun. 18, 2010, the entirety of which is herein incorporated by reference.

FIELD OF THE INVENTION

The invention relates generally to the field of industrial microbiology. The invention relates to recombinant host cells comprising (i) a modification in an endogenous gene encoding a polypeptide that converts pyruvate to acetyl-CoA, acetaldehyde or acetyl-phosphate and (ii) a heterologous polynucleotide encoding a polypeptide having phosphoketolase activity. The invention also relates to recombinant host cells comprising (i) a modification in an endogenous gene encoding a polypeptide having pyruvate decarboxylase (PDC) activity, or a modification in an endogenous polypeptide having PDC activity, and (ii) a heterologous polynucleotide encoding a polypeptide having phosphoketolase activity. The invention also relates to recombinant host cells further comprising (iii) a heterologous polynucleotide encoding a polypeptide having phosphotransacetylase activity. Additionally, the invention relates to methods of making and using such recombinant host cells including, for example, methods of increasing cell growth, methods of reducing or eliminating the requirement of an exogenous carbon substrate for cell growth, methods of increasing glucose consumption and methods of increasing the production of a product of a pyruvate-utilizing pathway.

BACKGROUND OF THE INVENTION

Global demand for liquid transportation fuel is projected to strain the ability to meet certain environmentally driven goals, for example, the conservation of oil reserves and limitation of green house gas emissions. Such demand has driven the development of technology which allows utilization of renewable resources to mitigate the depletion of oil reserves and to minimize green house gas emissions.

Butanol is an important industrial chemical, useful as a fuel additive, as a feedstock chemical in the plastics industry, and as a food grade extractant in the food and flavor industry. Each year 10 to 12 billion pounds of butanol are produced by petrochemical means and the need for this commodity chemical will likely increase in the future.

Methods for the chemical synthesis of isobutanol are known, such as oxo synthesis, catalytic hydrogenation of carbon monoxide (Ullmann's Encyclopedia of Industrial Chemistry, 6th edition, 2003, Wiley-VCH Verlag GmbH and Co., Weinheim, Germany, Vol. 5, pp. 716-719) and Guerbet condensation of methanol with n-propanol (Carlini et al., *J. Molec. Catal. A: Chem.* 220:215-220, 2004). These processes use starting materials derived from petrochemicals, are generally expensive, and are not environmentally friendly. The production of isobutanol from plant-derived raw materials would minimize green house gas emissions and would represent an advance in the art.

2-Butanone, also referred to as methyl ethyl ketone (MEK), is a widely used solvent and is the most important commercially produced ketone, after acetone. It is used as a solvent for paints, resins, and adhesives, as well as a selective extractant, activator of oxidative reactions, and it can be chemically converted to 2-butanol by reacting with hydrogen in the presence of a catalyst (Nystrom, R. F. and Brown, W. G. (*J. Am. Chem. Soc.* (1947) 69:1198). 2,3-butanediol can be used in the chemical synthesis of butene and butadiene, important industrial chemicals currently obtained from cracked petroleum, and esters of 2,3-butanediol may be used as plasticizers (Voloch et al., "Fermentation Derived 2,3-Butanediol," in Comprehensive Biotechnology, Pergamon Press Ltd., England Vol. 2, Section 3:933-947 (1986)).

Microorganisms can be engineered for the expression of biosynthetic pathways that initiate with cellular pyruvate to produce, for example, 2,3-butanediol, 2-butanone, 2-butanol and isobutanol. U.S. Pat. No. 7,851,188 discloses the engineering of recombinant microorganisms for production of isobutanol. U.S. Patent Application Publication Nos. US 20070259410 A1 and US 20070292927 A1 disclose the engineering of recombinant microorganisms for production of 2-butanone or 2-butanol. Multiple pathways are disclosed for biosynthesis of isobutanol and 2-butanol, all of which initiate with cellular pyruvate. Butanediol is an intermediate in the 2-butanol pathway disclosed in U.S. Patent Application Publication No. US 20070292927 A1.

The disruption of the enzyme pyruvate decarboxylase (PDC) in recombinant host cells engineered to express a pyruvate-utilizing biosynthetic pathway has been used to increase the availability of pyruvate for product formation via the biosynthetic pathway. For example, U.S. Application Publication No. US 20070031950 A1 discloses a yeast strain with a disruption of one or more pyruvate decarboxylase genes (a PDC knock-out or PDC-KO) and expression of a D-lactate dehydrogenase gene, which is used for production of D-lactic acid. U.S. Application Publication No. US 20050059136 A1 discloses glucose tolerant two-carbon source-independent (GCSI) yeast strains with no PDC activity, which may have an exogenous lactate dehydrogenase gene. Nevoigt and Stahl (*Yeast* 12:1331-1337 (1996)) describe the impact of reduced PDC and increased NAD-dependent glycerol-3-phosphate dehydrogenase in *Saccharomyces cerevisiae* on glycerol yield. U.S. Application Publication No. 20090305363 A1 discloses increased conversion of pyruvate to acetolactate by engineering yeast for expression of a cytosol-localized acetolactate synthase and substantial elimination of PDC activity.

While PDC-KO recombinant host cells can be used to produce the products of pyruvate-utilizing biosynthetic pathways, PDC-KO recombinant host cells require exogenous carbon substrate supplementation (e.g., ethanol or acetate) for their growth (Flikweert et al. 1999. FEMS Microbiol. Lett. 174(1):73-79 "Growth requirements of pyruvate-decarboxylase-negative *Saccharomyces cerevisiae*"). A similar auxotrophy is observed in *Escherichia coli* strains carrying a mutation of one or more genes encoding pyruvate dehydrogenase (Langley and Guest, 1977, J. Gen. Microbiol. 99:263-276).

In commercial applications, addition of exogenous carbon substrate in addition to the substrate converted to a desired product can lead to increased costs. There remains a need in the art for recombinant host cells with reduced or eliminated need for exogenous carbon substrate supplementation.

BRIEF SUMMARY OF THE INVENTION

One aspect of the invention relates to a recombinant host cell comprising (i) at least one deletion, mutation, and/or substitution in an endogenous gene encoding a polypeptide that converts pyruvate to acetaldehyde, acetyl-phosphate, or acetyl-CoA; and (ii) a heterologous polynucleotide encoding a polypeptide having phosphoketolase activity. Another aspect of the invention relates to such a recombinant host cell further comprising (iii) a heterologous polynucleotide encoding a polypeptide having phosphotransacetylase activity. In embodiments, the polypeptide that converts pyruvate to acetaldehyde, acetyl-phosphate, or acetyl-CoA is pyruvate decarboxylase, pyruvate-formate lyase, pyruvate dehydrogenase, pyruvate oxidase, or pyruvate:ferredoxin oxidoreductase.

One aspect of the invention relates to a recombinant host cell comprising (i) a modification in an endogenous gene encoding a polypeptide having pyruvate decarboxylase activity or in an endogenous polypeptide having pyruvate decarboxylase activity; and (ii) a heterologous polynucleotide encoding a polypeptide having phosphoketolase activity. Another aspect of the invention relates to such a recombinant host cell further comprising (iii) a heterologous polynucleotide encoding a polypeptide having phosphotransacetylase activity.

One aspect of the invention relates to a recombinant host cell comprising (i) at least one deletion, mutation, and/or substitution in an endogenous gene encoding a polypeptide having pyruvate decarboxylase activity; and (ii) a heterologous polynucleotide encoding a polypeptide having phosphoketolase activity. Another aspect of the invention relates to a recombinant host cell further comprising: (iii) a heterologous polynucleotide encoding a polypeptide having phosphotransacetylase activity. Another aspect of invention relates to a reduced or eliminated requirement of such cells for an exogenous two-carbon substrate for its growth in culture compared to a recombinant eukaryotic host cell comprising (i) and not (ii) or (iii). Another aspect of the invention relates to the growth of such host cells in culture media that is not supplemented with an exogenous two-carbon substrate, for example, at a growth rate substantially equivalent to, or greater than, the growth rate of a host cell comprising (i) and not (ii) or (iii) in culture media supplemented with an exogenous two-carbon substrate.

In one aspect of the invention, the recombinant host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Kluyveromyces, Yarrowia, Pichia, Candida, Hansenula*, or *Saccharomyces*. In another aspect of the invention, the recombinant host cell is *S. cerevisiae*.

In another aspect of the invention, the recombinant host cell expresses a pyruvate-utilizing biosynthetic pathway including, for example, a biosynthetic pathway for a product such as 2,3-butanediol, isobutanol, 2-butanol, 2-butanone, valine, leucine, alanine, lactic acid, malic acid, fumaric acid, succinic acid, or isoamyl alcohol. Another aspect of the invention relates to expression of an isobutanol biosynthetic pathway in the recombinant host cell comprising at least one DNA molecule encoding a polypeptide that catalyzes a substrate to product conversion selected from the group consisting of (i) pyruvate to acetolactate; (ii) acetolactate to 2,3-dihydroxyisovalerate; (iii) 2,3-dihydroxyisovalerate to 2-ketoisovalerate; (iv) 2-ketoisovalerate to isobutyraldehyde; and (v) isobutyraldehyde to isobutanol. Another aspect of the invention relates to expression of a 2-butanone biosynthetic pathway in the recombinant host cell comprising at least one DNA molecule encoding a polypeptide that catalyzes a substrate to product conversion selected from the group consisting of (i) pyruvate to acetolactate; (ii) acetolactate to acetoin; (iii) acetoin to 2,3-butanediol; and (iv) 2,3-butanediol to 2-butanone.

Another aspect of the invention relates to expression of a 2-butanol biosynthetic pathway in the recombinant host cell comprising at least one DNA molecule encoding a polypeptide that catalyzes a substrate to product conversion selected from the group consisting of (i) pyruvate to acetolactate; (ii) acetolactate to acetoin; (iii) acetoin to 2,3-butanediol; (iv) 2,3-butanediol to 2-butanone; and (v) 2-butanone to 2-butanol.

One aspect of the invention relates to methods for the production of a product selected from the group consisting of 2,3-butanediol, isobutanol, 2-butanol, 2-butanone, valine, leucine, alanine, lactic acid, malic acid, fumaric acid, succinic acid and isoamyl alcohol comprising growing the recombinant host cells described herein under conditions wherein the product is produced and optionally recovering the product. Another aspect of the invention relates to methods of producing a recombinant host cell comprising transforming a host cell comprising at least one deletion, mutation, and/or substitution in an endogenous gene encoding a polypeptide having pyruvate decarboxylase activity with (i) a heterologous polynucleotide encoding a polypeptide having phosphoketolase activity; and optionally (ii) a heterologous polynucleotide encoding a polypeptide having phosphotransacetylase activity.

Another aspect of the invention relates to methods of improving the growth of a recombinant host cell comprising at least one deletion, mutation or substitution in an endogenous gene encoding a polypeptide having pyruvate decarboxylase activity, comprising (i) transforming the recombinant host cell with a heterologous polynucleotide encoding a polypeptide having phosphoketolase activity; and optionally (ii) transforming the recombinant host cell with a heterologous polynucleotide encoding a polypeptide having phosphotransacetylase activity. In embodiments, the methods further comprise growing the recombinant host cell in media containing limited carbon substrate.

Another aspect of the invention relates to methods of reducing the requirement for an exogenous two-carbon substrate for the growth of a recombinant host cell comprising at least one deletion, mutation or substitution in an endogenous gene encoding a polypeptide having pyruvate decarboxylase activity, comprising (i) transforming the host cell with a heterologous polynucleotide encoding a polypeptide having phosphoketolase activity; and optionally (ii) transforming the host cell with a heterologous polynucleotide encoding a polypeptide having phosphotransacetylase activity.

Another aspect of the invention relates to methods of eliminating the requirement for an exogenous two-carbon substrate for the growth of a recombinant host cell comprising at least one deletion, mutation or substitution in an endogenous gene encoding a polypeptide having pyruvate decarboxylase activity, comprising (i) transforming the host cell with a heterologous polynucleotide encoding a polypeptide having phosphoketolase activity; and optionally (ii) transforming the host cell with a heterologous polynucleotide encoding a polypeptide having phosphotransacetylase activity.

Still another aspect of the invention relates to methods for increasing the activity of the phosphoketolase pathway in a recombinant host cell comprising (i) providing a recombinant host cell of the invention; and (ii) growing the recombinant host cell under conditions whereby the activity of the phosphoketolase pathway in the recombinant host cell is increased.

In another aspect, the recombinant host cells comprise a phosphoketolase that matches the Profile HMM given in Table 6 with an E value of less than 7.5E-242. In another aspect, the phosphoketolase has at least about 40% identity to at least one of SEQ ID NO: 355, 379, 381, 388, 481, 486, 468, or 504. In another aspect, the phosphoketolase has at least about 90% identity to at least one of SEQ ID NO: 355, 379, 381, 388, 481, 486, 468, or 504. In another aspect, the phosphoketolase matches the Profile HMMs given in Tables 6, 7, 8, and 9 with E values of less than 7.5E-242, 1.1E-124, 2.1E-49, 7.8E-37, respectively. In another aspect, the recombinant host cells further comprise a phosphotransacetylase which matches the Profile HMM given in Table 14 with an E value of less than 5E-34. In another aspect, the phosphotransacetylase has at least about 40% identity to SEQ ID NO: 1475, 1472, 1453, 1422, 1277, 1275, 1206, 1200, 1159, or 1129. In another aspect, the phosphotransacetylase has at least about 90% identity to SEQ ID NO: 1475, 1472, 1453, 1422, 1277, 1275, 1206, 1200, 1159, or 1129

BRIEF DESCRIPTION OF THE DRAWINGS/FIGURES AND INCORPORATION OF SEQUENCE LISTING AND TABLES

The various embodiments of the invention can be more fully understood from the detailed description, the figures, and the accompanying sequence descriptions, which form a part of this application.

Figure 4:
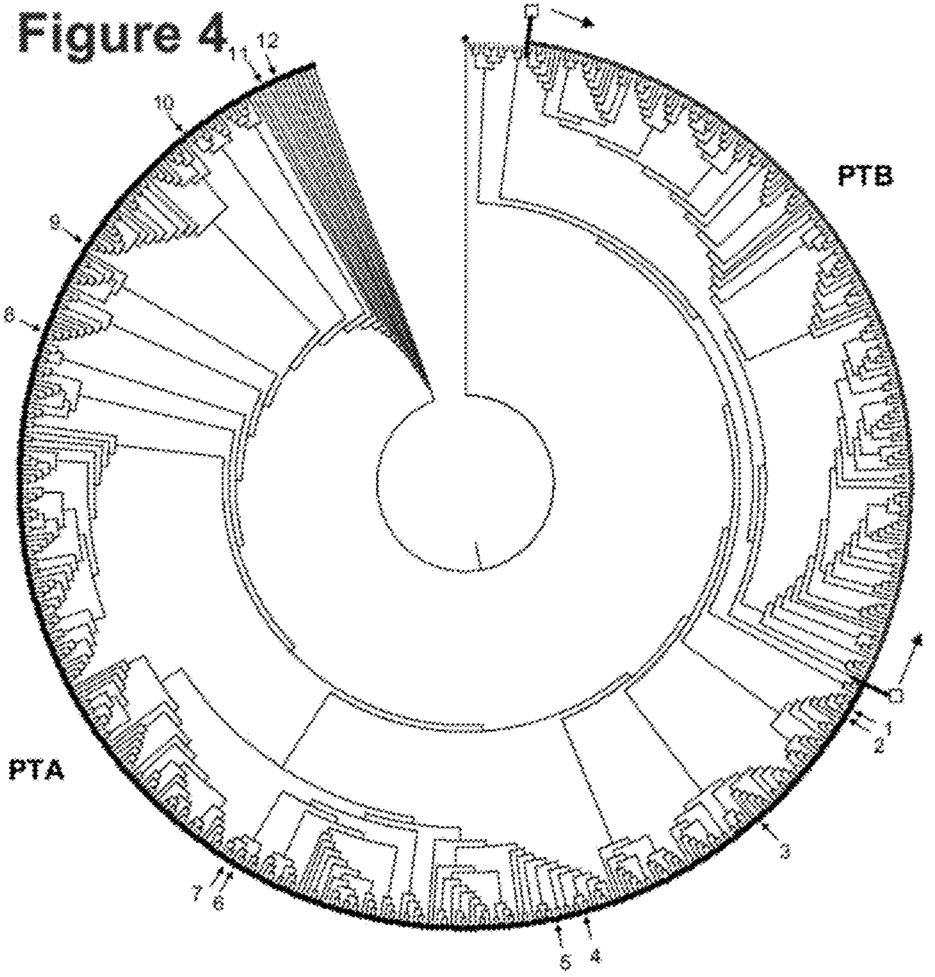
Figure 5:
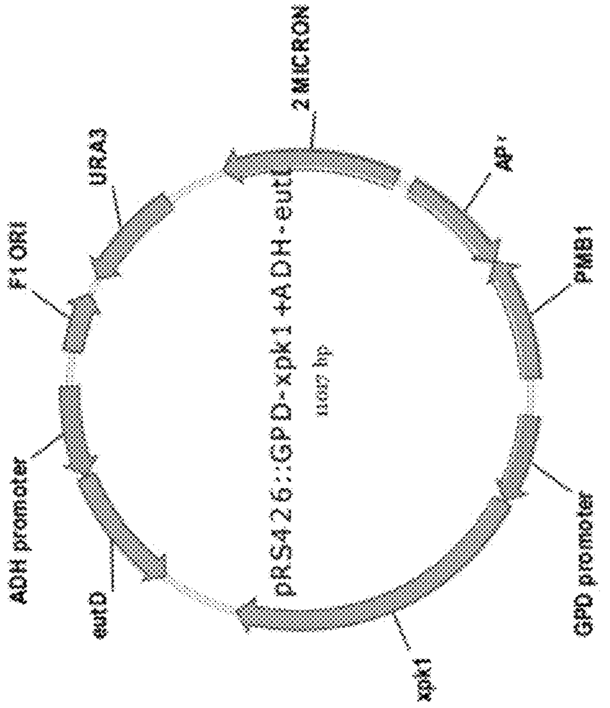

FIG. 4 depicts a phylogenetic tree of phosphate acetyltransferase (PTA) and phosphate butyryltransferase (PTB) sequences. Multiple sequence alignment was performed with Clustal X using default parameters. Phylogenetic tree was deduced using neighbor joining method and drawn with Mega 4 software. Marked sequences are as follows: (#, Species, GI#) 1, *S. enterica,* 56412650; 2, *E. coli* K12, 88192043; 3, *V. parvula,* 227371784; 4, *C. kluyveri,* 153954015; 5, *C. Acetobutylicum,* 15895019; 6, *C. thermocellum,* 196254011; 7, *M. thermophile,* 88192043; 8, *S. pyogenes,* 48425286; 9, *B. subtilis,* 58176784; 10, *L. fermentum,* 227514417; 11, *L. plantarum,* 28377658; 12, *L. sanfranciscensis,* 11862872;

FIG. 5 is a plasmid map of pRS426::GPD-xpk1+ADH-eutD map which is described herein.

Figure 6:
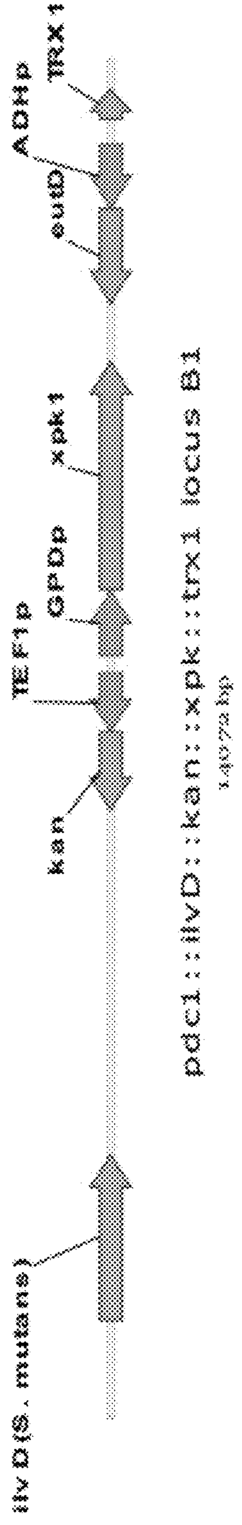

FIG. 6 depicts the Δpdc1::ilvD(Sm) locus of BP913 after integration of a phosphoketolase pathway vector (described herein).

Figure 7A:
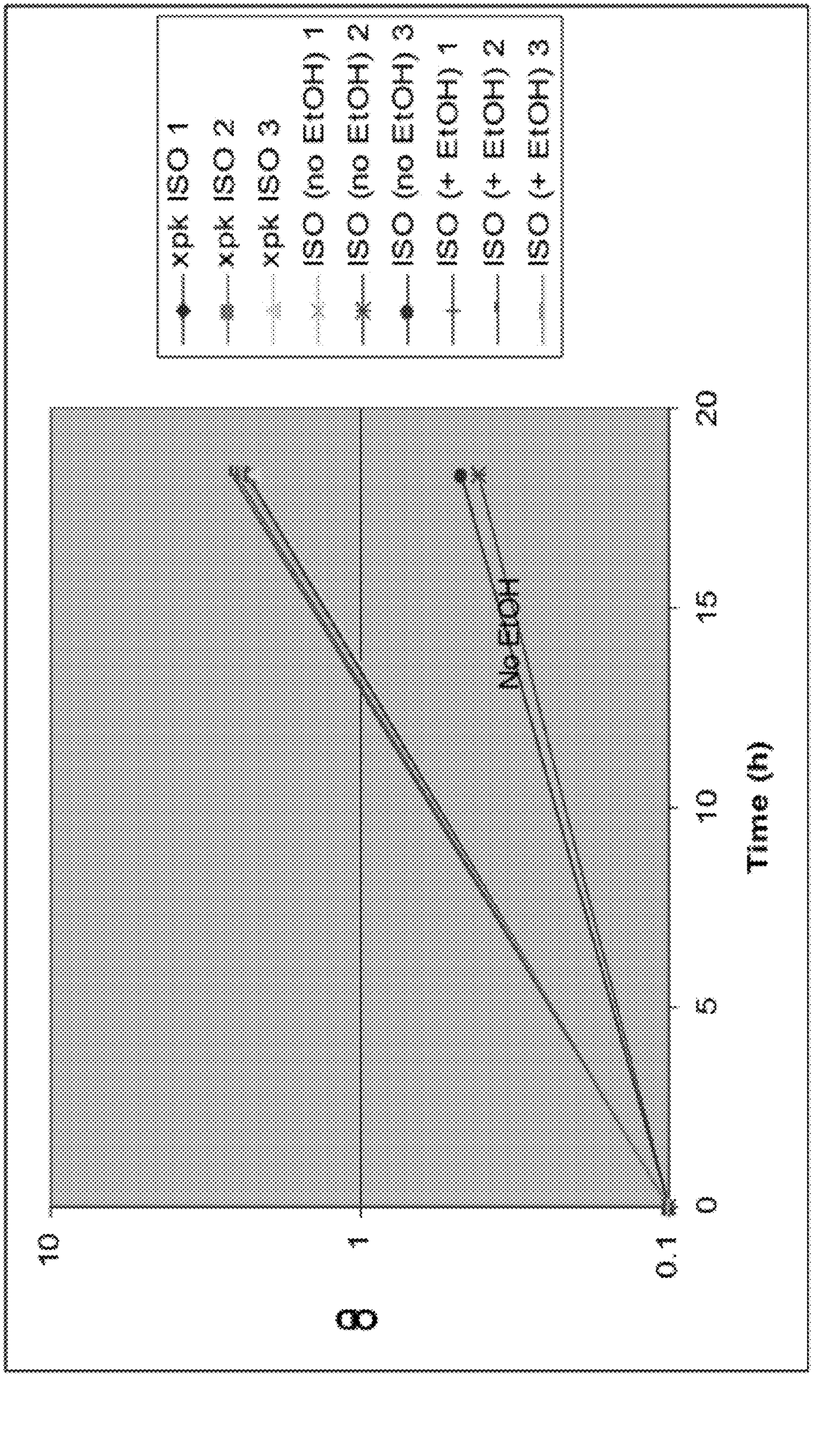

FIG. 7A shows the growth of an isobutanol-producing strain in the absence (no ETOH) and presence (+ETOH) of EtOH and the absence and presence of the phosphoketolase pathway (xpk). ISO1, ISO2 and ISO3 refer to replicates.

Figure 7B:
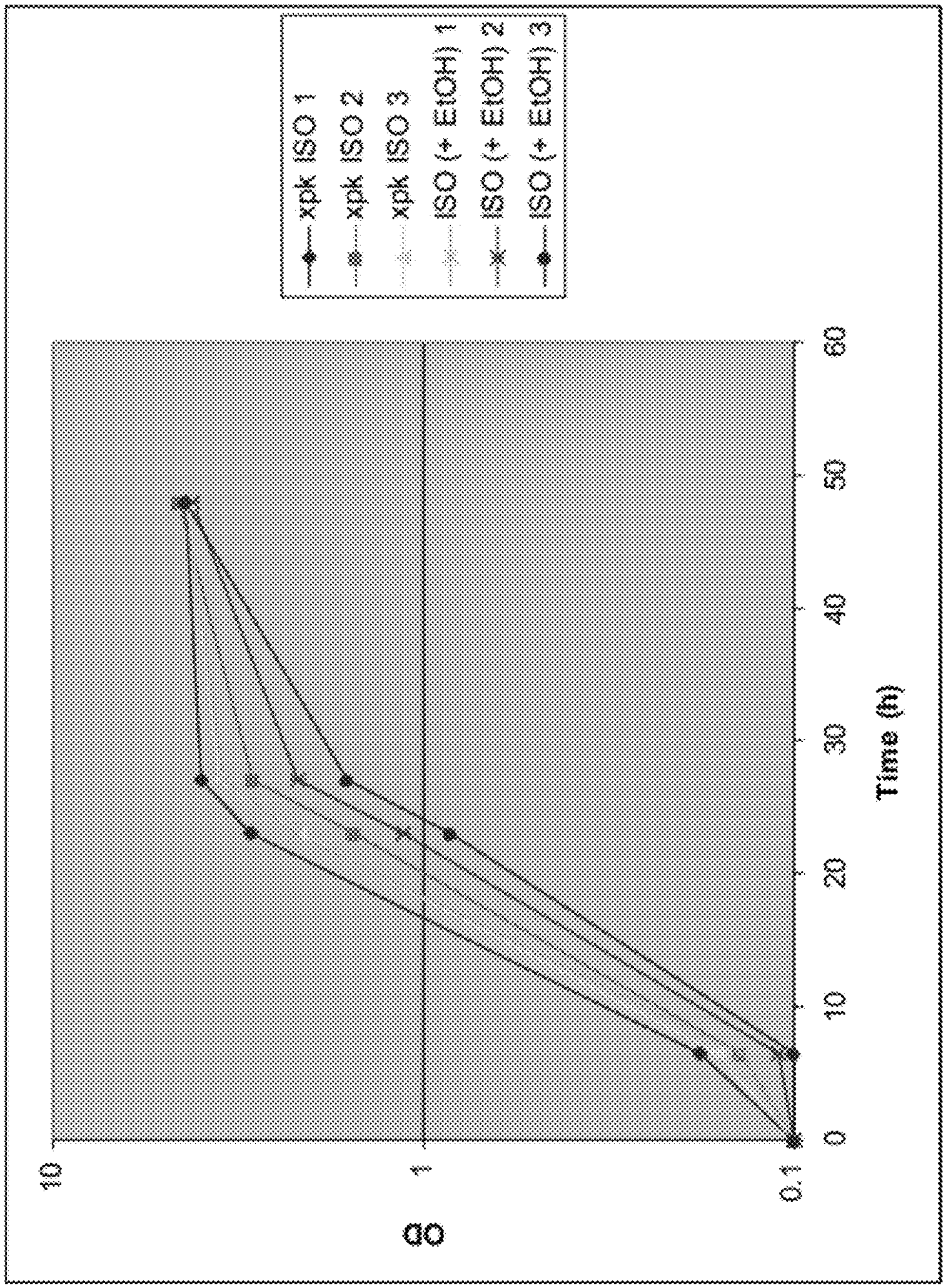

FIG. 7B shows the growth of a second subculture of strains from FIG. 7A.

Tables 6, 7, 8, 9, and 14 are tables of the Profile HMMs described herein. Table 6, 7, 8, 9, and 14 are submitted herewith electronically and are incorporated herein by reference.

The invention can be more fully understood from the following detailed description and the accompanying sequence descriptions which form a part of this application.

The sequence listing provided herewith is herein incorporated by reference and conforms with 37 C.F.R. 1.821-1.825 ("Requirements for Patent Applications Containing Nucleotide Sequences and/or Amino Acid Sequence Disclosures—the Sequence Rules") and is consistent with World Intellectual Property Organization (WIPO) Standard ST.25 (2009) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822. The content of the electronically submitted sequence listing Name: 20110615_CL4871USNA SeqList.txt; Size: 6.67 MB; and Date of Creation/Modification: Jun. 9, 2011/Jun. 15, 2011 is incorporated herein by reference in its entirety.

SEQ ID NOs: 1-20 are sequences of PDC target gene coding regions and proteins.

SEQ ID NOs: 21-638 are phosphoketolase target gene coding regions and proteins.

SEQ ID NOs: 762-1885 are phosphotransacetylase target gene coding regions and proteins.

SEQ ID NOs: 1893-1897 are hybrid promoter sequences.

SEQ ID NOs: 639-642, 644-654, 656-660, 662-701-714, 725-726, 729-740, 742-748, and 750-761 are primers.

SEQ ID NO: 643 is the vector pRS426::GPD-xpk1+ADH1-eutD.

SEQ ID NO: 655 is the TEF1p-kan-TEF1t gene.

SEQ ID NO: 661 is vector pLA54.

SEQ ID NO: 715 is vector pRS423::pGAL1-cre.

SEQ ID NO: 716 is the vector pLH468-sadB.

SEQ ID NOs: 717 and 718 are the amino acid and nucleic acid sequences for sadB from *Achromobacter xylosoxidans.*

SEQ ID NO: 719 is the kivD coding region from *L. lactis.*

SEQ ID NO: 720 is the plasmid pRS425::GPM-sadB.

SEQ ID NO: 721 is the GPM promoter.

SEQ ID NO: 722 is the ADH1 terminator.

SEQ ID NO: 723 is the GPM-sadB-ADHt segment.

SEQ ID NO: 724 is the pUC19-URA3 plasmid.

SEQ ID NO: 741 is the ilvD-FBA1t segment.

SEQ ID NO: 749 is URA3r2 template DNA.

SEQ ID NO: 1886 is the ilvD coding region from *S. mutans.*

SEQ ID NO: 1888 is vector pLH468.

SEQ ID NO: 1898 is pUC19-URA3::pdc1::GPD-xpk1+ADH1-eutD.

SEQ ID NOs: 1899-1906 are the sequences of modified *S. cerevisiae* loci.

SEQ ID NO: 1907 is the sequence of pLH702.

SEQ ID NO: 1908 is the sequence of pYZ067DkivDDhADH.

SEQ ID NO: 1909 is the amino acid sequence of ALD6.

SEQ ID NO: 1910 is the amino acid sequence of K9D3.

SEQ ID NO: 1911 is the amino acid sequence of K9G9.

SEQ ID NO: 1912 is the amino acid sequence of YMR226c.

SEQ ID NOs: 1913 and 1914 are the nucleic acid and amino acid sequences of AFT1.

SEQ ID NOs: 1915 and 1916 are the nucleic acid and amino acid sequences of AFT2.

SEQ ID NOs: 1917 and 1918 are the nucleic acid and amino acid sequences of FRA2.

SEQ ID NOs: 1919 and 1920 are the nucleic acid and amino acid sequences of GRX3.

SEQ ID NOs: 1921 and 1922 are the nucleic acid and amino acid sequences of CCC1.

SEQ ID NO: 1923 is the amino acid sequence of an alcohol dehydrogenase from *Beijerinkia indica.*

DETAILED DESCRIPTION OF THE INVENTION

Applicants have solved the stated problem by reducing or eliminating the need for providing two substrates, one of which is converted to a desired product, the other fully or partly into acetyl-CoA by recombinant host cells requiring such supplementation for growth comprising the expression of enzymes of the phosphoketolase pathway in such cells. One such enzyme, phosphoketolase (Enzyme Commission Number EC 4.1.2.9), catalyzes the conversion of xylulose 5-phosphate into glyceraldehyde 3-phosphate and acetyl-phosphate (Heath et al., *J. Biol. Chem.* 231: 1009-29; 1958). Another such enzyme is phosphotransacetylase (Enzyme Commission Number EC 2.3.1.8) which converts acetyl-phosphate into acetyl-CoA.

Applicants have provided PDC-KO recombinant host cells comprising a heterologous polynucleotide encoding a polypeptide having phosphoketolase activity, and optionally a heterologous polynucleotide encoding a polypeptide having phosphotransacetylase activity. Such cells exhibit a reduced or eliminated requirement for exogenous two-carbon substrate supplementation for their growth compared to PDC-KO cells. Applicants have also provided methods of making and using such recombinant host cells including, for example, methods of increasing cell growth, methods of reducing or eliminating the requirement of an exogenous two-carbon substrate for cell growth, methods of increasing glucose consumption and methods of increasing the production of a product of a pyruvate-utilizing pathway.

Unless defined otherwise, all technical and scientific terms used herein have the same meaning as commonly understood by one of ordinary skill in the art to which this invention belongs. In case of conflict, the present application including the definitions will control. Unless otherwise required by context, singular terms shall include pluralities and plural terms shall include the singular. All publications, patents and other references mentioned herein are incorporated by reference in their entireties for all purposes as if each individual publication or patent application were specifically and individually indicated to be incorporated by reference, unless only specific sections of patents or patent publications are indicated to be incorporated by reference.

Although methods and materials similar or equivalent to those described herein can be used in practice or testing of the present invention, suitable methods and materials are described below. The materials, methods and examples are illustrative only and are not intended to be limiting. Other features and advantages of the invention will be apparent from the detailed description and from the claims.

In order to further define this invention, the following terms, abbreviations and definitions are provided.

As used herein, the terms "comprises," "comprising," "includes," "including," "has," "having," "contains," or "containing," or any other variation thereof, are intended to be non-exclusive or open-ended. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "butanol" as used herein, refers to 2-butanol, 1-butanol, isobutanol, or mixtures thereof.

The term "pyruvate-utilizing biosynthetic pathway" refers to an enzyme pathway to produce a biosynthetic product from pyruvate.

The term "isobutanol biosynthetic pathway" refers to an enzyme pathway to produce isobutanol from pyruvate.

The term "2-butanol biosynthetic pathway" refers to an enzyme pathway to produce 2-butanol from pyruvate.

The term "2-butanone biosynthetic pathway" refers to an enzyme pathway to produce 2-butanone from pyruvate.

The terms "pdc−," "PDC knock-out," or "PDC-KO" as used herein refer to a cell that has a genetic modification to inactivate or reduce expression of at least one gene encoding pyruvate decarboxylase (PDC) so that the cell substantially or completely lacks pyruvate decarboxylase enzyme activity. If the cell has more than one expressed (active) PDC gene, then each of the active PDC genes may be inactivated or have minimal expression thereby producing a pdc− cell.

The term "carbon substrate" refers to a carbon source capable of being metabolized by the recombinant host cells disclosed herein. Non-limiting examples of carbon substrates are provided herein and include, but are not limited to, monosaccharides, oligosaccharides, polysaccharides, ethanol, lactate, succinate, glycerol, carbon dioxide, methanol, glucose, fructose, sucrose, xylose, arabinose, dextrose, or mixtures thereof.

The term "exogenous two-carbon substrate" refers to the carbon source provided to be metabolized into acetyl-CoA by a host cell that lacks the ability to convert pyruvic acid into acetyl-CoA. The term is used to distinguish from the carbon substrate which is converted into a pyruvate-derived product by a pyruvate-utilizing biosynthetic pathway, herein also referred to as the "pathway substrate" which includes, for example, glucose.

The term "polynucleotide" is intended to encompass a singular nucleic acid as well as plural nucleic acids, and refers to a nucleic acid molecule or construct, e.g., messenger RNA (mRNA) or plasmid DNA (pDNA). A polynucleotide can contain the nucleotide sequence of the full-length cDNA sequence, or a fragment thereof, including the untranslated 5' and 3' sequences and the coding sequences. The polynucleotide can be composed of any polyribonucleotide or polydeoxyribonucleotide, which may be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. "Polynucleotide" embraces chemically, enzymatically, or metabolically modified forms.

A polynucleotide sequence may be referred to as "isolated," in which it has been removed from its native environment. For example, a heterologous polynucleotide encoding a polypeptide or polypeptide fragment having dihydroxy-acid dehydratase activity contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA may be comprised of one or more segments of cDNA, genomic DNA or synthetic DNA.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Endogenous gene" refers to a native gene in its natural location in the genome of an organism. A "heterologous gene" refers to a gene not normally found in the host organism, but that is introduced into the host organism by gene transfer. "Heterologous gene" includes a native coding region, or portion thereof, that is reintroduced into the source organism in a form that is different from the corresponding native gene. For example, a heterologous gene may include a native coding region that is a portion of a chimeric gene including non-native regulatory regions that is reintroduced into the native host. Foreign genes can comprise native genes inserted into a non-native organism, or chimeric genes.

As used herein the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, the term "variant" refers to a polypeptide differing from a specifically recited polypeptide of the invention by amino acid insertions, deletions, mutations, and substitutions, created using, e.g., recombinant DNA techniques, such as mutagenesis. Guidance in determining which amino acid residues may be replaced, added, or deleted without abolishing activities of interest, may be found by comparing the sequence of the particular polypeptide with that of homologous polypeptides, e.g., yeast or bacterial, and minimizing the number of amino acid sequence changes made in regions of high homology (conserved regions) or by replacing amino acids with consensus sequences.

Alternatively, recombinant polynucleotide variants encoding these same or similar polypeptides may be synthesized or selected by making use of the "redundancy" in the genetic code. Various codon substitutions, such as silent changes which produce various restriction sites, may be introduced to optimize cloning into a plasmid or viral vector for expression. Mutations in the polynucleotide sequence may be reflected in the polypeptide or domains of other peptides added to the polypeptide to modify the properties of any part of the polypeptide.

Amino acid "substitutions" may be the result of replacing one amino acid with another amino acid having similar structural and/or chemical properties, i.e., conservative amino acid replacements, or they may be the result of replacing one amino acid with an amino acid having different structural and/or chemical properties, i.e., non-conservative amino acid replacements. "Conservative" amino acid substitutions may be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions may be made by selecting the differences in polarity, charge, solubility, hydrophobicity, hydrophilicity, or the amphipathic nature of any of these amino acids. "Insertions" or "deletions" may be within the range of variation as structurally or functionally tolerated by the recombinant proteins. The variation allowed may be experimentally determined by systematically making insertions, deletions, or substitutions of amino acids in a polypeptide molecule using recombinant DNA techniques and assaying the resulting recombinant variants for activity.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters." It is further recognized that since in most cases the exact boundaries of regulatory sequences have not been completely defined, DNA fragments of different lengths may have identical promoter activity. For example, it will be understood that "FBA1 promoter" can be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences have not been completely defined, DNA fragments of different lengths may have identical terminator activity. For example, it will be understood that "CYC1 terminator" can be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression," as used herein, refers to the transcription and stable accumulation of sense (mRNA) or antisense RNA derived from the nucleic acid fragment of the invention. Expression may also refer to translation of mRNA into a polypeptide.

The term "overexpression," as used herein, refers to expression that is higher than endogenous expression of the same or related gene. A heterologous gene is overexpressed if its expression is higher than that of a comparable endogenous gene.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

| | T | C | A | G |
|---|---|---|---|---|
| T | TTT Phe (F) | TCT Ser (S) | TAT Tyr (Y) | TGT Cys (C) |
| | TTC Phe (F) | TCC Ser (S) | TAC Tyr (Y) | TGC |
| | TTA Leu (L) | TCA Ser (S) | TAA **Stop** | TGA **Stop** |
| | TTG Leu (L) | TCG Ser (S) | TAG **Stop** | TGG Trp (W) |
| C | CTT Leu (L) | CCT Pro (P) | CAT His (H) | CGT Arg (R) |
| | CTC Leu (L) | CCC Pro (P) | CAC His (H) | CGC Arg (R) |
| | CTA Leu (L) | CCA Pro (P) | CAA Gln (Q) | CGA Arg (R) |
| | CTG Leu (L) | CCG Pro (P) | CAG Gln (Q) | CGG Arg (R) |
| A | ATT Ile (I) | ACT Thr (T) | AAT Asn (N) | AGT Ser (S) |
| | ATC Ile (I) | ACC Thr (T) | AAC Asn (N) | AGC Ser (S) |
| | ATA Ile (I) | ACA Thr (T) | AAA Lys (K) | AGA Arg (R) |
| | **ATG** Met (M) | ACG Thr (T) | AAG Lys (K) | AGG Arg (R) |
| G | GTT Val (V) | GCT Ala (A) | GAT Asp (D) | GGT Gly (G) |
| | GTC Val (V) | GCC Ala (A) | GAC Asp (D) | GGC Gly (G) |
| | GTA Val (V) | GCA Ala (A) | GAA Glu (E) | GGA Gly (G) |
| | GTG Val (V) | GCG Ala (A) | GAG Glu (E) | GGG Gly (G) |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at the "Codon Usage Database" available at http://www.kazusa.or.jp/codon/ (visited Mar. 20, 2008), and these tables can be adapted in a number of ways. See Nakamura, Y., et al. *Nucl. Acids Res.* 28:292 (2000). Codon usage tables for yeast, calculated from GenBank Release 128.0 [15 Feb. 2002], are reproduced below as Table 2. This table uses mRNA nomenclature, and so instead of thymine (T) which is found in DNA, the tables use uracil (U) which is found in RNA. Table 2 has been adapted so that frequencies are calculated for each amino acid, rather than for all 64 codons.

TABLE 2

Codon Usage Table for *Saccharomyces cerevisiae* Genes

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |

TABLE 2-continued

Codon Usage Table for *Saccharomyces cerevisiae* Genes

| Amino Acid | Codon | Number | Frequency per thousand |
|---|---|---|---|
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the Vector NTI Suite, available from InforMax, Inc., Bethesda, Md., and the "backtranslate" function in the GCG-Wisconsin Package, available from Accelrys, Inc., San Diego, Calif. In addition, various resources are publicly available to codon-optimize coding region sequences, e.g., the "backtranslation" function at http://www.entelechon.com/bioinformatics/backtranslation.php?lang=eng (visited Apr. 15, 2008) and the "backtranseq" function available at http://bioinfo.pbi.nrc.ca:8090/EMBOSS/index.html (visited Jul. 9, 2002). Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" (http://phenotype.biosci.umbc.edu/codon/sgd/index.php).

A polynucleotide or nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual,* $2^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.,* 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, CABIOS. 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, such as from other species, wherein such polypeptides have the same or similar function or activity. Useful examples of percent identities include, but are not limited to: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res*., [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Other molecular tools and techniques are known in the art and include splicing by overlapping extension polymerase chain reaction (PCR) (Yu, et al. (2004) Fungal Genet. Biol. 41:973-981), positive selection for mutations at the URA3 locus of *Saccharomyces cerevisiae* (Boeke, J. D. et al. (1984) Mol. Gen. Genet. 197, 345-346; M A Romanos, et al. Nucleic Acids Res. 1991 Jan. 11; 19(1): 187), the cre-lox site-specific recombination system as well as mutant lox sites and FLP substrate mutations (Sauer, B. (1987) Mol Cell Biol 7: 2087-2096; Senecoff, et al. (1988) Journal of Molecular Biology,
Volume 201, Issue 2, Pages 405-421; Albert, et al. (1995) The Plant Journal. Volume 7, Issue 4, pages 649-659), "seamless" gene deletion (Akada, et al. (2006) Yeast; 23(5):399-405), andgap repair methodology (Ma et al., *Genetics* 58:201-216; 1981). Applicants have discovered that activation of the phosphoketolase pathway in a recombinant host cell comprising a modification in an endogenous gene encoding a polypeptide having pyruvate decarboxylase activity or a modification in an endogenous polypeptide having pyruvate decarboxylase activity, reduces or eliminates the need for an exogenous carbon substrate for the growth of such a cell. In embodiments, the recombinant host cells comprise (i) at least one deletion, mutation and/or substitution in an endogenous gene encoding a polypeptide having pyruvate decarboxylase activity); (ii) a heterologous polynucleotide encoding a polypeptide having phosphoketolase activity; and optionally (iii) a heterologous polynucleotide encoding a polypeptide having phosphotransacetylase activity.

The genetic manipulations of the host cells described herein can be performed using standard genetic techniques and screening and can be made in any host cell that is suitable to genetic manipulation (*Methods in Yeast Genetics,* 2005, Cold Spring Harbor Laboratory Press, Cold Spring Harbor, N.Y., pp. 201-202). In embodiments, the recombinant host cells disclosed herein can be any bacteria, yeast or fungi host useful for genetic modification and recombinant gene expression. In other embodiments, a recombinant host cell can be a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Kluyveromyces, Yarrowia, Pichia, Candida, Hansenula, Issatchenkia*, or *Saccharomyces*. In other embodiments, the host cell can be *Saccharomyces cerevisiae, Schizosaccharomyces pombe, Kluyveromyces lactis, Kluyveromyces thermotolerans, Kluyveromyces marxianus, Candida glabrata, Candida albicans, Pichia stipitis, Yarrowia lipolytica, E. coli*, or *L. plantarum*. In still other embodiments, the host cell is a yeast host cell. In some embodiments, the host cell is a member of the genera *Saccharomyces*. In some embodiments, the host cell is *Kluyveromyces lactis, Candida glabrata* or *Schizosaccharomyces pombe*. In some embodiments, the host cell is *Saccharomyces cerevisiae. S. cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *S. cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Sources of Acetyl-CoA

Acetyl-CoA is a major cellular building block, required for the synthesis of fatty acids, sterols, and lysine. Pyruvate is often a major contributor to the acetyl-CoA pool. Pyruvate dehydrogenase catalyzes the direct conversion of pyruvate to acetyl-CoA (E.C. 1.2.4.1, E.C. 1.2.1.51) or acetate (E.C. 1.2.2.2) and is almost ubiquitous in nature. Other enzymes involved in conversion of pyruvate to acetyl-CoA, acetyl-phosphate or acetate include pyruvate-formate lyase (E.C. 2.3.1.54), pyruvate oxidase (E.C. 1.2.3.3, E.C. 1.2.3.6), pyruvate-ferredoxin oxidoreductase (E.C. 1.2.7.1), and pyruvate decarboxylase (E.C. 4.1.1.1). Genetic modifications made to a host cell to conserve the pyruvate pool for a product of interest may include those that restrict conversion to acetyl-CoA, leading to decreased growth in the absence of an exogenously supplied two-carbon substrate, a carbon substrate that can be readily converted to acetyl-CoA independent of pyruvate (e.g. ethanol or acetate). An example is the documented auxotrophy observed in pyruvate decarboxylase deficient *Saccharomyces cerevisiae* (Flikweert et al. 1999, supra). Another example is the documented auxotrophy observed in pyruvate dehydrogenase deficient *Escherichia coli* when grown aerobically on glucose (Langley and Guest, 1977, J. Gen. Microbiol. 99:2630276).

Modification of Pyruvate Decarboxylase

In embodiments, the recombinant host cells disclosed herein comprise a modification in an endogenous polynucleotide encoding a polypeptide having pyruvate decarboxylase (PDC) or a modification in an endogenous polypeptide having PDC activity. In embodiments, the recombinant host cells disclosed herein can have a modification or disruption of one or more polynucleotides, genes or polypeptides encoding PDC. In embodiments, the recombinant host cell comprises at least one deletion, mutation, and/or substitution in one or more endogenous polynucleotides or genes encoding a polypeptide having PDC activity, or in one or more endogenous polypeptides having PDC activity. Such modifications, disruptions, deletions, mutations, and/or substitutions can result in PDC activity that is reduced or eliminated, resulting in a PDC knock-out (PDC-KO) phenotype.

In embodiments, the endogenous pyruvate decarboxylase activity of the recombinant host cells disclosed herein converts pyruvate to acetaldehyde, which can then be converted to ethanol or to acetyl-CoA via acetate.

In embodiments, the recombinant host cell is *Kluyveromyces lactis* containing one gene encoding pyruvate decarboxylase, *Candida glabrata* containing one gene encoding pyruvate decarboxylase, or *Schizosaccharomyces pombe* containing one gene encoding pyruvate decarboxylase.

In other embodiments, the recombinant host cell is *Saccharomyces cerevisiae* containing three isozymes of pyruvate decarboxylase encoded by the pdc1, pdc5, and pdc6 genes, as well as a pyruvate decarboxylase regulatory gene, pdc2. In a non-limiting example in *S. cerevisiae*, the pdc1 and pdc5 genes, or all three genes, are disrupted. In another non-limiting example in *S. cerevisiae*, pyruvate decarboxylase activity may be reduced by disrupting the pdc2 regulatory gene. In another non-limiting example in *S. cerevisiae*, polynucleotides or genes encoding pyruvate decarboxylase proteins such as those having about 70% to about 75%, about 75% to about 80%, about 80% to about 85%, about 85% to about 90%, about 90% to about 95%, about 96%, about 97%, about 98%, or about 99% sequence identity to pdc1 or pdc5 can be disrupted.

In embodiments, the polypeptide having PDC activity or the polynucleotide or gene encoding a polypeptide having PDC activity is associated with Enzyme Commission Number EC 4.1.1.1. In other embodiments, a PDC gene of the recombinant host cells disclosed herein is not active under the fermentation conditions used, and therefore such a gene would not need to be modified or inactivated.

Examples of recombinant host cells with reduced pyruvate decarboxylase activity due to disruption of pyruvate decarboxylase encoding genes have been reported, such as for *Saccharomyces* in Flikweert et al. (*Yeast* (1996) 12:247-257), for *Kluyveromyces* in Bianchi et al. (*Mol. Microbiol.* (1996) 19(1):27-36), and disruption of the regulatory gene in Hohmann (*Mol. Gen. Genet.* (1993) 241:657-666). *Saccharomyces* strains having no pyruvate decarboxylase activity are available from the ATCC with Accession #200027 and #200028.

Examples of PDC polynucleotides, genes and polypeptides that can be targeted for modification or inactivation in the recombinant host cells disclosed herein include, but are not limited to, those of the following table.

TABLE 3

SEQ ID NOs of pyruvate decarboxylase (PDC) target gene coding regions and proteins.

| Description | SEQ ID NO: Nucleic acid | SEQ ID NO: Amino acid |
|---|---|---|
| PDC1 pyruvate decarboxylase from *Saccharomyces cerevisiae* | 1 | 2 |
| PDC5 pyruvate decarboxylase from *Saccharomyces cerevisiae* | 3 | 4 |
| PDC6 pyruvate decarboxylase from *Saccharomyces cerevisiae* | 5 | 6 |
| pyruvate decarboxylase from *Candida glabrata* | 7 | 8 |
| PDC1 pyruvate decarboxylase from *Pichia stipitis* | 9 | 10 |
| PDC2 pyruvate decarboxylase from *Pichia stipitis* | 11 | 12 |
| pyruvate decarboxylase from *Kluyveromyces lactis* | 13 | 14 |
| pyruvate decarboxylase from *Yarrowia lipolytica* | 15 | 16 |
| pyruvate decarboxylase from *Schizosaccharomyces pombe* | 17 | 18 |
| pyruvate decarboxylase from *Zygosaccharomyces rouxii* | 18 | 20 |

Other examples of PDC polynucleotides, genes and polypeptides that can be targeted for modification or inactivation in the recombinant host cells disclosed herein include, but are not limited to, PDC polynucleotides, genes and/or polypeptides having at least about 70% to about 75%, about 75% to about 80%, about 80% to about 85%, about 85% to about 90%, about 90% to about 95%, about 96%, about 97%, about 98%, or about 99% sequence identity to any one of the sequences of Table 3.

In embodiments, the sequences of other PDC polynucleotides, genes and/or polypeptides can be identified in the literature and in bioinformatics databases well known to the skilled person using sequences disclosed herein and available in the art. For example, such sequences can be identified through BLAST (as described above) searching of publicly available databases with known PDC encoding polynucleotide or polypeptide sequences. In such a method, identities can be based on the Clustal W method of alignment using the default parameters of GAP PENALTY=10, GAP LENGTH PENALTY=0.1, and Gonnet 250 series of protein weight matrix.

Additionally, the PDC polynucleotide or polypeptide sequences described herein or known the art can be used to identify other PDC homologs in nature. For example, each of the PDC encoding nucleic acid fragments described herein can be used to isolate genes encoding homologous proteins. Isolation of homologous genes using sequence-dependent protocols is well known in the art. Examples of sequence-dependent protocols include, but are not limited to (1) methods of nucleic acid hybridization; (2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., *Proc. Acad. Sci. USA* 82:1074 (1985); or strand displacement amplification (SDA), Walker et al., *Proc. Natl. Acad. Sci. U.S.A.*, 89:392 (1992)]; and (3) methods of library construction and screening by complementation.

In embodiments, PDC polynucleotides, genes and/or polypeptides related to the recombinant host cells described herein can be modified or disrupted. Many methods for genetic modification and disruption of target genes to reduce or eliminate expression are known to one of ordinary skill in the art and can be used to create the recombinant host cells described herein. Modifications that can be used include, but are not limited to, deletion of the entire gene or a portion of the gene encoding a PDC protein, inserting a DNA fragment into the encoding gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less active protein is expressed. In other embodiments, expression of a target gene can be blocked by expression of an antisense RNA or an interfering RNA, and constructs can be introduced that result in cosuppression. In other embodiments, the synthesis or stability of the transcript can be lessened by mutation. In embodiments, the efficiency by which a protein is translated from mRNA can be modulated by mutation. All of these methods can be readily practiced by one skilled in the art making use of the known or identified sequences encoding target proteins.

In other embodiments, DNA sequences surrounding a target PDC coding sequence are also useful in some modification procedures and are available, for example, for yeasts such as *Saccharomyces cerevisiae* in the complete genome sequence coordinated by Genome Project ID9518 of Genome Projects coordinated by NCBI (National Center for Biotechnology Information) with identifying GOPID #13838. An additional non-limiting example of yeast genomic sequences is that of *Candida albicans*, which is included in GPID #10771, #10701 and #16373. Other yeast genomic sequences can be readily found by one of skill in the art in publicly available databases.

In other embodiments, DNA sequences surrounding a target PDC coding sequence can be useful for modification methods using homologous recombination. In a non-limiting example of this method, PDC gene flanking sequences can be placed bounding a selectable marker gene to mediate homologous recombination whereby the marker gene replaces the PDC gene. In another non-limiting example, partial PDC gene sequences and PDC gene flanking sequences bounding a selectable marker gene can be used to mediate homologous recombination whereby the marker gene replaces a portion of the target PDC gene. In embodiments, the selectable marker can be bounded by site-specific recombination sites, so that following expression of the corresponding site-specific recombinase, the resistance gene is excised from the PDC gene without reactivating the latter. In embodiments, the site-specific recombination leaves behind a recombination site which disrupts expression of the PDC protein. In other embodiments, the homologous recombination vector can be constructed to also leave a deletion in the PDC gene following excision of the selectable marker, as is well known to one skilled in the art.

In other embodiments, deletions can be made to a PDC target gene using mitotic recombination as described in Wach et al. (*Yeast,* 10:1793-1808; 1994). Such a method can involve preparing a DNA fragment that contains a selectable marker between genomic regions that can be as short as 20 bp, and which bound a target DNA sequence. In other embodiments, this DNA fragment can be prepared by PCR amplification of the selectable marker gene using as primers oligonucleotides that hybridize to the ends of the marker gene and that include the genomic regions that can recombine with the yeast genome. In embodiments, the linear DNA fragment can be efficiently transformed into yeast and recombined into the genome resulting in gene replacement including with deletion of the target DNA sequence ((as described, for example, in *Methods in Enzymology*, Volume 194, Guide to Yeast Genetics and Molecular and Cell Biology (Part A, 2004, Christine Guthrie and Gerald R. Fink (Eds.), Elsevier Academic Press, San Diego, Calif.)).

Moreover, promoter replacement methods can be used to exchange the endogenous transcriptional control elements allowing another means to modulate expression such as described in Mnaimneh et al. ((2004) *Cell* 118(1):31-44).

In other embodiments, the PDC target gene encoded activity can be disrupted using random mutagenesis, which can then be followed by screening to identify strains with dependency on carbon substrates for growth. In this type of method, the DNA sequence of the target gene encoding region, or any other region of the genome affecting carbon substrate dependency for growth, need not be known. In embodiments, a screen for cells with reduced PDC activity and/or two-carbon substrate dependency, or other mutants having reduced PDC activity and a reduced or eliminated dependency for exogenous two-carbon substrate for growth, can be useful as recombinant host cells of the invention.

Methods for creating genetic mutations are common and well known in the art and can be applied to the exercise of creating mutants. Commonly used random genetic modification methods (reviewed in *Methods in Yeast Genetics,* 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of host cells can involve, but is not limited to, treatment with one of the following DNA mutagens: ethyl methanesulfonate (EMS), nitrous acid, diethyl sulfate, or N-methyl-N'-nitro-N-nitroso-guanidine (MNNG). Such methods of mutagenesis have been reviewed in Spencer et al. (Mutagenesis in Yeast, 1996, *Yeast Protocols: Methods in Cell and Molecular Biology*. Humana Press, Totowa, N.J.). In embodiments, chemical mutagenesis with EMS can be performed as described in *Methods in Yeast Genetics,* 2005, Cold Spring Harbor Laboratory Press, Cold Spring Harbor, N.Y. Irradiation with ultraviolet (UV) light or X-rays can also be used to produce random mutagenesis in yeast cells. The primary effect of mutagenesis by UV irradiation is the formation of pyrimidine dimers which disrupt the fidelity of DNA replication. Protocols for UV-mutagenesis of yeast can be found in Spencer et al. (Mutagenesis in Yeast, 1996, *Yeast Protocols: Methods in Cell and Molecular Biology*. Humana Press, Totowa, N.J.). In embodiments, the introduction of a mutator phenotype can also be used to generate random chromosomal mutations in host cells. In embodiments, common mutator phenotypes can be obtained through disruption of one or more of the following genes: PMS1, MAG1, RAD18 or RAD51. In other embodiments, restoration of the non-mutator phenotype can be obtained by insertion of the wildtype allele. In other embodiments, collections of modified cells produced from any of these or other known random mutagenesis processes may be screened for reduced or eliminated PDC activity.

Genomes have been completely sequenced and annotated and are publicly available for the following yeast strains: *Ashbya gossypii* ATCC 10895, *Candida glabrata* CBS138, *Kluyveromyces lactis* NRRL Y-1140, *Pichia stipitis* CBS 6054, *Saccharomyces cerevisiae* S288c, Schizosaccharomyces pombe 972h−, and *Yarrowia lipolytica* CLIB122. Typically BLAST (described above) searching of publicly available databases with known PDC polynucleotide or polypeptide sequences, such as those provided herein, is used to identify PDC-encoding sequences of other host cells, such as yeast cells.

Accordingly, it is within the scope of the invention to provide pyruvate decarboxylase polynucleotides and polypeptides having at least about 70% to about 75%, about 75% to about 80%, about 80% to about 85%, about 85% to about 90%, about 90% to about 95%, about 96%, about 97%, about 98%, or about 99% sequence identity to any of the PDC polypeptides or polypeptides disclosed herein (SEQ ID NOs: 1-20). Identities are based on the Clustal W method of alignment using the default parameters of GAP PENALTY=10, GAP LENGTH PENALTY=0.1, and Gonnet 250 series of protein weight matrix.

The modification of PDC in the host cells disclosed herein to reduce or eliminate PDC activity can be confirmed using methods known in the art. For example, PCR methods well known in the art can be used to confirm deletion of PDC. Other suitable methods will be known to those of skill in the art and include, but are not limited to, lack of growth on yeast extract peptone-dextrose medium (YPD).

Introduction of the Phosphoketolase Pathway

Applicants have found that expression of enzymes associated with the phosphoketolase pathway (e.g., phosphoketolase and/or phosphotransacetylase) results in a reduced or eliminated requirement for exogenous two-carbon substrate supplementation for growth of PDC-KO cells. Phosphoketolases and/or phosphotransacetylases identified as described herein, can be expressed in such cells using methods described herein.

Figure 1:
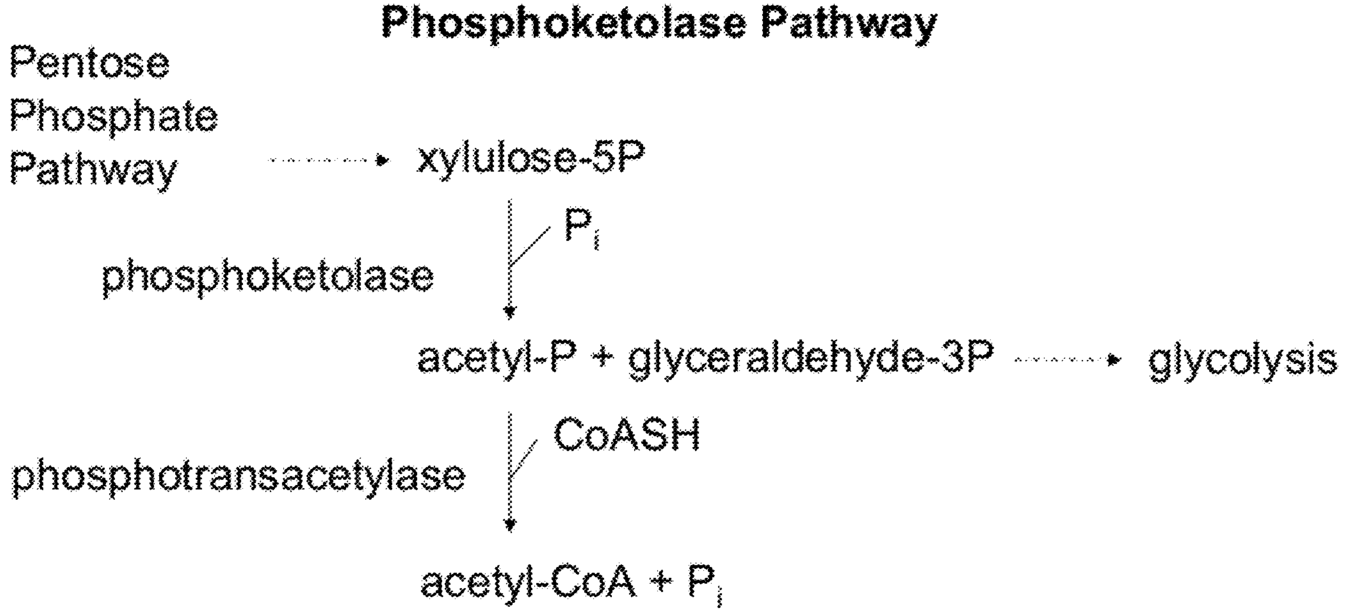
FIG. 1 depicts a schematic representation of the phosphoketolase pathway, including the phosphoketolase and phosphotransacetylase enzymes.

Enzymes of the phosphoketolase pathway include phosphoketolase and phosphotransacetylase (FIG. 1). Phosphoketolase (Enzyme Commission Number EC 4.1.2.9) catalyzes the conversion of xylulose 5-phosphate into glyceraldehyde 3-phosphate and acetyl-phosphate (Heath et al., *J. Biol. Chem.* 231: 1009-29; 1958). Phosphoketolase activity has been identified in several yeast strains growing with xylose as the sole carbon source but not in yeast strains grown with glucose (Evans and Ratledge, *Arch. Microbiol.* 139: 48-52; 1984). Inhibitors of phosphoketolase include, but are not limited to, erythrose 4-phosphate and glyceraldehyde 3-phosphate. Phosphotransacetylase (Enzyme Commission Number EC 2.3.1.8) converts acetyl-phosphate into acetyl-CoA.

In embodiments, the phosphoketolase pathway is activated in the recombinant host cells disclosed herein by engineering the cells to express polynucleotides and/or polypeptides encoding phosphoketolase and, optionally, phosphotransacetylase. In embodiments, the recombinant host cells disclosed herein comprise a heterologous polynucleotide encoding a polypeptide having phosphoketolase activity. In other embodiments, the recombinant host cells disclosed herein comprise a heterologous polynucleotide encoding a polypeptide having phosphoketolase activity and a heterologous polynucleotide encoding a polypeptide having phosphotransacetylase activity. In other embodiments, the heterologous polynucleotide encoding a polypeptide having phosphoketolase activity is overexpressed, or expressed at a level that is higher than endogenous expression of the same or related endogenous gene, if any. In still other embodiments, the heterologous polynucleotide encoding a polypeptide having phosphotransacetylase activity is overexpressed, or expressed at a level that is higher than endogenous expression of the same or related endogenous gene, if any.

In embodiments, a polypeptide having phosphoketolase activity catalyzes the conversion of xylulose 5-phosphate into glyceraldehyde-3-phosphate and acetyl-phosphate and/or the conversion of fructose-6-phosphate into erythrose-4-phosphate and acetyl-phosphate. In embodiments, the activity of a polypeptide having phosphoketolase activity is inhibited by erythrose 4-phosphate and/or glyceraldehyde 3-phosphate. In other embodiments, a polypeptide having phosphotransacetylase activity catalyzes the conversion of acetyl-phosphate into acetyl-CoA.

Numerous examples of polynucleotides, genes and polypeptides encoding phosphoketolase activity are known in the art and can be used in the recombinant host cells disclosed herein. In embodiments, such a polynucleotide, gene and/or polypeptide can be the xylulose 5-phosphateketolase (XpkA) of *Lactobacillus pentosus* MD363 (Posthuma et al., *Appl. Environ. Microbiol.* 68: 831-7; 2002). XpkA is the central enzyme of the phosphoketolase pathway (PKP) in lactic acid bacteria, and exhibits a specific activity of 4.455 μmol/min/mg (Posthuma et al., *Appl. Environ. Microbiol.* 68: 831-7; 2002). In other embodiments, such a polynucleotide, gene and/or polypeptide can be the phosphoketolase of *Leuconostoc mesenteroides* which exhibits a specific activity of 9.9 μmol/min/mg and is stable at pH above 4.5 (Goldberg et al., *Methods Enzymol.* 9: 515-520; 1966). This phosphoketolase exhibits a Km of 4.7 mM for D-xylulose 5-phosphate and a Km of 29 mM for fructose 6-phosphate (Goldberg et al., *Methods Enzymol.* 9: 515-520; 1966). In other embodiments, such a polynucleotide, gene and/or polypeptide can be the D-xylulose 5-phosphate/D-fructose 6-phosphate phosphoketolase gene xfp from *B. lactis*, as described, for example, in a pentose-metabolizing *S. cerevisiae* strain by Sonderegger et al. (*Appl. Environ. Microbiol.* 70: 2892-7; 2004).

In embodiments, a polynucleotide, gene and/or polypeptide encoding phosphoketolase corresponds to the Enzyme Commission Number EC 4.1.2.9.

In embodiments, host cells comprise a polypeptide having at least about 80%, at least about 85%, at least about 90%, or 100% identity to a polypeptide of Table 4 or an active fragment thereof or a polynucleotide encoding such a polypeptide. In other embodiments, a polynucleotide, gene and/or polypeptide encoding phosphoketolase can include, but is not limited to, a sequence provided in the following tables 4 or 5.

TABLE 4

SEQ ID NOs of phosphoketolase target gene coding regions and proteins

| Description | SEQ ID NO: Nucleic acid | SEQ ID NO: Amino acid | Amino Acid sequence |
|---|---|---|---|
| Xpk1 phosphoketolase from *Lactobacillus plantarum* | 172 | 481 | MTTDYSSPAYLQKVDKYWRAANYLSVGQLYLKDNPLLQRPL<br>KASDVKVHPIGHWGTIAGQ<br>NFIYAHLNRVINKYGLKMFYVEGPGHGGQVMVSNSYLDGTY<br>TDIYPEITQDVEGMQKLFK<br>QFSFPGGVASHAAPETPGSIHEGGELGYSISHGVGAILDNP |

TABLE 4-continued

SEQ ID NOs of phosphoketolase target gene coding regions and proteins

| Description | SEQ ID NO: Nucleic acid | SEQ ID NO: Amino acid | Amino Acid sequence |
| --- | --- | --- | --- |
| | | | DEIAAVVVGDGESETGPLA TSWQSTKFINPINDGAVLPILNLNGFKISNPTIFGRTSDAK IKEYFESMNWEPIFVEGDD PEKVHPALAKAMDEAVEKIKAIQKHARENNDATLPVWPMIV FRAPKGWTGPKSWDGDKIE GSFRAHQIPIPVDQNDMEHADALVDWLESYQPKELFNEDGS LKDDIKEIIPTGDSRMAAN PITNGGVDPKALNLPNFRDYAVDTSKEGANVKQDMIVWSDY LRDVIKKNPDNFRLFGPDE TMSNRLYGVFETTNRQWMEDIHPDSDQYEAPAGRVLDAQLS EHQAEGWLEGYVLTGRHGL FASYEAFLRVVDSMLTQHFKWLRKANELDWRKKYPSLNIIA ASTVFQQDHNGYTHQDPGA LTHLAEKKPEYIREYLPADANTLLAVGDVIFRSQEKINYVV TSKHPRQQWFSIEEAKQLV DNGLGIIDWASTDQGSEPDIVFAAAGTEPTLETLAAIQLLH DSFPEMKIRFVNVVDILKL RSPEKDPRGLSDAEFDHYFTKDKPVVFAFHGYEDLVRDIFF DRHNHNLYVHGYRENGDIT TPFDVRVMNQMDRFDLAKSAIAAQPAMENTGAAFVQSMDNM LAKHNAYIRDAGTDLPEVN DWQWKGLK |
| XpkA phosphoketolase from *Lactobacillus pentosus* MD363 | 1890 | 1889 | MSTDYSSPAYLQKVDKYWRAANYLSVGQLYLKDNPLLQRPL KASDVKVHPIGHWGTIAGQ NFIYAHLNRVINKYGLKMFYVEGPGHGGQVMVSNSYLDGTY TDIYPEITQDVEGMQKLFK QFSFPGGVASHAAPETPGSIHEGGELGYSISHGVGAILDNP DEIAAVVVGDGESETGPLA TSWQSTKFINPINDGAVLPILNLNGFKISNPTIFGRTSDEK IKQYFESMNWEPIFVEGDD PEKVHPALAKAMDEAVEKIKAIQKNARENDDATLPVWPMIV FRAPKGWTGPKSWDGDKIE GSFRAHQIPIPVDQTDMEHADALVDWLESYQPKELFNEDGS LKDDIKEIIPTGDARMAAN PITNGGVDPKALNLPNFRDYAVDTSKHGANVKQDMIVWSDY LRDVIKKNPDNFRLFGPDE TMSNRLYGVFETTNRQWMEDIHPDSDQYEAPAGRVLDAQLS EHQAEGWLEGYVLTGRHGL FASYEAFLRVVDSMLTQHFKWLRKANELDWRKKYPSLNIIA ASTVFQQDHNGYTHQDPGA LTHLAEKKPEYIREYLPADANSLLAVGDVIFRSQEKINYVV TSKHPRQQWFSIEEAKQLV DNGLGIIDWASTDQGSEPDIVFAAAGTEPTLETLAAIQLLH DSFPDMKIRFVNVVDILKL RSPEKDPRGLSDAEFDHYFTKDKPVVFAFHGYEDLVRDIFF DRHNHNLHVHGYRENGDIT TPFDVRVMNQMDRFDLAKSAIAAQPAMENTGAAFVQDMDNM LAKHNAYIRDAGTDLPEVN DWQWKGLK |
| Xpf D-xylulose 5-phosphate/D-fructose 6-phosphate phosphoketolase from *B. lactis* | 79 | 388 | MTNPVIGTPWQKLDRPVSEEAIEGMDKYWRVANYMSIGQIY LRSNPLMKEPFTRDDVKHR LVGHWGTTPGLNFLLAHINRLIADHQQNTVFIMGPGHGGPA GTAQSYIDGTYTEYYPNIT KDEAGLQKFFRQFSYPGGIPSHFAPETPGSIHEGGELGYAL SHAYGAIMDNPSLFVPCII GDGEAETGPLATGWQSNKLVNPRTDGIVLPILHLNGYKIAN PTILARISDEELHDFFRGM GYHPYEFVAGFDNEDHLSIHRRFAELFETIFDEICDIKAAA QTDDMTRPFYPMLIFRTPK GWTCPKFIDGKKTEGSWRAHQVPLASARDTEAHFEVLKGWM ESYKPEELFNADGSIKEDV TAFMPKGELRIGANPNANGGRIREDLKLPELDQYEITGVKE YGHGWGQVEAPRSLGAYCR DIIKNNPDSFRVFGPDETASNRLNATYEVTKKQWDNGYLSA LVDENMAVTGQVVEQLSEH QCEGFLEAYLLTGRHGIWSSYESFVHVIDSMLNQHAKWLEA TVREIPWRKPISSVNLLVS SHVWRQDHNGFSHQDPGVTSVLLNKTFNNDHVTNIYFATDA NMLLAIAEKCFKSTNKINA IFAGKQPAATWITLDEARAELEAGAAEWKWASNAKSNDEVQ VVLAAAGDVPTQEIMAASD |

TABLE 4-continued

| SEQ ID NOs of phosphoketolase target gene coding regions and proteins | | | |
|---|---|---|---|
| Description | SEQ ID NO: Nucleic acid | SEQ ID NO: Amino acid | Amino Acid sequence |
| | | | ALNKMGIKFKVVNVVDLIKLQSSKENDEAMSDEDFADLFTA DKPVLFAYHSYAQDVRGLI YDRPNHDNFTVVGYKEQGSTTTPFDMVRVNDMDRYALQAKA LELIDADKYADKINELNEF RKTAFQFAVDNGYDIPEFTDWVYPDVKVDETSMLSATAATA GDNE |

In other embodiments, a polynucleotide, gene and/or polypeptide encoding phosphoketolase can have at least about 70% to about 75%, about 75% to about 80%, about 80% to about 85%, about 85% to about 90%, about 90% to about 95%, about 96%, about 97%, about 98%, or about 99% sequence identity to that of any one of the sequences of Table 4, wherein the polynucleotide, gene and/or polypeptide encodes a polypeptide having phosphoketolase activity.

In other embodiments, a polynucleotide, gene and/or polypeptide encoding phosphoketolase can be used to identify other phosphoketolase polynucleotide, gene and/or polypeptide sequences or to identify phosphoketolase homologs in other cells, as described above for PDC. Such phosphoketolase encoding sequences can be identified, for example, in the literature and/or in bioinformatics databases well known to the skilled person. For example, the identification of phosphoketolase encoding sequences in other cell types using bioinformatics can be accomplished through BLAST (as described above) searching of publicly available databases with known phosphoketolase encoding DNA and polypeptide sequences, such as those provided herein. Identities are based on the Clustal W method of alignment using the default parameters of GAP PENALTY=10, GAP LENGTH PENALTY=0.1, and Gonnet 250 series of protein weight matrix.

Additional phosphoketolase target gene coding regions were identified using diversity search, clustering, experimentally verified xylulose-5-phosphate/fructose-6-phosphate phosphoketolases and domain architecture. Briefly, a BLAST search with the experimentally verified sequences with an Evalue cut-off of 0.01 resulted in 595 sequence matches. Clustering with the CD-HIT program at 95% sequence identity and 90% length overlap reduced the number to 436. CD-HIT is a program for clustering large protein database at high sequence identity threshold. The program removes redundant sequences and generates a database of only the representatives. (Clustering of highly homologous sequences to reduce the size of large protein database, Weizhong Li, Lukasz Jaroszewski & Adam Godzik Bioinformatics, (2001) 17:282-283)

Xylulose-5-phosphate/fructose-6-phosphate phosphoketolases have three Pfam domains: XFP_N; XFP; XFP_C. Although each of these domains may be present in several domain architectures, e.g. XFP_N is found in eight architectures. The architecture of interest was determined to be XFP_N; XFP; XFP_C. The cumulative length of the three domains is 760 amino acids.

A structure/function characterization of the phosphoketolases was performed using the HMMER software package. The following information based on the HMMER software user guide gives some description of the way that the hmmbuild program prepares a Profile HMM. A Profile HMM is capable of modeling gapped alignments, e.g. including insertions and deletions, which lets the software describe a complete conserved domain (rather than just a small ungapped motif). Insertions and deletions are modeled using insertion (I) states and deletion (D) states. All columns that contain more than a certain fraction x of gap characters will be assigned as an insert column. By default, x is set to 0.5. Each match state has an I and a D state associated with it. HMMER calls a group of three states (M/D/I) at the same consensus position in the alignment a “node”. These states are interconnected with arrows called state transition probabilities. M and I states are emitters, while D states are silent. The transitions are arranged so that at each node, either the M state is used (and a residue is aligned and scored) or the D state is used (and no residue is aligned, resulting in a deletion-gap character, ‘-’). Insertions occur between nodes, and I states have a self-transition, allowing one or more inserted residues to occur between consensus columns.

The scores of residues in a match state (i.e. match state emission scores), or in an insert state (i.e. insert state emission scores) are proportional to Log__2(p_x)/(null_x). Where p_x is the probability of an amino acid residue, at a particular position in the alignment, according to the Profile HMM and null_x is the probability according to the Null model. The Null model is a simple one state probabilistic model with pre-calculated set of emission probabilities for each of the 20 amino acids derived from the distribution of amino acids in the SWISSPROT release 24. State transition scores are also calculated as log odds parameters and are propotional to Log__2(t_x). Where t_x is the probability of transiting to an emitter or non-emitter state.

Using a multiple sequence alignment of experimentally verified sequences containing the architecture of interest XFP_N; XFP; XFP_C, a profile Hidden Markov Model (HMM) was created for representing members of the xylulose-5-phosphate/fructose-6-phosphate phosphoketolases (XPK-XFP). As stated in the user guide, Profile HMMs are statistical models of multiple sequence alignments. They capture position-specific information about how conserved each column of the alignment is, and which amino acid residues are most likely to occur at each position. Thus HMMs have a formal probabilistic basis. Profile HMMs for a large number of protein families are publicly available in the PFAM database (Janelia Farm Research Campus, Ashburn, Va.), see ftp://ftp.sanger.ac.uk/pub/databases/Pfam/releases/Pfam24.0/.

Eight xylulose-5-phosphate/fructose-6-phosphate phosphoketolases sequences with experimentally verified function were identified in the BRENDA database:

1. CBF76492.1 from *Aspergillus nidulans* FGSC A4 (SEQ ID NO: 355)

2. AAR98787.1 from *Bifidobacterium longum* (SEQ ID NO: 379)
3. ZP__03646196.1 from *Bifidobacterium bifidum* NCIMB 41171 (SEQ ID NO: 381)
4. ZP__02962870.1 from *Bifidobacterium animalis* subsp. *lactis* HN019 (SEQ ID NO: 388)
5. NP__786060.1 from *Lactobacillus plantarum* WCFS1 (SEQ ID NO: 481)
6. ZP__03940142.1 from *Lactobacillus brevis* subsp. *gravesensis* ATCC 27305 (SEQ ID NO: 486)
7. ZP__03073172.1 from *Lactobacillus reuteri* 100-23 (SEQ ID NO 468)
8. YP__818922.1 from *Leuconostoc mesenteroides* subsp. *mesenteroides* ATCC 8293 (SEQ ID NO: 504)

The BRENDA database is a freely available information system containing biochemical and molecular information on all classified enzymes as well as software tools for querying the database and calculating molecular properties. The database covers information on classification and nomenclature, reaction and specificity, functional parameters, occurrence, enzyme structure and stability, mutants and enzyme engineering, preparation and isolation, the application of enzymes, and ligand-related data. (BRENDA, AMENDA and FRENDA the enzyme information system: new content and tools in 2009. Nucleic Acids Res. 2009 January; 37 (Database issue):D588-92. Epub 2008 Nov. 4. Chang A, Scheer M, Grote A, Schomburg I, Schomburg D.) The eight sequences were used to build a profile HMM which is provided herein as Table 6.

To further identify the proteins of interest, the 436 sequences were searched with four profile HMMs: the generated XPK_XFP_HMM profile HMM provided in Table 6 as well as the three published profiles for the three domains XFP_N; XFP; XFP_C (PFAM DATABASE) described in Tables 7, 8, and 9, respectively. 309 protein sequences which lengths were between 650 amino acids and 900 amino acids, and contained the three domains were retained.

All 309 sequences are at least 40% identical to an experimentally verified phosphoketolase, with exception of 12 sequences that are within 35% identity distance. However, all 309 sequences have a highly significant match to all 4 profile HMMs. The least significant matches have Evalues of 7.5E-242, 1.1E-124, 2.1E-49, 7.8E-37 to XFP_XPK HMM, XFP_N, XFP, and XFP_C profile HMMs respectively. The 309 sequences are provided in Table 5, however, it is understood that any xylulose-5-phosphate/fructose-6-phosphate phosphoketolase identifiable by the method described may be expressed in host cells as described herein. Where accession information is given as "complement(NN_NNNNN.N:X . . . Y)", it should be understood to mean the reverse complement of nucleotides X to Y of the sequence with Accession number NN_NNNNN.N. Where accession information is given as "join (NNNNNN.N:X . . . Y, NNNNNN.N:Z . . . Q)", it should be understood to mean the sequence resulting from joining nucleotides X to Y of NNNNNN.N to nucleotides Z to Q of NNNNNN.N.

TABLE 5

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 162147402 | complement(NC__010125.1: 1624982 . . . 1627414) | 21 | YP__001601863.1 | 330 | *Gluconacetobacter diazotrophicus* PAl5 |
| 127512024 | complement(NC__009092.1: 1256548 . . . 1258914) | 22 | YP__001093221.1 | 331 | *Shewanella loihica* PV-4 |
| 119774052 | complement(NC__008700.1: 1105589 . . . 1107955) | 23 | YP__926792.1 | 332 | *Shewanella amazonensis* SB2B |
| 113971300 | NC__008321.1: 3541276 . . . 3543642 | 24 | YP__735093.1 | 333 | *Shewanella* sp. MR-4 |
| 126173290 | complement(NC__009052.1: 1204351 . . . 1206717) | 25 | YP__001049439.1 | 334 | *Shewanella baltica* OS155 |
| 163750647 | complement(NZ__ABIC01000018.1: 47875 . . . 50253) | 26 | ZP__02157884.1 | 335 | *Shewanella benthica* KT99 |
| 157374325 | complement(NC__009831.1: 1410491 . . . 1412857) | 27 | YP__001472925.1 | 336 | *Shewanella sediminis* HAW-EB3 |
| 170725643 | complement(NC__010506.1: 1624098 . . . 1626464) | 28 | YP__001759669.1 | 337 | *Shewanella woodyi* ATCC 51908 |
| 167623058 | complement(NC__010334.1: 1364332 . . . 1366698) | 29 | YP__001673352.1 | 338 | *Shewanella halifaxensis* HAW-EB4 |
| 91794082 | NC__007954.1: 3270590 . . . 3272956 | 30 | YP__563733.1 | 339 | *Shewanella denitrificans* OS217 |
| 254498997 | NZ__ACUL01000224.1: 8243 . . . 10492 | 31 | ZP__05111697.1 | 340 | *Legionella drancourtii* LLAP12 |
| 239607320 | join(EQ999973.1: 7995808 . . . 7995885, EQ999973.1: 7996059 . . . 7996116, EQ999973.1: 7996178 . . . 7996412, EQ999973.1: 7996486 . . . 7996638, EQ999973.1: 7996791 . . . 7997016, EQ999973.1: 7997082 . . . 7997548, EQ999973.1: 7997603 . . . 7997705, EQ999973.1: 7997779 . . . 7998604, | 32 | EEQ84307.1 | 341 | *Ajellomyces dermatitidis* ER-3 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| | EQ999973.1: 7998677 . . . 7998717) | | | | |
| 261200667 | XM_002626688.1: 1 . . . 2034 | 33 | XP_002626734.1 | 342 | *Ajellomyces dermatitidis* SLH14081 |
| 154276328 | XM_001538959.1: 1 . . . 2421 | 34 | XP_001539009.1 | 343 | *Ajellomyces capsulatus* NAm1 |
| 225555843 | join(GG663374.1: 72330 . . . 72492, GG663374.1: 72695 . . . 72929, GG663374.1: 73005 . . . 73157, GG663374.1: 73216 . . . 74203, GG663374.1: 74274 . . . 75146) | 35 | EEH04133.1 | 344 | *Ajellomyces capsulatus* G186AR |
| 225681974 | join(DS544805.1: 2187102 . . . 2187264, DS544805.1: 2187353 . . . 2187427, DS544805.1: 2187521 . . . 2187755, DS544805.1: 2187839 . . . 2187991, DS544805.1: 2188086 . . . 2188395, DS544805.1: 2188462 . . . 2189082, DS544805.1: 2189147 . . . 2189263, DS544805.1: 2189358 . . . 2189973, DS544805.1: 2190044 . . . 2190084) | 36 | EEH20258.1 | 345 | *Paracoccidioides brasiliensis* Pb03 |
| 226289140 | join(DS572750.1: 3105630 . . . 3105792, DS572750.1: 3106049 . . . 3106283, DS572750.1: 3106367 . . . 3106519, DS572750.1: 3106614 . . . 3106923, DS572750.1: 3107023 . . . 3107610, DS572750.1: 3107675 . . . 3108500, DS572750.1: 3108572 . . . 3108612) | 37 | EEH44652.1 | 346 | *Paracoccidioides brasiliensis* Pb18 |
| 258564014 | XM_002582706.1: 1 . . . 2421 | 38 | XP_002582752.1 | 347 | *Uncinocarpus reesii* 1704 |
| 240108203 | join(ACFW01000030.1: 1281918 . . . 1282080, ACFW01000030.1: 1282133 . . . 1282207, ACFW01000030.1: 1282266 . . . 1282500, ACFW01000030.1: 1282551 . . . 1282703, ACFW01000030.1: 1282757 . . . 1283066, ACFW01000030.1: 1283132 . . . 1283752, ACFW01000030.1: 1283828 . . . 1284653, ACFW01000030.1: 1284726 . . . 1284763) | 39 | EER26377.1 | 348 | *Coccidioides posadasii* C735 delta SOWgp |
| 238838423 | join(DS995701.1: 2675053 . . . 2675215, DS995701.1: 2675278 . . . 2675352, DS995701.1: 2675424 . . . 2675658, DS995701.1: 2675745 . . . 2675897, DS995701.1: 2675972 . . . 2676281, DS995701.1: 2676341 . . . 2676961, DS995701.1: 2677062 . . . 2677836, DS995701.1: 2677864 . . . 2677933, DS995701.1: 2677998 . . . 2678013) | 40 | EEQ28085.1 | 349 | *Microsporum canis* CBS 113480 |
| 169770631 | XM_001819733.1: 1 . . . 2457 | 41 | XP_001819785.1 | 350 | *Aspergillus oryzae* RIB40 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 145232813 | XM_001399743.1: 1 . . . 2421 | 42 | XP_001399780.1 | 351 | *Aspergillus niger* |
| 119491775 | XM_001263381.1: 1 . . . 2421 | 43 | XP_001263382.1 | 352 | *Neosartorya fischeri* NRRL 181 |
| 121705634 | XM_001271079.1: 1 . . . 2421 | 44 | XP_001271080.1 | 353 | *Aspergillus clavatus* NRRL 1 |
| 115396290 | XM_001213784.1: 1 . . . 2400 | 45 | XP_001213784.1 | 354 | *Aspergillus terreus* NIH2624 |
| 259482219 | join(BN001303.1: 576345 . . . 576507, BN001303.1: 576696 . . . 576930, BN001303.1: 576981 . . . 577133, BN001303.1: 577185 . . . 577494, BN001303.1: 577544 . . . 578161, BN001303.1: 578210 . . . 579035, BN001303.1: 579091 . . . 579128) | 46 | CBF76492.1 | 355 | *Aspergillus nidulans* FGSC A4 |
| 255942289 | XM_002561867.1: 1 . . . 2469 | 47 | XP_002561913.1 | 356 | *Penicillium chrysogenum* Wisconsin 54-1255 |
| 242784458 | XM_002480346.1: 69 . . . 2489 | 48 | XP_002480391.1 | 357 | *Talaromyces stipitatus* ATCC 10500 |
| 212527714 | XM_002143978.1: 139 . . . 2559 | 49 | XP_002144014.1 | 358 | *Penicillium marneffei* ATCC 18224 |
| 70999652 | XM_749450.1: 1 . . . 2145 | 50 | XP_754543.1 | 359 | *Aspergillus fumigatus* Af293 |
| 154314622 | XM_001556585.1: 1 . . . 2061 | 51 | XP_001556635.1 | 360 | *Botryotinia fuckeliana* B05.10 |
| 156053245 | XM_001592499.1: 1 . . . 2430 | 52 | XP_001592549.1 | 361 | *Sclerotinia sclerotiorum* 1980 |
| 46124351 | XM_386729.1: 1 . . . 2418 | 53 | XP_386729.1 | 362 | *Gibberella zeae* PH-1 |
| 256733824 | complement(join(GG698897.1: 220636 . . . 220670, GG698897.1: 220723 . . . 221650, GG698897.1: 221704 . . . 222510, GG698897.1: 222576 . . . 222732, GG698897.1: 222783 . . . 223020, GG698897.1: 223072 . . . 223146, GG698897.1: 223199 . . . 223361)) | 54 | EEU47171.1 | 363 | *Nectria haematococca* mpVI 77-13-4 |
| 261354209 | join(DS985216.1: 747889 . . . 748126, DS985216.1: 748174 . . . 748564, DS985216.1: 748620 . . . 748929, DS985216.1: 748985 . . . 749555, DS985216.1: 749607 . . . 749833, DS985216.1: 749946 . . . 750572) | 55 | EEY16637.1 | 364 | *Verticillium alboatrum* VaMs.102 |
| 85081035 | XM_951556.2: 215 . . . 2662 | 56 | XP_956649.1 | 365 | *Neurospora crassa* OR74A |
| 145609083 | XM_364271.2: 1 . . . 2442 | 57 | XP_364271.2 | 366 | *Magnaporthe grisea* 70-15 |
| 171679277 | XM_001904550.1: 1 . . . 2316 | 58 | XP_001904585.1 | 367 | *Podospora anserine* |
| 169859036 | XM_001836107.1: 1 . . . 2418 | 59 | XP_001836159.1 | 368 | *Coprinopsis cinerea* okayama7#130 |
| 19112755 | NM_001021872.1: 1 . . . 2478 | 60 | NP_595963.1 | 369 | *Schizosaccharomyces pombe* |
| 213405339 | XM_002173405.1: 1 . . . 2469 | 61 | XP_002173441.1 | 370 | *Schizosaccharomyces japonicus* yFS275 |
| 58267408 | XM_570860.1: 39 . . . 2594 | 62 | XP_570860.1 | 371 | *Cryptococcus neoformans* var. *neoformans* JEC21 |
| 71018661 | XM_754468.1: 1 . . . 2682 | 63 | XP_759561.1 | 372 | *Ustilago maydis* 521 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 254413307 | NZ_DS989851.1: 81897 . . . 84338 | 64 | ZP_05027078.1 | 373 | *Microcoleus chthonoplastes* PCC 7420 |
| 256377454 | NC_013093.1: 3941285 . . . 3943633 | 65 | YP_003101114.1 | 374 | *Actinosynnema mirum* DSM 43827 |
| 221195188 | NZ_ACFE01000002.1: 241103 . . . 243577 | 66 | ZP_03568244.1 | 375 | *Atopobium rimae* ATCC 49626 |
| 257785020 | complement(NC_013203.1: 1365893 . . . 1368364) | 67 | YP_003180237.1 | 376 | *Atopobium parvulum* DSM 20469 |
| 227516879 | complement(NZ_ACGK01000053.1: 213016 . . . 215490) | 68 | ZP_03946928.1 | 377 | *Atopobium vaginae* DSM 15829 |
| 210630184 | NZ_ABXJ01000012.1: 49466 . . . 51985 | 69 | ZP_03296299.1 | 378 | *Collinsella stercoris* DSM 13279 |
| 41056825 | AY518215.1: 989 . . . 3466 | 70 | AAR98787.1 | 379 | *Bifidobacterium longum* |
| 223467373 | NZ_ACCG01000015.1: 9765 . . . 12350 | 71 | ZP_03618909.1 | 380 | *Bifidobacterium breve* DSM 20213 |
| 224282874 | NZ_ABQP01000009.1: 218668 . . . 221073 | 72 | ZP_03646196.1 | 381 | *Bifidobacterium bifidum* NCIMB 41171 |
| 229817819 | complement(NZ_ABYS02000004.1: 901411 . . . 903888) | 73 | ZP_04448101.1 | 382 | *Bifidobacterium angulatum* DSM 20098 |
| 212716076 | complement(NZ_ABXY01000011.1: 578312 . . . 580789) | 74 | ZP_03324204.1 | 383 | *Bifidobacterium catenulatum* DSM 16992 |
| 41056831 | AY518218.1: 1430 . . . 3907 | 75 | AAR98790.1 | 384 | *Bifidobacterium* sp. CFAR 172 |
| 41056829 | AY518217.1: 951 . . . 3428 | 76 | AAR98789.1 | 385 | *Bifidobacterium pullorum* |
| 227507561 | NZ_ACGF01000124.1: 41655 . . . 44132 | 77 | ZP_03937610.1 | 386 | *Gardnerella vaginalis* ATCC 14019 |
| 261337317 | NZ_ABXB03000001.1: 154886 . . . 157366 | 78 | ZP_05965201.1 | 387 | *Bifidobacterium gallicum* DSM 20093 |
| 183601500 | complement(NZ_ABOT01000001.1: 194894 . . . 197371) | 79 | ZP_02962870.1 | 388 | *Bifidobacterium animalis* subsp. *lactis* HN019 |
| 41056827 | AY518216.1:988 . . . 3465 | 80 | AAR98788.1 | 389 | *Bifidobacterium pseudolongum* subsp. *Globosum* |
| 227516469 | complement(NZ_ACGK01000047.1: 28634 . . . 31102) | 81 | ZP_03946518.1 | 390 | *Atopobium vaginae* DSM 15829 |
| 76556241 | AJ509177.1: 1 . . . 2625 | 82 | YP_001511171.1 | 391 | *Frankia* sp. EAN1pec |
| 158318663 | NC_009921.1: 8441355 . . . 8443790 | 83 | YP_713678.1 | 392 | *Frankia alni* ACN14a |
| 111222884 | complement(NC_008278.1: 3758441 . . . 3760909) | 84 | YP_002778395.1 | 393 | *Rhodococcus opacus* B4 |
| 226360617 | complement(NC_012522.1: 1273076 . . . 1275478) | 85 | YP_701466.1 | 394 | *Rhodococcus jostii* RHA1 |
| 111018494 | complement(NC_008268.1: 1575800 . . . 1578352) | 86 | ZP_04383880.1 | 395 | *Rhodococcus erythropolis* SK121 |
| 229490027 | NZ_ACNO01000014.1: 107516 . . . 109885 | 87 | YP_947598.1 | 396 | *Arthrobacter aurescens* TC1 |
| 119962524 | NC_008711.1: 2018415 . . . 2020796 | 88 | CAD48946.1 | 397 | *Propionibacterium freudenreichii* subsp. *Shermanii* |
| 28868876 | NC_004578.1: 1837381 . . . 1839888 | 89 | NP_791495.1 | 398 | *Pseudomonas syringae* pv. tomato str. DC3000 |
| 256425339 | NC_013132.1: 8027760 . . . 8030123 | 90 | YP_003125992.1 | 399 | *Chitinophaga pinensis* DSM 2588 |
| 161075783 | EU223897.1: 1 . . . 2430 | 91 | ABX56639.1 | 400 | *Verrucomicrobiae bacterium* V4 |
| 218246512 | complement(NC_011726.1: 1758431 . . . 1760839) | 92 | YP_002371883.1 | 401 | *Cyanothece* sp. PCC 8801 |
| 172055269 | NC_010547.1: 390265 . . . 392673 | 93 | YP_001806596.1 | 402 | *Cyanothece* sp. ATCC 51142 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 126659520 | complement(NZ_AAXW01000034.1: 5415 . . . 7823) | 94 | ZP_01730652.1 | 403 | *Cyanothece* sp. CCY0110 |
| 258380665 | complement(AM990467.1: 2704 . . . 5112) | 95 | CAQ48286.1 | 404 | *Planktothrix rubescens* NIVA-CYA 98 |
| 209527806 | NZ_ABYK01000067.1: 8063 . . . 10480 | 96 | ZP_03276298.1 | 405 | *Arthrospira maxima* CS-328 |
| 196258744 | NZ_ABVE01000007.1: 72906 . . . 75314 | 97 | ZP_03157277.1 | 406 | *Cyanothece* sp. PCC 7822 |
| 218440702 | complement(NC_011729.1: 4207741 . . . 4210149) | 98 | YP_002379031.1 | 407 | *Cyanothece* sp. PCC 7424 |
| 166366228 | complement(NC_010296.1: 3156762 . . . 3159182) | 99 | YP_001658501.1 | 408 | *Microcystis aeruginosa* NIES-843 |
| 119488765 | NZ_AAVU01000020.1: 110903 . . . 113317 | 100 | ZP_01621774.1 | 409 | *Lyngbya* sp. PCC 8106 |
| 17228976 | complement(NC_003272.1: 1746056 . . . 1748482) | 101 | NP_485524.1 | 410 | *Nostoc* sp. PCC 7120 |
| 254422632 | NZ_DS989904.1: 4613864 . . . 4616290 | 102 | ZP_05036350.1 | 411 | *Synechococcus* sp. PCC 7335 |
| 158333641 | NC_009925.1: 422232 . . . 424652 | 103 | YP_001514813.1 | 412 | *Acaryochloris marina* MBIC11017 |
| 254425820 | complement(NZ_DS989905.1: 71540 . . . 74017) | 104 | ZP_05039537.1 | 413 | *Synechococcus* sp. PCC 7335 |
| 170695087 | complement(NZ_ABLD01000020.1: 33972 . . . 36368) | 105 | ZP_02886235.1 | 414 | *Burkholderia graminis* C4D1M |
| 209515639 | complement(NZ_ABYL01000006.1: 33232 . . . 35628) | 106 | ZP_03264503.1 | 415 | *Burkholderia* sp. H160 |
| 87303015 | NZ_AANO01000008.1: 122233 . . . 124656 | 107 | ZP_01085819.1 | 416 | *Synechococcus* sp. WH 5701 |
| 254431900 | complement(NZ_DS990556.1: 2146872 . . . 2149313) | 108 | ZP_05045603.1 | 417 | *Cyanobium* sp. PCC 7001 |
| 88808134 | NZ_AAOK01000002.1: 342081 . . . 344516 | 109 | ZP_01123645.1 | 418 | *Synechococcus* sp. WH 7805 |
| 148238545 | complement(NC_009481.1: 226771 . . . 229206) | 110 | YP_001223932.1 | 419 | *Synechococcus* sp. WH 7803 |
| 87123187 | NZ_AANP01000001.1: 180603 . . . 183032 | 111 | ZP_01079038.1 | 420 | *Synechococcus* sp. RS9917 |
| 187919971 | complement(NC_010676.1: 1450148 . . . 1452541) | 112 | YP_001889002.1 | 421 | *Burkholderia phytofirmans* PsJN |
| 91778759 | complement(NC_007952.1: 1882080 . . . 1884473) | 113 | YP_553967.1 | 422 | *Burkholderia xenovorans* LB400 |
| 170690542 | NZ_ABLD01000001.1: 565487 . . . 567880 | 114 | ZP_02881709.1 | 423 | *Burkholderia graminis* C4D1M |
| 209521856 | NZ_ABYL01000194.1: 6778 . . . 9171 | 115 | ZP_03270532.1 | 424 | *Burkholderia* sp. H160 |
| 186474278 | complement(NC_010623.1: 2647064 . . . 2649448) | 116 | YP_001861620.1 | 425 | *Burkholderia phymatum* STM815 |
| 225873826 | complement(NC_012483.1: 2598033 . . . 2600420) | 117 | YP_002755285.1 | 426 | *Acidobacterium capsulatum* ATCC 51196 |
| 206602403 | DS995260.1: 236338 . . . 238704 | 118 | EDZ38884.1 | 427 | *Leptospirillum* sp. Group II '5-way CG' |
| 251772639 | complement(GG693868.1: 86578 . . . 88956) | 119 | EES53204.1 | 428 | *Leptospirillum ferrodiazotrophum* |
| 56752022 | complement(NC_006576.1: 2156604 . . . 2158994) | 120 | YP_172723.1 | 429 | *Synechococcus elongatus* PCC 6301 |
| 22298729 | complement(NC_004113.1: 1224195 . . . 1226633) | 121 | NP_681976.1 | 430 | *Thermosynechococcus elongatus* BP-1 |
| 53804073 | NC_002977.6: 1693459 . . . 1695894 | 122 | YP_114037.1 | 431 | *Methylococcus capsulatus* str. Bath |
| 220907266 | NC_011884.1: 1725657 . . . 1728098 | 123 | YP_002482577.1 | 432 | *Cyanothece* sp. PCC 7425 |
| 16332268 | NC_000911.1: 3500713 . . . 3503178 | 124 | NP_442996.1 | 433 | *Synechocystis* sp. PCC 6803 |
| 220907424 | complement(NC_011884.1: 1898702 . . . 1901167) | 125 | YP_002482735.1 | 434 | *Cyanothece* sp. PCC 7425 |
| 241777601 | complement(NZ_ACQQ01000020.1: 30393 . . . 32762) | 126 | ZP_04774866.1 | 435 | *Allochromatium vinosum* DSM 180 |
| 114778289 | NZ_AATS01000014.1: 23435 . . . 25801 | 127 | ZP_01453148.1 | 436 | *Mariprofundus ferrooxydans* PV-1 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 251827471 | complement(NZ_ACSD01000006.1: 39617 . . . 41986) | 128 | ZP_04830548.1 | 437 | *Gallionella ferruginea* ES-2 |
| 121712503 | XM_001273862.1: 1 . . . 2436 | 129 | XP_001273863.1 | 438 | *Aspergillus clavatus* NRRL 1 |
| 119473535 | XM_001258642.1: 1 . . . 2439 | 130 | XP_001258643.1 | 439 | *Neosartorya fischeri* NRRL 181 |
| 169763560 | XM_001727628.1: 1 . . . 2433 | 131 | XP_001727680.1 | 440 | *Aspergillus oryzae* RIB40 |
| 145248115 | XM_001396269.1: 1 . . . 2448 | 132 | XP_001396306.1 | 441 | *Aspergillus niger* |
| 115400974 | XM_001216075.1: 1 . . . 2457 | 133 | XP_001216075.1 | 442 | *Aspergillus terreus* NIH2624 |
| 255952755 | XM_002567084.1: 1 . . . 2433 | 134 | XP_002567130.1 | 443 | *Penicillium chrysogenum* Wisconsin 54-1255 |
| 212527388 | XM_002143815.1: 98 . . . 2551 | 135 | XP_002143851.1 | 444 | *Penicillium marneffei* ATCC 18224 |
| 242783584 | XM_002480171.1: 1 . . . 2448 | 136 | XP_002480216.1 | 445 | *Talaromyces stipitatus* ATCC 10500 |
| 154321267 | XM_001559899.1: 1 . . . 2466 | 137 | XP_001559949.1 | 446 | *Botryotinia fuckeliana* B05.10 |
| 156054348 | XM_001593050.1: 1 . . . 2499 | 138 | XP_001593100.1 | 447 | *Sclerotinia sclerotiorum* 1980 |
| 189191706 | XM_001932157.1: 1 . . . 2469 | 139 | XP_001932192.1 | 448 | *Pyrenophora tritici-repentis* Pt-1C-BFP |
| 169600613 | XM_001793677.1: 1 . . . 2466 | 140 | XP_001793729.1 | 449 | *Phaeosphaeria nodorum* SN15 |
| 58260732 | XM_567776.1: 41 . . . 2545 | 141 | XP_567776.1 | 450 | *Cryptococcus neoformans* var. *neoformans* JEC21 |
| 46123901 | XM_386504.1: 1 . . . 2460 | 142 | XP_386504.1 | 451 | *Gibberella zeae* PH-1 |
| 256732917 | complement(join(GG698898.1: 321524 . . . 322233, GG698898.1: 322285 . . . 322489, GG698898.1: 322540 . . . 324081)) | 143 | EEU46265.1 | 452 | *Nectria haematococca* mpVI 77-13-4 |
| 225729111 | FJ790496.1: 215 . . . 2677 | 144 | ACO24516.1 | 453 | *Metarhizium anisopliae* |
| 85094948 | XM_954892.2: 155 . . . 2638 | 145 | XP_959985.1 | 454 | *Neurospora crassa* OR74A |
| 171679479 | XM_001904651.1: 1 . . . 2517 | 146 | XP_001904686.1 | 455 | *Podospora anserine* |
| 198283820 | NC_011206.1: 1682860 . . . 1685307 | 147 | YP_002220141.1 | 456 | *Acidithiobacillus ferrooxidans* ATCC 53993 |
| 148243889 | NC_009468.1: 90683 . . . 93145 | 148 | YP_001220128.1 | 457 | *Acidiphilium cryptum* JF-5 |
| 157364435 | NC_009828.1: 1658895 . . . 1661258 | 149 | YP_001471202.1 | 458 | *Thermotoga lettingae* TMO |
| 217966781 | NC_011661.1: 369050 . . . 371428 | 150 | YP_002352287.1 | 459 | *Dictyoglomus turgidum* DSM 6724 |
| 92109503 | complement(NC_007960.1: 14429 . . . 16810) | 151 | YP_571790.1 | 460 | *Nitrobacter hamburgensis* X14 |
| 87310270 | complement(NZ_AANZ01000017.1: 80191 . . . 82560) | 152 | ZP_01092401.1 | 461 | *Blastopirellula marina* DSM 3645 |
| 152995974 | NC_009654.1: 2214232 . . . 2216625 | 153 | YP_001340809.1 | 462 | *Marinomonas* sp. MWYL1 |
| 32473390 | NC_005027.1: 2520925 . . . 2523306 | 154 | NP_866384.1 | 463 | *Rhodopirellula baltica* SH 1 |
| 254495580 | complement(NZ_ACUL01000002.1: 21176 . . . 23557) | 155 | ZP_05108502.1 | 464 | *Legionella drancourtii* LLAP12 |
| 254380451 | NZ_DS570384.1: 88623 . . . 90992 | 156 | ZP_04995817.1 | 465 | *Streptomyces* sp. Mg1 |
| 227974767 | NZ_ACGW01000133.1: 1172 . . . 3235 | 157 | ZP_04023055.1 | 466 | *Lactobacillus reuteri* SD2112 |
| 227530011 | NZ_ACGV01000134.1: 2320 . . . 4794 | 158 | ZP_03960060.1 | 467 | *Lactobacillus vaginalis* ATCC 49540 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 194467185 | complement(NZ_AAPZ02000001.1: 905298 . . . 907709) | 159 | ZP_03073172.1 | 468 | *Lactobacillus reuteri* 100-23 |
| 256847586 | NZ_GG698803.1: 21616 . . . 24015 | 160 | ZP_05553031.1 | 469 | *Lactobacillus coleohominis* 101-4-CHN |
| 260662452 | complement(NZ_GG704700.1: 145244 . . . 147643) | 161 | ZP_05863347.1 | 470 | *Lactobacillus fermentum* 28-3-CHN |
| 227903484 | NZ_ACHN01000046.1: 59035 . . . 61452 | 162 | ZP_04021289.1 | 471 | *Lactobacillus acidophilus* ATCC 4796 |
| 227877116 | NZ_ACKR01000020.1: 11753 . . . 14191 | 163 | ZP_03995194.1 | 472 | *Lactobacillus crispatus* JV-V01 |
| 227893117 | NZ_ACGU01000035.1: 36787 . . . 39186 | 164 | ZP_04010922.1 | 473 | *Lactobacillus ultunensis* DSM 16047 |
| 256844475 | NZ_GG698762.1: 280846 . . . 283242 | 165 | ZP_05549961.1 | 474 | *Lactobacillus crispatus* 125-2-CHN |
| 227521312 | complement(NZ_ACG001000008.1: 37191 . . . 39647) | 166 | ZP_03951361.1 | 475 | *Lactobacillus gasseri* JV-V03 |
| 259501613 | complement(NZ_ACLN01000019.1: 10173 . . . 12569) | 167 | ZP_05744515.1 | 476 | *Lactobacillus iners* DSM 13335 |
| 104773655 | NC_008054.1: 449229 . . . 451631 | 168 | YP_618635.1 | 477 | *Lactobacillus delbrueckii* subsp. *bulgaricus* ATCC 11842 |
| 227525868 | NZ_ACGQ01000037.1: 36941 . . . 39310 | 169 | ZP_03955917.1 | 478 | *Lactobacillus jensenii* JV-V16 |
| 227512366 | NZ_ACGH01000107.1: 31655 . . . 34045 | 170 | ZP_03942415.1 | 479 | *Lactobacillus buchneri* ATCC 11577 |
| 118587374 | complement(NZ_AAUV01000059.1: 59008 . . . 61416) | 171 | ZP_01544800.1 | 480 | *Oenococcus oeni* ATCC BAA-1163 |
| 28379168 | complement(NC_004567.1: 2362936 . . . 2365302) | 172 | NP_786060.1 | 481 | *Lactobacillus plantarum* WCFS1 |
| 21363093 | AJ309011.1: 181 . . . 2547 | 173 | Q937F6 | 482 | XPKA_LACPE |
| 81427904 | NC_007576.1: 286496 . . . 288859 | 174 | YP_394903.1 | 483 | *Lactobacillus sakei* subsp. *sakei* 23K |
| 116492156 | NC_008525.1: 398927 . . . 401290 | 175 | YP_803891.1 | 484 | *Pediococcus pentosaceus* ATCC 25745 |
| 259648565 | AP011548.1: 211570 . . . 213957 | 176 | BAI40727.1 | 485 | *Lactobacillus rhamnosus* GG |
| 227510093 | complement(NZ_ACGG01000115.1: 64541 . . . 66952) | 177 | ZP_03940142.1 | 486 | *Lactobacillus brevis* subsp. *gravesensis* ATCC 27305 |
| 227891468 | complement(NZ_ACGT01000007.1: 44265 . . . 46625) | 178 | ZP_04009273.1 | 487 | *Lactobacillus salivarius* ATCC 11741 |
| 227528594 | NZ_ACGS01000122.1: 352 . . . 2721 | 179 | ZP_03958643.1 | 488 | *Lactobacillus ruminis* ATCC 25644 |
| 229542373 | complement(NZ_AAWV02000001.1: 1384102 . . . 1386486) | 180 | ZP_04431433.1 | 489 | *Bacillus coagulans* 36D1 |
| 238021480 | complement(NZ_ACJW02000002.1: 913355 . . . 915730) | 181 | ZP_04601906.1 | 490 | *Kingella oralis* ATCC 51147 |
| 259046526 | NZ_ACKZ01000008.1: 36586 . . . 38955 | 182 | ZP_05736927.1 | 491 | *Granulicatella adiacens* ATCC 49175 |
| 157150221 | NC_009785.1: 333239 . . . 335623 | 183 | YP_001449631.1 | 492 | *Streptococcus gordonii* str. *Challis* substr. CH1 |
| 25011879 | complement(NC_004368.1: 1900754 . . . 1903132) | 184 | NP_736274.1 | 493 | *Streptococcus agalactiae* NEM316 |
| 229555065 | complement(NZ_ACCR01000006.1: 74043 . . . 76418) | 185 | ZP_04442854.1 | 494 | *Listeria grayi* DSM 20601 |
| 257866707 | NZ_GG670386.1: 478278 . . . 480644 | 186 | ZP_05646360.1 | 495 | *Enterococcus casseliflavus* EC30 |
| 257870669 | NZ_GG670289.1: 233512 . . . 235875 | 187 | ZP_05650322.1 | 496 | *Enterococcus gallinarum* EG2 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 257895654 | NZ_GG670306.1: 612981 . . . 615353 | 188 | ZP_05675307.1 | 497 | *Enterococcus faecium* Com12 |
| 238810139 | AP009608.1: 744956 . . . 747334 | 189 | BAH69929.1 | 498 | *Mycoplasma fermentans* PG18 |
| 193216764 | NC_011025.1: 384420 . . . 386801 | 190 | YP_002000006.1 | 499 | *Mycoplasma arthritidis* 158L3-1 |
| 148377390 | NC_009497.1: 136795 . . . 139182 | 191 | YP_001256266.1 | 500 | *Mycoplasma agalactiae* PG2 |
| 191639669 | NC_010999.1: 2885324 . . . 2887711 | 192 | YP_001988835.1 | 501 | *Lactobacillus casei* BL23 |
| 28379861 | NC_004567.1: 3169067 . . . 3171478 | 193 | NP_786753.1 | 502 | *Lactobacillus plantarum* WCFS1 |
| 227892171 | complement(NZ_ACGT01000037.1: 21330 . . . 23759) | 194 | ZP_04009976.1 | 503 | *Lactobacillus salivarius* ATCC 11741 |
| 116618551 | NC_008531.1: 1449343 . . . 1451709 | 195 | YP_818922.1 | 504 | *Leuconostoc mesenteroides* subsp. *mesenteroides* ATCC 8293 |
| 116333142 | NC_008497.1: 507704 . . . 510163 | 196 | YP_794669.1 | 505 | *Lactobacillus brevis* ATCC 367 |
| 241895257 | complement(NZ_ACKU01000007.1: 101374 . . . 103833) | 197 | ZP_04782553.1 | 506 | *Weissella paramesenteroides* ATCC 33313 |
| 170016535 | NC_010471.1: 181964 . . . 184417 | 198 | YP_001727454.1 | 507 | *Leuconostoc citreum* KM20 |
| 116619034 | complement(NC_008531.1: 1934181 . . . 1936622) | 199 | YP_819405.1 | 508 | *Leuconostoc mesenteroides* subsp. *mesenteroides* ATCC 8293 |
| 161702316 | EU255918.1: 18411 . . . 20879 | 200 | ABX75772.1 | 509 | *Lactococcus lactis* subsp. *Lactis* |
| 116491770 | complement(NC_008528.1: 1731509 . . . 1733962) | 201 | YP_811314.1 | 510 | *Oenococcus oeni* PSU-1 |
| 182419955 | complement(NZ_ABDT01000107.2: 13616 . . . 15991) | 202 | ZP_02951191.1 | 511 | *Clostridium butyricum* 5521 |
| 255523324 | complement(NZ_ACVI01000003.1: 55354 . . . 57747) | 203 | ZP_05390294.1 | 512 | *Clostridium carboxidivorans* P7 |
| 15894622 | NC_003030.1: 1482782 . . . 1485172 | 204 | NP_347971.1 | 513 | *Clostridium acetobutylicum* ATCC 824 |
| 226324778 | complement(NZ_ABVR01000041.1: 500857 . . . 503232) | 205 | ZP_03800296.1 | 514 | *Coprococcus comes* ATCC 27758 |
| 253580358 | NZ_GG696051.1: 158015 . . . 160390 | 206 | ZP_04857624.1 | 515 | *Ruminococcus* sp. 5_1_39B_FAA |
| 257413435 | NZ_ABYJ02000055.1: 10320 . . . 12779 | 207 | ZP_04743029.2 | 516 | *Roseburia intestinalis* L1-82 |
| 154500233 | complement(NZ_AAXG02000041.1: 34174 . . . 36609) | 208 | ZP_02038271.1 | 517 | *Bacteroides capillosus* ATCC 29799 |
| 219119570 | XM_002180506.1: 1 . . . 2508 | 209 | XP_002180542.1 | 518 | *Phaeodactylum tricornutum* CCAP 1055/1 |
| 91975971 | NC_007958.1: 1660408 . . . 1662762 | 210 | YP_568630.1 | 519 | *Rhodopseudomonas palustris* BisB5 |
| 86750966 | complement(NC_007778.1: 4411322 . . . 4413676) | 211 | YP_487462.1 | 520 | *Rhodopseudomonas palustris* HaA2 |
| 39934743 | NC_005296.1: 1858439 . . . 1860790 | 212 | NP_947019.1 | 521 | *Rhodopseudomonas palustris* CGA009 |
| 90425290 | complement(NC_007925.1: 4235875 . . . 4238229) | 213 | YP_533660.1 | 522 | *Rhodopseudomonas palustris* BisB18 |
| 121583071 | NC_008758.1: 65532 . . . 67904 | 214 | YP_973512.1 | 523 | *Polaromonas naphthalenivorans* CJ2 |
| 115376972 | complement(NZ_AAMD01000095.1: 4173 . . . 6533) | 215 | ZP_01464191.1 | 524 | *Stigmatella aurantiaca* DW4/3-1 |
| 148547676 | complement(NC_009512.1: 2807645 . . . 2810020) | 216 | YP_001267778.1 | 525 | *Pseudomonas putida* F1 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 116668711 | NC_008541.1: 145493 . . . 147928 | 217 | YP_829644.1 | 526 | *Arthrobacter* sp. FB24 |
| 220911083 | NC_011886.1: 321712 . . . 324174 | 218 | YP_002486392.1 | 527 | *Arthrobacter chlorophenolicus* A6 |
| 260517200 | complement(NZ_ABUN01000002.1: 92936 . . . 95461) | 219 | ZP_05816651.1 | 528 | *Sanguibacter keddieii* DSM 10542 |
| 229821527 | NC_012669.1: 3398743 . . . 3401217 | 220 | YP_002883053.1 | 529 | *Beutenbergia cavernae* DSM 12333 |
| 256832813 | NC_013174.1: 1712156 . . . 1714588 | 221 | YP_003161540.1 | 530 | *Jonesia denitrificans* DSM 20603 |
| 227428425 | complement(NZ_ABVC01000008.1: 152502 . . . 154988) | 222 | ZP_03911482.1 | 531 | *Xylanimonas cellulosilytica* DSM 15894 |
| 165929357 | AM182260.1: 1 . . . 2481 | 223 | CAJ57850.1 | 532 | *Cellulomonas flavigena* |
| 145223927 | NC_009338.1: 3525804 . . . 3528275 | 224 | YP_001134605.1 | 533 | *Mycobacterium gilvum* PYR-GCK |
| 120404048 | NC_008726.1: 3236585 . . . 3239083 | 225 | YP_953877.1 | 534 | *Mycobacterium vanbaalenii* PYR-1 |
| 257069356 | NC_013172.1: 2493744 . . . 2496215 | 226 | YP_003155611.1 | 535 | *Brachybacterium faecium* DSM 4810 |
| 256824167 | NC_013169.1: 273585 . . . 276047 | 227 | YP_003148127.1 | 536 | *Kytococcus sedentarius* DSM 20547 |
| 148271607 | NC_009480.1: 506602 . . . 509040 | 228 | YP_001221168.1 | 537 | *Clavibacter michiganensis* subsp. *michiganensis* NCPPB 382 |
| 145594129 | complement(NC_009380.1: 1798516 . . . 1800918) | 229 | YP_001158426.1 | 538 | *Salinispora tropica* CNB-440 |
| 159037167 | complement(NC_009953.1: 1767167 . . . 1769569) | 230 | YP_001536420.1 | 539 | *Salinispora arenicola* CNS-205 |
| 238063593 | complement(NZ_GG657738.1: 5405062 . . . 5407251) | 231 | ZP_04608302.1 | 540 | *Micromonospora* sp. ATCC 39149 |
| 118469963 | NC_008596.1: 3674267 . . . 3676639 | 232 | YP_887914.1 | 541 | *Mycobacterium smegmatis* str. MC2 155 |
| 108799759 | NC_008146.1: 2939527 . . . 2941947 | 233 | YP_639956.1 | 542 | *Mycobacterium* sp. MCS |
| 240170498 | complement(NZ_ACBV01000039.1: 21 . . . 2423) | 234 | ZP_04749157.1 | 543 | *Mycobacterium kansasii* ATCC 12478 |
| 183982748 | complement(NC_010612.1: 3341817 . . . 3344219) | 235 | YP_001851039.1 | 544 | *Mycobacterium marinum* M |
| 41407671 | complement(NC_002944.2: 1726717 . . . 1729131) | 236 | NP_960507.1 | 545 | *Mycobacterium avium* subsp. *paratuberculosis* K-10 |
| 254819329 | NZ_ABIN01000047.1: 36474 . . . 38837 | 237 | ZP_05224330.1 | 546 | *Mycobacterium intracellulare* ATCC 13950 |
| 169629591 | complement(NC_010397.1: 2559451 . . . 2561871) | 238 | YP_001703240.1 | 547 | *Mycobacterium abscessus* |
| 84496279 | complement(NZ_AAMN01000002.1: 433314 . . . 435707) | 239 | ZP_00995133.1 | 548 | *Janibacter* sp. HTCC2649 |
| 72163369 | NC_007333.1: 3478272 . . . 3480650 | 240 | YP_291026.1 | 549 | *Thermobifida fusca* YX |
| 227984600 | complement(NZ_ABUZ01000013.1: 70531 . . . 72909) | 241 | ZP_04031845.1 | 550 | *Thermomonospora curvata* DSM 43183 |
| 229855558 | complement(NZ_ABUU01000106.1: 1385 . . . 3700) | 242 | ZP_04475514.1 | 551 | *Streptosporangium roseum* DSM 43021 |
| 229209207 | NZ_ABUI01000028.1: 55841 . . . 58189 | 243 | ZP_04335641.1 | 552 | *Nocardiopsis dassonvillei* subsp. *dassonvillei* DSM 43111 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 229862587 | NZ_ABUS01000001.1: 1911934 . . . 1914330 | 244 | ZP_04482201.1 | 553 | *Stackebrandtia nassauensis* DSM 44728 |
| 256376052 | NC_013093.1: 2125566 . . . 2127935 | 245 | YP_003099712.1 | 554 | *Actinosynnema mirum* DSM 43827 |
| 32141117 | complement(NC_003888.3: 656319 . . . 658772) | 246 | NP_733508.1 | 555 | *Streptomyces coelicolor* A3(2) |
| 117164830 | complement(AM238664.1: 846551 . . . 849055) | 247 | CAJ88379.1 | 556 | *Streptomyces ambofaciens* ATCC 23877 |
| 256811868 | complement(NZ_ACFA01000015.1: 3377 . . . 5761) | 248 | ZP_05536883.1 | 557 | *Streptomyces griseoflavus* Tu4000 |
| 254405496 | complement(NZ_DS570938.1: 43288 . . . 45726) | 249 | ZP_05020421.1 | 558 | *Streptomyces sviceus* ATCC 29083 |
| 260644540 | complement(FN554889.1: 480316 . . . 482694) | 250 | CBG67625.1 | 559 | *Streptomyces scabiei* 87.22 |
| 29827814 | complement(NC_003155.4: 1579336 . . . 1581717) | 251 | NP_822448.1 | 560 | *Streptomyces avermitilis* MA-4680 |
| 239932594 | NZ_ABYA01000503.1: 5217 . . . 7595 | 252 | ZP_04689547.1 | 561 | *Streptomyces ghanaensis* ATCC 14672 |
| 256800397 | complement(NZ_ACEZ01000048.1: 24916 . . . 27303) | 253 | ZP_05530021.1 | 562 | *Streptomyces viridochromogenes* DSM 40736 |
| 256774038 | complement(NZ_ACEX01000074.1: 46221 . . . 48614) | 254 | ZP_05512501.1 | 563 | *Streptomyces hygroscopicus* ATCC 53653 |
| 260452518 | NZ_ACZH01000001.1: 321972 . . . 324359 | 255 | ZP_05800927.1 | 564 | *Streptomyces flavogriseus* ATCC 33331 |
| 182440556 | NC_010572.1: 8084439 . . . 8086826 | 256 | YP_001828275.1 | 565 | *Streptomyces griseus* subsp. *griseus* NBRC 13350 |
| 239982969 | NZ_ABYC01000425.1: 13265 . . . 15646 | 257 | ZP_04705493.1 | 566 | *Streptomyces albus* J1074 |
| 254381599 | NZ_DS570386.1: 118817 . . . 121204 | 258 | ZP_04996963.1 | 567 | *Streptomyces* sp. Mg1 |
| 256674998 | NZ_ACEU01000020.1: 1507 . . . 3900 | 259 | ZP_05485309.1 | 568 | *Streptomyces* sp. SPB78 |
| 227377421 | NZ_ABUC01000002.1: 229225 . . . 231603 | 260 | ZP_03860882.1 | 569 | *Kribbella flavida* DSM 17836 |
| 54023297 | complement(NC_006361.1: 1487629 . . . 1490097) | 261 | YP_117539.1 | 570 | *Nocardia farcinica* IFM 10152 |
| 158313048 | NC_009921.1: 1426213 . . . 1428621 | 262 | YP_001505556.1 | 571 | *Frankia* sp. EAN1pec |
| 86742227 | complement(NC_007777.1: 4238578 . . . 4240986) | 263 | YP_482627.1 | 572 | *Frankia* sp. CcI3 |
| 256395329 | NC_013131.1: 7133131 . . . 7135533 | 264 | YP_003116893.1 | 573 | *Catenulispora acidiphila* DSM 44928 |
| 117927729 | NC_008578.1: 555555 . . . 557948 | 265 | YP_872280.1 | 574 | *Acidothermus cellulolyticus* 11B |
| 119717842 | complement(NC_008699.1: 3839565 . . . 3841961) | 266 | YP_924807.1 | 575 | *Nocardioides* sp. JS614 |
| 134098496 | NC_009142.1: 2098116 . . . 2100512 | 267 | YP_001104157.1 | 576 | *Saccharopolyspora erythraea* NRRL 2338 |
| 209550756 | NC_011369.1: 3264963 . . . 3267347 | 268 | YP_002282673.1 | 577 | *Rhizobium leguminosarum* bv. *trifolii* WSM2304 |
| 241206160 | NC_012850.1: 3503904 . . . 3506288 | 269 | YP_002977256.1 | 578 | *Rhizobium leguminosarum* bv. *trifolii* WSM1325 |
| 190893254 | NC_010994.1: 3714233 . . . 3716620 | 270 | YP_001979796.1 | 579 | *Rhizobium etli* CIAT 652 |
| 86359034 | NC_007761.1: 3623921 . . . 3626308 | 271 | YP_470926.1 | 580 | *Rhizobium etli* CFN 42 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 222081270 | complement(NC_011983.1: 490969 . . . 493383) | 272 | YP_002540633.1 | 581 | *Agrobacterium radiobacter* K84 |
| 254720555 | NZ_ACBQ01000064.1: 129340 . . . 131718 | 273 | ZP_05182366.1 | 582 | *Brucella* sp. 83/13 |
| 239835057 | complement(NZ_ACQA01000003.1: 10528 . . . 13017) | 274 | ZP_04683384.1 | 583 | *Ochrobactrum intermedium* LMG 3301 |
| 153012043 | NC_009671.1: 16319 . . . 18706 | 275 | YP_001373254.1 | 584 | *Ochrobactrum anthropi* ATCC 49188 |
| 146339061 | complement(NC_009445.1: 2141749 . . . 2144226) | 276 | YP_001204109.1 | 585 | *Bradyrhizobium* sp. ORS278 |
| 148253833 | complement(NC_009485.1: 2424642 . . . 2427059) | 277 | YP_001238418.1 | 586 | *Bradyrhizobium* sp. BTAi1 |
| 27377629 | complement(NC_004463.1: 2749734 . . . 2752139) | 278 | NP_769158.1 | 587 | *Bradyrhizobium japonicum* USDA 110 |
| 92117435 | complement(NC_007964.1: 2109162 . . . 2111570) | 279 | YP_577164.1 | 588 | *Nitrobacter hamburgensis* X14 |
| 240137143 | NC_012808.1: 407982 . . . 410417 | 280 | YP_002961612.1 | 589 | *Methylobacterium extorquens* AM1 |
| 110634584 | complement(NC_008254.1: 2388345 . . . 2390747) | 281 | YP_674792.1 | 590 | *Mesorhizobium* sp. BNC1 |
| 260467447 | NZ_ACZA01000051.1: 15952 . . . 18360 | 282 | ZP_05813617.1 | 591 | *Mesorhizobium opportunistum* WSM2075 |
| 75676138 | NC_007406.1: 2135469 . . . 2137856 | 283 | YP_318559.1 | 592 | *Nitrobacter winogradskyi* Nb-255 |
| 170749020 | complement(NC_010505.1: 2769888 . . . 2772470) | 284 | YP_001755280.1 | 593 | *Methylobacterium radiotolerans* JCM 2831 |
| 170746859 | complement(NC_010505.1: 465997 . . . 468552) | 285 | YP_001753119.1 | 594 | *Methylobacterium radiotolerans* JCM 2831 |
| 254558916 | NC_012988.1: 271224 . . . 273809 | 286 | YP_003066011.1 | 595 | *Methylobacterium extorquens* DM4 |
| 240140298 | NC_012808.1: 3931130 . . . 3933676 | 287 | YP_002964777.1 | 596 | *Methylobacterium extorquens* AM1 |
| 220925990 | NC_011894.1: 6291823 . . . 6294321 | 288 | YP_002501292.1 | 597 | *Methylobacterium nodulans* ORS 2060 |
| 220919962 | complement(NC_011892.1: 451339 . . . 453840) | 289 | YP_002495265.1 | 598 | *Methylobacterium nodulans* ORS 2060 |
| 170741732 | NC_010511.1: 3988668 . . . 3991166 | 290 | YP_001770387.1 | 599 | *Methylobacterium* sp. 4-46 |
| 239815802 | complement(NC_012791.1: 2971257 . . . 2973608) | 291 | YP_002944712.1 | 600 | *Variovorax paradoxus* S110 |
| 89069402 | NZ_AAOT01000017.1: 31124 . . . 33460 | 292 | ZP_01156757.1 | 601 | *Oceanicola granulosus* HTCC2516 |
| 119509641 | complement(NZ_AAVW01000007.1: 15878 . . . 18259) | 293 | ZP_01628787.1 | 602 | *Nodularia spumigena* CCY9414 |
| 186682350 | NC_010628.1: 2389837 . . . 2392218 | 294 | YP_001865546.1 | 603 | *Nostoc punctiforme* PCC 73102 |
| 75906719 | complement(NC_007413.1: 617971 . . . 620352) | 295 | YP_321015.1 | 604 | *Anabaena variabilis* ATCC 29413 |
| 225522346 | NZ_ACIR01000182.1: 624 . . . 2756 | 296 | ZP_03769140.1 | 605 | *Nostoc azollae*' 0708 |
| 37520566 | NC_005125.1: 1065716 . . . 1068097 | 297 | NP_923943.1 | 606 | *Gloeobacter violaceus* PCC 7421 |
| 86608623 | NC_007776.1: 1182311 . . . 1184686 | 298 | YP_477385.1 | 607 | *Synechococcus* sp. JA-2-3B'a(2-13) |
| 150398192 | complement(NC_009636.1: 3144485 . . . 3146857) | 299 | YP_001328659.1 | 608 | *Sinorhizobium medicae* WSM419 |
| 116249832 | complement(NC_008380.1: 82152 . . . 84617) | 300 | YP_765670.1 | 609 | *Rhizobium leguminosarum* bv. *viciae* 3841 |
| 195970218 | complement(NC_003047.1: 123688 . . . 126141) | 301 | NP_384212.2 | 610 | *Sinorhizobium meliloti* 1021 |

TABLE 5-continued

SEQ ID NOs of xylulose-5-phosphate/fructose-6-phosphate phosphoketolase target gene coding regions and proteins.

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 171912985 | NZ_ABIZ01000001.1: 4370841 . . . 4373354 | 302 | ZP_02928455.1 | 611 | *Verrucomicrobium spinosum* DSM 4136 |
| 163849496 | complement(NC_010172.1: 46285 . . . 48720) | 303 | YP_001637539.1 | 612 | *Methylobacterium extorquens* PA1 |
| 85714839 | NZ_AAMY01000005.1: 72844 . . . 75210 | 304 | ZP_01045825.1 | 613 | *Nitrobacter* sp. Nb-311A |
| 168704325 | complement(NZ_ABGO01000323.1: 57 . . . 2462) | 305 | ZP_02736602.1 | 614 | *Gemmata obscuriglobus* UQM 2246 |
| 256829143 | complement(NC_013173.1: 1530488 . . . 1532881) | 306 | YP_003157871.1 | 615 | *Desulfomicrobium baculatum* DSM 4028 |
| 223939426 | complement(NZ_ABOX02000044.1: 41392 . . . 43863) | 307 | ZP_03631304.1 | 616 | *bacterium* Ellin514 |
| 237747078 | complement(NZ_GG658151.1: 2005797 . . . 2008190) | 308 | ZP_04577558.1 | 617 | *Oxalobacter formigenes* HOxBLS |
| 237749232 | complement(NZ_GG658170.1: 2042015 . . . 2044411) | 309 | ZP_04579712.1 | 618 | *Oxalobacter formigenes* OXCC13 |
| 116624013 | NC_008536.1: 6218168 . . . 6220537 | 310 | YP_826169.1 | 619 | *Solibacter usitatus* Ellin6076 |
| 194336959 | complement(NC_011060.1: 2004498 . . . 2006885) | 311 | YP_002018753.1 | 620 | *Pelodictyon phaeoclathratiforme* BU-1 |
| 194334425 | complement(NC_011059.1: 1762093 . . . 1764489) | 312 | YP_002016285.1 | 621 | *Prosthecochloris aestuarii* DSM 271 |
| 189346840 | complement(NC_010803.1: 1427679 . . . 1430054) | 313 | YP_001943369.1 | 622 | *Chlorobium limicola* DSM 245 |
| 21674344 | complement(NC_002932.3: 1423776 . . . 1426289) | 314 | NP_662409.1 | 623 | *Chlorobium tepidum* TLS |
| 110597897 | complement(NZ_AASE01000009.1: 37756 . . . 40179) | 315 | ZP_01386179.1 | 624 | *Chlorobium ferrooxidans* DSM 13031 |
| 78187379 | complement(NC_007512.1: 1709621 . . . 1712050) | 316 | YP_375422.1 | 625 | *Chlorobium luteolum* DSM 273 |
| 71907690 | complement(NC_007298.1: 2220090 . . . 2222456) | 317 | YP_285277.1 | 626 | *Dechloromonas aromatica* RCB |
| 74316849 | NC_007404.1: 876540 . . . 878978 | 318 | YP_314589.1 | 627 | *Thiobacillus denitrificans* ATCC 25259 |
| 91775246 | complement(NC_007947.1: 935825 . . . 938200) | 319 | YP_545002.1 | 628 | *Methylobacillus flagellatus* KT |
| 30250069 | NC_004757.1: 2318109 . . . 2320481 | 320 | NP_842139.1 | 629 | *Nitrosomonas europaea* ATCC 19718 |
| 114332052 | NC_008344.1: 2209596 . . . 2211971 | 321 | YP_748274.1 | 630 | *Nitrosomonas eutropha* C91 |
| 82702122 | NC_007614.1: 1152112 . . . 1154535 | 322 | YP_411688.1 | 631 | *Nitrosospira multiformis* ATCC 25196 |
| 77166175 | NC_007484.1: 3082455 . . . 3084869 | 323 | YP_344700.1 | 632 | *Nitrosococcus oceani* ATCC 19707 |
| 46445639 | complement(NC_005861.1: 5907 . . . 8303) | 324 | YP_007004.1 | 633 | *Candidatus Protochlamydia amoebophila* UWE25 |
| 16263040 | complement(NC_003037.1: 591065 . . . 593440) | 325 | NP_435833.1 | 634 | *Sinorhizobium meliloti* 1021 |
| 229532493 | NZ_ABUV01000006.1: 47234 . . . 49585 | 326 | ZP_04421874.1 | 635 | *Sulfurospirillum deleyianum* DSM 6946 |
| 13475490 | NC_002678.2: 5384229 . . . 5386652 | 327 | NP_107054.1 | 636 | *Mesorhizobium loti* MAFF303099 |
| 209885940 | complement(NC_011386.1: 2786353 . . . 2788746) | 328 | YP_002289797.1 | 637 | *Oligotropha carboxidovorans* OM5 |
| 182679166 | NC_010581.1: 2524033 . . . 2526420 | 329 | YP_001833312.1 | 638 | *Beijerinckia indica* subsp. *indica* ATCC 9039 |

Numerous examples of polynucleotides, genes and/or polypeptides encoding phosphotransacetylase are known in the art and can be used in relation to the recombinant host cells disclosed herein. In embodiments, the phosphotransacetylase can be EutD from *Lactobacillus plantarum*. In embodiments, the phosphotransacetylase can be the phosphotransacetylase from *Bacillus subtilis*. This phosphotransacetylase has a specific activity of 1371 μmol/min/mg and a Km 0.06 mM for acetyl-CoA (Rado and Hoch, *Biochim. Biophys. Acta.* 321: 114-25; 1973). In addition, the equilibrium constant (Keq) of this reaction was found to be 154±14 in favor of the formation of acetyl-CoA according to the following formula:

$$\frac{[\text{acetyl-CoA}][\text{Pi}]}{[\text{CoA}][\text{acetyl-P}]} = \text{Keq}$$

In embodiments, host cells comprise a polypeptide having at least about 80%, at least about 85%, at least about 90%, or at least about 99% identity to a polypeptide of Table 10 or an active fragment thereof or a polynucleotide encoding such a polypeptide. In embodiments, the phosphotransacetylase can be a polypeptide having at least about 80%, at least about 85%, at least about 90%, at least about 95%, or at least about 99% identity to SEQ ID NO: 1472 or an active fragment thereof. In other embodiments, a polynucleotide, gene and/or polypeptide encoding phosphotransacetylase can include, but is not limited to, a sequence provided in the following tables 10 or 12.

following organisms: *S. enterica, E. coli* K12, *V. Parvula, C. Kluyveri, C. Acetobutylicum, C. Thermocellum, M. thermophile, S. pyogenes, B. subtilis, L. fermentum, L. plantarum, L. sanfranciscensis, B. subtilis, L. fermentum, L. plantarum, L. sanfranciscensis, R. palustris, E. coli.*

Experimentally verified phosphate acetyltransferases (EC 2.3.1.8) belong to the PTA_PTB pfam family. However, the PTA_PTB domain is present in 13 distinct architectures (http://pfam.janelia.org/family/PF01515, Pfam database version 24). The motivation for investigating the domain architecture is to determine which of the proteins, that were identified by BLAST search, are likely to be phosphate acetyltransferases.

Experimentally verified sequences extracted from the BRENDA database as well as sequences retained after the CD-HIT clustering and clean-up, were searched against the Pfam database to determine their domain architecture. Pfam is a collection of multiple sequence alignments and profile hidden Markov models (HMMs). Each Pfam HMM represents a protein family or domain. By searching a protein sequence against the Pfam library of HMMs, it is possible to determine which domains it carries i.e. its domain architecture. (*The Pfam protein families database*: R. D. Finn, J. Tate, J. Mistry, P. C. Coggill, J. S. Sammut, H. R. Hotz, G. Ceric, K. Forslund, S. R. Eddy, E. L. Sonnhammer and A. Bateman Nucleic Acids Research (2008) Database Issue 36:D281-D288)

Twelve of the experimentally verified proteins only contained the PTA_PTB domain. Two sequences, from *R. palustris* and *E. coli*, contained two domains PTA_PTB and

TABLE 10

SEQ ID NOs of phosphotransacetylase target gene coding regions and proteins.

| Description | SEQ ID NO: Nucleic acid | SEQ ID NO: Amino acid | Amino acid sequence |
|---|---|---|---|
| EutD phosphotransacetylase from *Lactobacillus plantarum* | 1111 | 1472 | MDLFESLAQKITGKDQTIVFPEGTEPRIVGAAARLAADGLVKPIVLGATDKVQAVANDLN ADLTGVQVLDPATYPAEDKQAMLDALVERRKGKNTPEQAAKMLEDENYFGTMLVYMGKAD GMVSGAIHPTGDTVRPALQIIKTKPGSHRISGAFIMQKGEERYVFADCAINIDPDADTLA EIATQSAATAKVFDIDPKVAMLSFSTKGSAKGEMVTKVQEATAKAQAAEPELAIDGELQF DAAFVEKVGLQKAPGSKVAGHANVFVFPELQSGNIGYKIAQRFGHFEAVGPVLQGLNKPV SDLSRGCSEEDVYKVAIITAAQGLA |
| Phosphotransacetylase from *Bacillus subtilis* | 1061 | 1422 | MADLFSTVQEKVAGKDVKIVFPEGLDERILEAVSKLAGNKVLNPIVIGNENEIQAKAKEL NLTLGGVKIYDPHTYEGMEDLVQAFVERRKGKATEEQARKALLDENYFGTMLVYKGLADG LVSGAAHSTADTVRPALQIIKTKEGVKKTSGVFIMARGEEQYVFADCAINIAPDSQDLAE IAIESANTAKMFDIEPRVAMLSFSTKGSAKSDETEKVADAVKIAKEKAPELTLDGEFQFD AAFVPSVAEKKAPDSEIKGDANVFVFPSLEAGNIGYKIAQRLGNFEAVGPILQGLNMPVN DLSRGCNAEDVYNLALITAAQAL |

Additional suitable phosphotransacetylase target gene coding regions and proteins were identified by diversity searching and clustering. A blast search of the non redundant GenBank protein database (NR) was performed with the *L. plantarum* EutD protein as a query sequence. A blast cut-off (Evalue) of 0.01 was applied. This search resulted in 2124 sequence matches. Redundancy reduction was achieved by clustering proteins with the CD-HIT program with parameters set at 95% sequence identity and 90% length overlap. The longest seed sequence, representative of each cluster, is retained for further analysis. Clustering reduced the number of protein sequences to 1336. Further clean-up of the sequences by removing sequences <280 amino acids and sequences >795 amino acids resulted in 1231 seqs.

The Brenda database was queried for experimentally verified phosphate acetyltransferases. Thirteen were found in the DRTGG, a domain of unknown function. Therefore, from the CD-HIT clustering results, proteins that contained either the PTA_PTB domain only (Group 1: 549 sequences) or a combination of PTA_PTB+DRTGG domains (Group 2: 201 sequences) were chosen.

Furthermore, the PTA_PTB domain, as the name indicates, is actually not specific to phosphate acetyltransferases. The domain is also a signature for phosphate butyryltransferases (EC 2.3.1.19). Two methods to distinguish between the two subfamilies: acetyltransferases and butyryltransferases were employed and are as follows:

To further characterize the relationship among the sequences, multiple sequence alignment MSA), phylogenetic analysis, profile HMMs and GroupSim analysis were performed. For this set of analyses, the phosphate acetyltransferases are split in two groups. Group 1 contains phosphate acetyltransferases with the PTA_PTB domain only, while Group 2 contains phosphate acetyltransferases with PTA_PTB+DRTGG. The motivation here is to generate groups with similar lengths.

Clustal X, version 2.0 was used for sequence alignments with default parameters. (Thompson J D, et al. The CLUSTAL_X windows interface: flexible strategies for multiple sequence alignment aided by quality analysis tools. *Nucleic Acids Res*. (1997) 25:4876-4882.)

Alignment results were utilized to compute % sequence identities to a reference sequence. If the sequence from *L. plantarum* is taken as a reference, % IDs range from as low as 10.5% to 75.6% for the closest sequence. Alignment results also provided the basis for re-constructing phylogenetic trees. The Neighbor Joining method, available in the Jalview package version 2.3, was used to produce the trees, and computed trees were visualized in MEGA 4 (Tamura, Dudley, Nei, and Kumar 2007). The Neighbor Joining method is a method for re-constructing phylogenetic trees, and computing the lengths of the branches of this tree. In each stage, the two nearest nodes of the tree (the term "nearest nodes" will be defined in the following paragraphs) are chosen and defined as neighbors in our tree. This is done recursively until all of the nodes are paired together. "The neighbor joining method: a new method for reconstructing phylogenetic trees. Mol Biol Evol. 1987 July; 4(4):406-25. Saitou N, Nei M." Jalview Version 2 is a system for interactive editing, analysis and annotation of multiple sequence alignments (Waterhouse, A. M., Procter, J. B., Martin, D. M. A, Clamp, M. and Barton, G. J. (2009) "Jalview Version 2—a multiple sequence alignment editor and analysis workbench" *Bioinformatics* 25 (9) 1189-1191). The MEGA software provides tools for exploring, discovering, and analyzing DNA and protein sequences from an evolutionary perspective. MEGA4 enables the integration of sequence acquisition with evolutionary analysis. It contains an array of input data and multiple results explorers for visual representation; the handling and editing of sequence data, sequence alignments, inferred phylogenetic trees; and estimated evolutionary distances. The results explorers allow users to browse, edit, summarize, export, and generate publication-quality captions for their results. MEGA 4 also includes distance matrix and phylogeny explorers as well as advanced graphical modules for the visual representation of input data and output results (Tamura K, Dudley J, Nei M & Kumar S (2007) MEGA4: Molecular Evolutionary Genetics Analysis (MEGA) software version 4.0. Molecular Biology and Evolution 24:1596-1599).

Taken together, % IDs and the generated tree (FIG. 4) indicated that potential phosphate acetyltransferases (PTA_PTB domain only) are divided in two major subfamilies. Subfamily 1 from 10.5% ID to ~20% ID (176 sequences) and Subfamily 2 from ~20% ID to 75.6% ID (361 sequences). The third Subfamily, of 12 sequences, has % ID ranging from 17% ID to 25% ID with respect to the *L. plantarum* sequence.

Based on experimentally verified sequences contained within each of the Subfamilies, Subfamily 1 and Subfamily 2 were determined to represent phosphate butyryltransferases (PTB) and phosphate acetylytransferases (PTA) respectively.

Discrimination between Subfamily 1 members and Subfamily 2 members was also performed by GroupSim analysis (Capra and Singh (2008) Bioinformatics 24: 1473-1480). The GroupSim method identifies amino acid residues that determine a protein's functional specificity. In a multiple sequence alignment (MSA) of a protein family whose sequences are divided into multiple Subfamilies, amino acid residues that distinguish between the functional Subfamilies of sequences can be identified. The method takes a multiple sequence alignment (MSA) and known specificity groupings as input, and assigns a score to each amino acid position in the MSA. Higher scores indicate a greater likelihood that an amino acid position is a specificity determining position (SDP).

GroupSim analysis performed on the MSA of 537 sequences (divided into Subfamily 1 and Subfamily 2 by the phylogenetic analysis above) identified highly discriminating positions. Listed in Table 11 are positions (Pos) having scores greater than to 0.7, where a perfect score of 1.0 would indicate that all proteins within the Subfamily have the listed amino acid in the specified position and between Subfamilies the amino acid would always be different. The "Pattern" columns give the amino acid(s) in single letter code. Numbers between parentheses indicate frequency of occurrence of each amino acid at the particular position. The amino acid position number in column 1 is for the PTA protein sequence from *Lactobacillus plantarum*, the representative protein of group 2 with a GI#28377658 (SEQ ID NO: 1472).

TABLE 11

Highly discriminating amino acid positions for Subfamily 1 (PTB) and Subfamily 2 (PTA) from GroupSim analysis.

| Pos | Score | Pattern PTB | Pattern PTA |
|---|---|---|---|
| 212 | 0.980314 | Group 1: E(173), D(2), L(1) | Group 2: S(360), N(1) |
| 305 | 0.87236 | Group 1: L(152), V(11), M(5), I(5), F(3) | Group 2: D(360), Q(1) |
| 242 | 0.831201 | Group 1: A(142), D(15), S(13), G(4), T(2) | Group 2: Q(361) |
| 208 | 0.776954 | Group 1: L(130), I(35), V(11) | Group 2: S(355), A(6) |
| 125 | 0.705868 | Group 1: K(175), R(1) | Group 2: S(215), A(85), G(41), C(14), N(4), T(2) |

An alternative structure/function characterization of the PTA and PTB subfamilies of enzymes was performed using the HMMER software package (the theory behind profile HMMs is described in R. Durbin, S. Eddy, A. Krogh, and G. Mitchison, Biological sequence analysis: probabilistic models of proteins and nucleic acids, Cambridge University Press, 1998; Krogh et al., 1994; J. Mol. Biol. 235:1501-1531), following the user guide which is available from HMMER (Janelia Farm Research Campus, Ashburn, Va.).

Using a multiple sequence alignment of the experimentally verified sequences (containing the PTA_PTB domain only) in Subfamily 2, a profile Hidden Markov Model (HMM) was created for representing Subfamily 2 members. The sequences were:

1. BAB19267.1 from *Lactobacillus sanfranciscensis* (SEQ ID NO: 1475)
2. NP_784550.1 from *Lactobacillus plantarum* WCFS1 (SEQ ID NO: 1472)
3. ZP_03944466.1 from *Lactobacillus fermentum* ATCC 14931 (SEQ ID NO: 1453)
4. NP_391646.1 from *Bacillus subtilis* subsp. *subtilis* str. 168 (SEQ ID NO: 1422)
5. AAA72041.1 from *Methanosarcina thermophila* (SEQ ID NO: 1277)
6. ZP_03152606.1 from *Clostridium thermocellum* DSM 4150 (SEQ ID NO: 1275)
7. NP_348368.1 from *Clostridium acetobutylicum* ATCC 824 (SEQ ID NO: 1206)
8. YP_001394780.1 from *Clostridium kluyveri* DSM 555 (SEQ ID NO: 1200)
9. ZP_03855267.1 from *Veillonella parvula* DSM 2008 (SEQ ID NO: 1159)

10. YP_149725.1 from *Salmonella enterica* subsp. *enterica* serovar Paratyphi A str. ATCC 9150 (SEQ ID NO: 1129)

The Profile HMM was built as follows: The 10 seed sequences (sequences representing experimentally verified function) that are in Subfamily 2 were aligned using Clustal X (interface to Clustal W) with default parameters. The hmmbuild program was run on each set of the aligned sequences using default parameters. hmmbuild reads the multiple sequence alignment file, builds a new Profile HMM, and saves the Profile HMM to file. Using this program an uncalibrated profile was generated from the multiple alignment for each set of subunit sequences described above.

The Profile HMM was read using hmmcalibrate which scores a large number of synthesized random sequences with the Profile (the default number of synthetic sequences used is 5,000), fits an extreme value distribution (EVD) to the histogram of those scores, and re-saves the HMM file now including the EVD parameters. These EVD parameters (μ and λ) are used to calculate the E-values of bit scores when the profile is searched against a protein sequence database. hmmcalibrate writes two parameters into the HMM file on a line labeled "EVD": these parameters are the μ (location) and λ (scale) parameters of an extreme value distribution (EVD) that best fits a histogram of scores calculated on randomly generated sequences of about the same length and residue composition as SWISS-PROT. This calibration was done once for the Profile HMM.

The calibrated pofile HMM for the Subfamily 2 set is provided as Table 14. The Profile HMM table gives the probability of each amino acid occurring at each position in the amino acid sequence. The amino acids are represented by the one letter code. The first line for each position reports the match emission scores: probability for each amino acid to be in that state (highest score is highlighted). The second line reports the insert emission scores, and the third line reports on state transition scores: M→M, M→I, M→D; I→M, I→I; D→M, D→D; B→M; M→E. Table 14 shows that in the Subfamily 2 profile HMM, methionine has a 3792 ans 4481 probability of being in the first two positions.

The Subfamily 2 profile HMM was evaluated using hmmsearch, with the Z parameter set to one billion, for the ability to discriminate Subfamily 1 members from those of Subfamily 2. The hmmsearch program takes the hmm file for the Subfamily 2 profile HMM and all the sequences from both Subfamilies and assigns an E-value score to each sequence. This E-value score is a measure of fit to the Profile HMM, with a lower score being a better fit. The Profile HMM distinguished Subfamily 2 members from Subfamily 1 members and there was a large margin of E-value difference between the worst scoring Subfamily 2 member (5e-34) and the best scoring Subfamily 1 member (4.3e-07). This analysis shows that the Profile HMM prepared for Subfamily 2 phosphate acetyltransferases (PTA) distinguishes PTA sequences from phosphate butyryltransferase PTB protein sequences.

Based on these analyses, 361 phosphate acetyltransferase sequences (PTA_PTB domain only) were identified and are provided in Table 12a.

TABLE 12a

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 255994631 | complement (NZ_ACON01000003.1: 407639 . . . 408607) | 762 | ZP_05427766.1 | 1123 | *Eubacterium saphenum* ATCC 49989 |
| 223935781 | NZ_ABOX02000007.1: 10458 . . . 11600 | 763 | ZP_03627696.1 | 1124 | *bacterium* Ellin514 |
| 196232920 | NZ_ABVL01000018.1: 134406 . . . 135449 | 764 | ZP_03131770.1 | 1125 | *Chthoniobacter flavus* Ellin428 |
| 187735919 | NC_010655.1: 1714393 . . . 1715484 | 765 | YP_001878031.1 | 1126 | *Akkermansia muciniphila* ATCC BAA-835 |
| 237732443 | complement (NZ_GG657366.1: 2437071 . . . 2438087) | 766 | ZP_04562924.1 | 1127 | *Citrobacter* sp. 30_2 |
| 157144617 | NC_009792.1: 326993 . . . 328009 | 767 | YP_001451936.1 | 1128 | *Citrobacter koseri* ATCC BAA-895 |
| 56412650 | NC_006511.1: 473496 . . . 474512 | 768 | YP_149725.1 | 1129 | *Salmonella enterica* subsp. *enterica* serovar *Paratyphi* A str. ATCC 9150 |
| 161502384 | NC_010067.1: 425125 . . . 426141 | 769 | YP_001569496.1 | 1130 | *Salmonella enterica* subsp. *arizonae* serovar 62: z4, z23: — |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 16130383 | complement (NC_000913.2: 2570511 . . . 2571527) | 770 | NP_416953.1 | 1131 | *Escherichia coli* str. K-12 substr. MG1655 |
| 238895918 | complement (NC_012731.1: 3863205 . . . 3864221) | 771 | YP_002920654.1 | 1132 | *Klebsiella pneumoniae* NTUH-K2044 |
| 238794182 | complement (NZ_AALF02000025.1: 17041 . . . 18039) | 772 | ZP_04637797.1 | 1133 | *Yersinia intermedia* ATCC 29909 |
| 90414632 | complement (NZ_AAPH01000046.1: 12550 . . . 13527) | 773 | ZP_01222604.1 | 1134 | *Photobacterium profundum* 3TCK |
| 163749608 | complement (NZ_ABIC01000008.1: 73942 . . . 74913) | 774 | ZP_02156855.1 | 1135 | *Shewanella benthica* KT99 |
| 120554157 | NC_008740.1: 1389827 . . . 1390810 | 775 | YP_958508.1 | 1136 | *Marinobacter aquaeolei* VT8 |
| 51246887 | complement (NC_006138.1: 3433697 . . . 3434677) | 776 | YP_066771.1 | 1137 | *Desulfotalea psychrophila* LSv54 |
| 226362753 | complement (NC_012522.1: 3613049 . . . 3614074) | 777 | YP_002780531.1 | 1138 | *Rhodococcus opacus* B4 |
| 111020534 | complement (NC_008268.1: 3751557 . . . 3752585) | 778 | YP_703506.1 | 1139 | *Rhodococcus jostii* RHA1 |
| 256669010 | NZ_ACEV01000044.1: 80096 . . . 81085 | 779 | ZP_05479963.1 | 1140 | *Streptomyces* sp. AA4 |
| 226227292 | complement (NC_012489.1: 2203452 . . . 2204474) | 780 | YP_002761398.1 | 1141 | *Gemmatimonas aurantiaca* T-27 |
| 239627158 | complement (NZ_DS990260.1: 924717 . . . 925736) | 781 | ZP_04670189.1 | 1142 | *Clostridiales bacterium* 1_7_47FAA |
| 256753163 | complement (NZ_ACXX01000001.1: 167634 . . . 168635) | 782 | ZP_05493958.1 | 1143 | *Clostridium papyrosolvens* DSM 2782 |
| 257063834 | NC_013165.1: 1278820 . . . 1279818 | 783 | YP_003143506.1 | 1144 | *Slackia heliotrinireducens* DSM 20476 |
| 254477436 | NZ_DS999054.1: 3384063 . . . 3384914 | 784 | ZP_05090822.1 | 1145 | *Ruegeria* sp. R11 |
| 126732220 | complement (NZ_AAYA01000016.1: 68052 . . . 68996) | 785 | ZP_01748021.1 | 1146 | *Sagittula stellata* E-37 |
| 19704507 | complement (NC_003454.1: 1833702 . . . 1834715) | 786 | NP_604069.1 | 1147 | *Fusobacterium nucleatum* subsp. *nucleatum* ATCC 25586 |
| 260494604 | NZ_GG704456.1: 222376 . . . 223389 | 787 | ZP_05814734.1 | 1148 | *Fusobacterium* sp. 3_1_33 |
| 262067001 | complement (NZ_ACJY01000064.1: 9865 . . . 10869) | 788 | ZP_06026613.1 | 1149 | *Fusobacterium periodonticum* ATCC 33693 |
| 257452333 | complement (NZ_ACDD01000037.1: 1250 . . . 2263) | 789 | ZP_05617632.1 | 1150 | *Fusobacterium* sp. 3_1_5R |
| 257463639 | NZ_ACDG01000104.1: 17109 . . . 18122 | 790 | ZP_05628030.1 | 1151 | *Fusobacterium* sp. D12 |
| 253583748 | complement (NZ_GG696122.1: 645905 . . . 646912) | 791 | ZP_04860946.1 | 1152 | *Fusobacterium varium* ATCC 27725 |
| 237736963 | NZ_GG657909.1: 489336 . . . 490343 | 792 | ZP_04567444.1 | 1153 | *Fusobacterium mortiferum* ATCC 9817 |
| 157736754 | complement (NC_009850.1: 500921 . . . 501916) | 793 | YP_001489437.1 | 1154 | *Arcobacter butzleri* RM4018 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 257125122 | NC_013192.1: 327731 . . . 328735 | 794 | YP_003163236.1 | 1155 | *Leptotrichia buccalis* C-1013-b |
| 260891157 | NZ_ACVB02000026.1: 170989 . . . 171993 | 795 | ZP_05902420.1 | 1156 | *Leptotrichia hofstadii* F0254 |
| 262037878 | complement (NZ_ADAD01000064.1: 9188 . . . 10195) | 796 | ZP_06011308.1 | 1157 | *Leptotrichia goodfellowii* F0264 |
| 229859891 | NZ_ABUT01000004.1: 63190 . . . 64215 | 797 | ZP_04479548.1 | 1158 | *Streptobacillus moniliformis* DSM 12112 |
| 227371784 | NZ_ABVB01000002.1: 260421 . . . 261419 | 798 | ZP_03855267.1 | 1159 | *Veillonella parvula* DSM 2008 |
| 227498373 | complement (NZ_ACGB01000001.1: 109630 . . . 110643) | 799 | ZP_03928523.1 | 1160 | *Acidaminococcus* sp. D21 |
| 42525561 | NC_002967.9: 48816 . . . 49823 | 800 | NP_970659.1 | 1161 | *Treponema denticola* ATCC 35405 |
| 257456313 | NZ_ACYH01000011.1: 210840 . . . 211847 | 801 | ZP_05621510.1 | 1162 | *Treponema vincentii* ATCC 35580 |
| 15639088 | NC_000919.1: 102879 . . . 103889 | 802 | NP_218534.1 | 1163 | *Treponema pallidum* subsp. *pallidum* str. Nichols |
| 228000316 | complement (NZ_ABTG01000001.1: 1179041 . . . 1180048) | 803 | ZP_04047318.1 | 1164 | *Brachyspira murdochii* DSM 12563 |
| 225619252 | NC_012225.1: 340269 . . . 341276 | 804 | YP_002720478.1 | 1165 | *Brachyspira hyodysenteriae* WA1 |
| 218960931 | complement (NS_000195.1: 716420 . . . 717424) | 805 | YP_001740706.1 | 1166 | *Candidatus Cloacamonas acidaminovorans* |
| 239878221 | complement (join(GG681098.1: 49679 . . . 49966, GG681098.1: 50017 . . . 50325, GG681098.1: 50380 . . . 50442, GG681098.1: 50494 . . . 50605, GG681098.1: 50656 . . . 50780, GG681098.1: 50826 . . . 50908, GG681098.1: 50958 . . . 51039)) | 806 | EER05013.1 | 1167 | *Perkinsus marinus* ATCC 50983 |
| 119953373 | NC_008710.1: 614125 . . . 615171 | 807 | YP_945582.1 | 1168 | *Borrelia turicatae* 91E135 |
| 187918450 | NC_010673.1: 616784 . . . 617842 | 808 | YP_001884013.1 | 1169 | *Borrelia hermsii* DAH |
| 203284493 | NC_011229.1: 622676 . . . 623746 | 809 | YP_002222233.1 | 1170 | *Borrelia duttonii* Ly |
| 224534734 | complement (NZ_ABKB02000009.1: 27640 . . . 28677) | 810 | ZP_03675306.1 | 1171 | *Borrelia spielmanii* A14S |
| 216263399 | NZ_ABCU02000001.1: 172066 . . . 173103 | 811 | ZP_03435394.1 | 1172 | *Borrelia afzelii* ACA-1 |
| 219685198 | NZ_ABPZ02000001.1: 172004 . . . 173041 | 812 | ZP_03540018.1 | 1173 | *Borrelia garinii* Far04 |
| 224532296 | NZ_ABCY02000001.1: 609419 . . . 610456 | 813 | ZP_03672928.1 | 1174 | *Borrelia valaisiana* VS116 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 15594934 | NC_001318.1: 608020 . . . 609078 | 814 | NP_212723.1 | 1175 | *Borrelia burgdorferi* B31 |
| 189485346 | NS_000191.1: 518918 . . . 519919 | 815 | YP_001956287.1 | 1176 | uncultured Termite group 1 *bacterium* phylotype Rs-D17 |
| 42560817 | NC_005364.2: 308545 . . . 309513 | 816 | NP_975268.1 | 1177 | *Mycoplasma mycoides* subsp. *mycoides* SC str. PG1 |
| 83319483 | NC_007633.1: 277239 . . . 278207 | 817 | YP_424216.1 | 1178 | *Mycoplasma capricolum* subsp. *capricolum* ATCC 27343 |
| 50364858 | NC_006055.1: 58892 . . . 59860 | 818 | YP_053283.1 | 1179 | *Mesoplasma florum* L1 |
| 110005214 | complement (AM285317.1: 14153 . . . 15130) | 819 | CAK99540.1 | 1180 | *Spiroplasma citri* |
| 12045155 | complement (NC_000908.2: 368733 . . . 369695) | 820 | NP_072966.1 | 1181 | *Mycoplasma genitalium* G37 |
| 13508167 | complement (NC_000912.1: 515605 . . . 516567) | 821 | NP_110116.1 | 1182 | *Mycoplasma pneumoniae* M129 |
| 31544825 | complement (NC_004829.1: 851083 . . . 852075) | 822 | NP_853403.1 | 1183 | *Mycoplasma gallisepticum* R |
| 26553955 | complement (NC_004432.1: 640803 . . . 641777) | 823 | NP_757889.1 | 1184 | *Mycoplasma penetrans* HF-2 |
| 54020554 | complement (NC_006360.1: 638554 . . . 639507) | 824 | YP_116016.1 | 1185 | *Mycoplasma hyopneumoniae* 232 |
| 240047219 | NC_012806.1: 88435 . . . 89406 | 825 | YP_002960607.1 | 1186 | *Mycoplasma conjunctivae* |
| 148377406 | NC_009497.1: 159649 . . . 160605 | 826 | YP_001256282.1 | 1187 | *Mycoplasma agalactiae* PG2 |
| 238809713 | complement (AP009608.1: 242111 . . . 243064) | 827 | BAH69503.1 | 1188 | *Mycoplasma fermentans* PG18 |
| 71894663 | complement (NC_007294.1: 757812 . . . 758771) | 828 | YP_278771.1 | 1189 | *Mycoplasma synoviae* 53 |
| 15828708 | NC_002771.1: 274992 . . . 275948 | 829 | NP_326068.1 | 1190 | *Mycoplasma pulmonis* UAB CTIP |
| 47459003 | NC_006908.1: 230100 . . . 231068 | 830 | YP_015865.1 | 1191 | *Mycoplasma mobile* 163K |
| 148377754 | NC_009497.1: 572993 . . . 573967 | 831 | YP_001256630.1 | 1192 | *Mycoplasma agalactiae* PG2 |
| 116515056 | NC_008513.1: 131608 . . . 132594 | 832 | YP_802685.1 | 1193 | *Buchnera aphidicola* str. Cc (Cinara Cedri) |
| 187934490 | NC_010674.1: 1263289 . . . 1264287 | 833 | YP_001885432.1 | 1194 | *Clostridium botulinum* B str. Eklund 17B |
| 150016048 | NC_009617.1: 1384403 . . . 1385404 | 834 | YP_001308302.1 | 1195 | *Clostridium beijerinckii* NCIMB 8052 |
| 254519224 | complement (NZ_EQ999773.1: 2015491 . . . 2016492) | 835 | ZP_05131280.1 | 1196 | *Clostridium* sp. 7_2_43FAA |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 182417251 | NZ_ABDT01000035.2: 9769 . . . 10770 | 836 | ZP_02948604.1 | 1197 | *Clostridium butyricum* 5521 |
| 18310707 | complement (NC_003366.1: 2001712 . . . 2002719) | 837 | NP_562641.1 | 1198 | *Clostridium perfringens* str. 13 |
| 255524273 | complement (NZ_ACVI01000014.1: 63543 . . . 64547) | 838 | ZP_05391232.1 | 1199 | *Clostridium carboxidivorans* P7 |
| 153954015 | NC_009706.1: 1428554 . . . 1429555 | 839 | YP_001394780.1 | 1200 | *Clostridium kluyveri* DSM 555 |
| 187778946 | NZ_ABKW02000004.1: 733017 . . . 734015 | 840 | ZP_02995419.1 | 1201 | *Clostridium sporogenes* ATCC 15579 |
| 28210926 | NC_004557.1: 1326340 . . . 1327359 | 841 | NP_781870.1 | 1202 | *Clostridium tetani* E88 |
| 253681395 | NZ_ACSJ01000007.1: 344343 . . . 345338 | 842 | ZP_04862192.1 | 1203 | *Clostridium botulinum* D str. 1873 |
| 118444574 | complement (NC_008593.1: 1416375 . . . 1417373) | 843 | YP_878298.1 | 1204 | *Clostridium novyi* NT |
| 242260238 | NZ_ACPD01000011.1: 83320 . . . 84318 | 844 | ZP_04804960.1 | 1205 | *Clostridium cellulovorans* 743B |
| 15895019 | NC_003030.1: 1890289 . . . 1891290 | 845 | NP_348368.1 | 1206 | *Clostridium acetobutylicum* ATCC 824 |
| 169247670 | EU313773.1: 40 . . . 1026 | 846 | ACA51668.1 | 1207 | *Thermoanaero bacterium saccharolyticum* |
| 255257449 | NZ_ACVG01000034.1: 8635 . . . 9621 | 847 | ZP_05336886.1 | 1208 | *Thermoanaero bacterium thermosaccharolyticum* DSM 571 |
| 20807926 | complement (NC_003869.1: 1451520 . . . 1452515) | 848 | NP_623097.1 | 1209 | *Thermoanaero bacter tengcongensis* MB4 |
| 167040369 | complement (NC_010320.1: 1738259 . . . 1739257) | 849 | YP_001663354.1 | 1210 | *Thermoanaero bacter* sp. X514 |
| 220931863 | NC_011899.1: 1110901 . . . 1111899 | 850 | YP_002508771.1 | 1211 | *Halothermothrix orenii* H 168 |
| 258514457 | complement (NC_013216.1: 1194895 . . . 1195899) | 851 | YP_003190679.1 | 1212 | *Desulfotomaculum acetoxidans* DSM 771 |
| 188586231 | complement (NC_010718.1: 1692944 . . . 1693942) | 852 | YP_001917776.1 | 1213 | *Natranaerobius thermophilus* JW/NM-WN-LF |
| 78044760 | complement (NC_007503.1: 1302969 . . . 1303973) | 853 | YP_360288.1 | 1214 | *Carboxydothermus hydrogenoformans* Z-2901 |
| 262295620 | complement (GG705150.1: 648642 . . . 649655) | 854 | EEY83551.1 | 1215 | *Bacteroides* sp. 2_1_33B |
| 154494088 | complement (NZ_AAXE02000107.1: 241237 . . . 242250) | 855 | ZP_02033408.1 | 1216 | *Parabacteroides merdae* ATCC 43184 |
| 34540818 | complement (NC_002950.2: 1149763 . . . 1150773) | 856 | NP_905297.1 | 1217 | *Porphyromonas* as *gingivalis* W83 |
| 228471187 | complement (NZ_ACLR01000214.1: 23231 . . . 24238) | 857 | ZP_04056000.1 | 1218 | *Porphyromonas uenonis* 60-3 |
| 229496164 | NZ_ACNN01000020.1: 205218 . . . 206225 | 858 | ZP_04389884.1 | 1219 | *Porphyromonas endodontalis* ATCC 35406 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 160887812 | complement (NZ_AAYH02000031.1: 6367 . . . 7386) | 859 | ZP_2068815.1 | 1220 | *Bacteroides uniformis* ATCC 8492 |
| 218131945 | NZ_ABVO01000052.1: 25694 . . . 26710 | 860 | ZP_03460749.1 | 1221 | *Bacteroides eggerthii* DSM 20697 |
| 224536405 | complement (NZ_ACCH01000118.1: 1796 . . . 2812) | 861 | ZP_03676944.1 | 1222 | *Bacteroides cellulosilyticus* DSM 14838 |
| 53711769 | NC_006347.1: 557297 . . . 558316 | 862 | YP_097761.1 | 1223 | *Bacteroides fragilis* YCH46 |
| 237715344 | complement (NZ_EQ973249.1: 217217 . . . 218236) | 863 | ZP_04545825.1 | 1224 | *Bacteroides* sp. D1 |
| 224025178 | NZ_ACBW01000140.1: 3350 . . . 4369 | 864 | ZP_03643544.1 | 1225 | *Bacteroides coprophilus* DSM 18228 |
| 198274546 | NZ_ABQC02000011.1: 44269 . . . 45279 | 865 | ZP_03207078.1 | 1226 | *Bacteroides plebeius* DSM 17135 |
| 150003111 | NC_009614.1: 740818 . . . 741831 | 866 | YP_001297855.1 | 1227 | *Bacteroides vulgatus* ATCC 8482 |
| 258649233 | complement (NZ_ACIJ02000031.1: 14596 . . . 15612) | 867 | ZP_05736702.1 | 1228 | *Prevotella tannerae* ATCC 51259 |
| 261881160 | NZ_ACKS01000109.1: 4227 . . . 5276 | 868 | ZP_06007587.1 | 1229 | *Prevotella bergensis* DSM 17361 |
| 260593477 | NZ_ACVA01000073.1: 31053 . . . 32099 | 869 | ZP_05858935.1 | 1230 | *Prevotella veroralis* F0319 |
| 260910323 | complement (NZ_ACZS01000043.1: 34220 . . . 35257) | 870 | ZP_05916997.1 | 1231 | *Prevotella* sp. oral taxon 472 str. F0295 |
| 212550465 | complement (NC_011565.1: 126538 . . . 127539) | 871 | YP_002308782.1 | 1232 | *Candidatus Azobacteroides pseudotrichonymphae* genomovar. CFP2 |
| 114566305 | NC_008346.1: 872558 . . . 873550 | 872 | YP_753459.1 | 1233 | *Syntrophomonas wolfei* subsp. *wolfei* str. Goettingen |
| 139437229 | NZ_AAVN02000001.1: 368246 . . . 369226 | 873 | ZP_01771389.1 | 1234 | *Collinsella aerofaciens* ATCC 25986 |
| 210631306 | complement (NZ_ABXJ01000041.1: 3328 . . . 4308) | 874 | ZP_03296849.1 | 1235 | *Collinsella stercoris* DSM 13279 |
| 229814970 | complement (NZ_ABXH02000002.1: 65772 . . . 66770) | 875 | ZP_04445308.1 | 1236 | *Collinsella intestinalis* DSM 13280 |
| 221194458 | complement (NZ_ACFE01000001.1: 86128 . . . 87273) | 876 | ZP_03567515.1 | 1237 | *Atopobium rimae* ATCC 49626 |
| 257784450 | complement (NC_013203.1: 723329 . . . 724309) | 877 | YP_003179667.1 | 1238 | *Atopobium parvulum* DSM 20469 |
| 227516084 | complement (NZ_ACGK01000007.1: 63717 . . . 64691) | 878 | ZP_03946133.1 | 1239 | *Atopobium vaginae* DSM 15829 |
| 227872296 | NZ_ACKX01000061.1: 10209 . . . 11261 | 879 | ZP_03990654.1 | 1240 | *Oribacterium sinus* F0268 |
| 229824780 | NZ_ACIN02000002.1: 126870 . . . 127931 | 880 | ZP_04450849.1 | 1241 | *Abiotrophia defectiva* ATCC 49176 |
| 260443831 | NZ_ACIQ01000073.1: 32192 . . . 33196 | 881 | ZP_05797601.1 | 1242 | *Oribacterium* sp. oral taxon 078 str. F0262 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 225176688 | complement (NZ_ACFX01000006.1: 113088 . . . 114089) | 882 | ZP_03730247.1 | 1243 | *Clostridium* sp. M62/1 |
| 253578981 | complement (NZ_GG696046.1: 364564 . . . 365595) | 883 | ZP_04856252.1 | 1244 | *Ruminococcus* sp. 5_1_39BFAA |
| 153813664 | NZ_AAVO02000036.1: 4823 . . . 5992 | 884 | ZP_01966332.1 | 1245 | *Ruminococcus obeum* ATCC 29174 |
| 255281061 | complement (NZ_ACCL02000005.1: 162813 . . . 163811) | 885 | ZP_05345616.1 | 1246 | *Bryantella formatexigens* DSM 14469 |
| 225571965 | NZ_ACBZ01000008.1: 1408 . . . 2442 | 886 | ZP_03780829.1 | 1247 | *Blautia hydrogenotrophica* DSM 10507 |
| 210612569 | NZ_ABWO01000095.2: 3132 . . . 4127 | 887 | ZP_03289360.1 | 1248 | *Clostridium nexile* DSM 1787 |
| 154505354 | complement (NZ_AAYG02000022.1: 50151 . . . 51146) | 888 | ZP_02042092.1 | 1249 | *Ruminococcus gnavus* ATCC 29149 |
| 197303064 | NZ_ABOU02000039.1: 71843 . . . 72838 | 889 | ZP_03168112.1 | 1250 | *Ruminococcus lactaris* ATCC 29176 |
| 153816169 | complement (NZ_AAVP02000015.1: 36559 . . . 37554) | 890 | ZP_01968837.1 | 1251 | *Ruminococcus torques* ATCC 27756 |
| 1677582999 | complement (NZ_ABFY02000009.1: 238358 . . . 239380) | 891 | ZP_02430426.1 | 1252 | *Clostridium scindens* ATCC 35704 |
| 225570721 | NZ_ABYI02000032.1: 3477 . . . 4499 | 892 | ZP_03779744.1 | 1253 | *Clostridium hylemonae* DSM 15053 |
| 166031766 | NZ_AAXA02000013.1: 54410 . . . 55414 | 893 | ZP_02234595.1 | 1254 | *Dorea formicigenerans* ATCC 27755 |
| 153853264 | complement (NZ_AAXB02000002.1: 216862 . . . 217857) | 894 | ZP_01994673.1 | 1255 | *Dorea longicatena* DSM 13814 |
| 160879474 | NC_010001.1: 1657582 . . . 1658577 | 895 | YP_001558442.1 | 1256 | *Clostridium phytofermentans* ISDg |
| 239624054 | complement (NZ_DS990263.1: 658578 . . . 659573) | 896 | ZP_04667085.1 | 1257 | *Clostridiales bacterium* 1_7_47FAA |
| 160938034 | complement (NZ_ABCC02000027.1: 52316 . . . 53311) | 897 | ZP_02085391.1 | 1258 | *Clostridium bolteae* ATCC BAA-613 |
| 260437037 | complement (NZ_ABWN01000017.1: 33488 . . . 34483) | 898 | ZP_05790853.1 | 1259 | *Butyrivibrio crossotus* DSM 2876 |
| 154483586 | complement (NZ_AAVL02000033.1: 74910 . . . 75941) | 899 | ZP_02026034.1 | 1260 | *Eubacterium ventriosum* ATCC 27560 |
| 238916996 | complement (NC_012778.1: 1076225 . . . 1077220) | 900 | YP_002930513.1 | 1261 | *Eubacterium eligens* ATCC 27750 |
| 242309058 | NZ_DS990446.1: 108718 . . . 109737 | 901 | ZP_04808213.1 | 1262 | *Helicobacter pullorum* MIT 98-5489 |
| 224418114 | complement (NZ_ABQS01000024.1: 18744 . . . 19745) | 902 | ZP_03656120.1 | 1263 | *Helicobacter canadensis* MIT 98-5491 |
| 237752737 | NZ_GG661974.1: 463241 . . . 464236 | 903 | ZP_04583217.1 | 1264 | *Helicobacter winghamensis* ATCC BAA-430 |
| 32266808 | complement (NC_004917.1: 1266998 . . . 1267993) | 904 | NP_860840.1 | 1265 | *Helicobacter hepaticus* ATCC 51449 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 224436915 | complement (NZ_ABQT01000013.1: 10506 . . . 11522) | 905 | ZP_03657896.1 | 1266 | *Helicobacter cinaedi* CCUG 18818 |
| 167745652 | complement (NZ_ABAX03000002.1: 101957 . . . 102961) | 906 | ZP_02417779.1 | 1267 | *Anaerostipes caccae* DSM 14662 |
| 167765558 | complement (NZ_ABGC03000004.1: 50807 . . . 51820) | 907 | ZP_02437622.1 | 1268 | *Clostridium* sp. SS2/1 |
| 163814038 | NZ_ABEY02000003.1: 15727 . . . 16794 | 908 | ZP_02205430.1 | 1269 | *Coprococcus eutactus* ATCC 27759 |
| 168334441 | complement (NZ_ABEQ01000029.2: 21420 . . . 22418) | 909 | ZP_02692616.1 | 1270 | *Epulopiscium* sp. 'N.t. morphotype B' |
| 257791476 | NC_013204.1: 2035882 . . . 2036880 | 910 | YP_003182082.1 | 1271 | *Eggerthella lenta* DSM 2243 |
| 256827068 | complement (NC_013170.1: 735166 . . . 736167) | 911 | YP_003151027.1 | 1272 | *Cryptobacterium curtum* DSM 15641 |
| 257063929 | complement (NC_013165.1: 1407526 . . . 1408521) | 912 | YP_003143601.1 | 1273 | *Slackia heliotrinireducens* DSM 20476 |
| 256757417 | complement (NZ_ACXX01000078.1: 7706 . . . 8701) | 913 | ZP_05498135.1 | 1274 | *Clostridium papyrosolvens* DSM 2782 |
| 196254011 | NZ_ABVG01000076.1: 9016 . . . 10092 | 914 | ZP_03152606.1 | 1275 | *Clostridium thermocellum* JW20 |
| 146297046 | complement (NC_009437.1: 2185773 . . . 2186804) | 915 | YP_001180817.1 | 1276 | *Caldicellulosiruptor saccharolyticus* DSM 8903 |
| 349833 | L23147.1: 207 . . . 1208 | 916 | AAA72041.1 | 1277 | *Methanosarcina thermophila* |
| 20092407 | complement (NC_003552.1: 4448053 . . . 4449054) | 917 | NP_618482.1 | 1278 | *Methanosarcina acetivorans* C2A |
| 73669327 | complement (NC_007355.1: 2275987 . . . 2276988) | 918 | YP_305342.1 | 1279 | *Methanosarcina barkeri* str. Fusaro |
| 163734840 | NZ_ABIG01000010.1: 132890 . . . 133867 | 919 | ZP_02142278.1 | 1280 | *Roseobacter litoralis* Och 149 |
| 110678177 | complement (NC_008209.1: 803709 . . . 804707) | 920 | YP_681184.1 | 1281 | *Roseobacter denitrificans* OCh 114 |
| 159044374 | complement (NC_009952.1: 1904769 . . . 1905794) | 921 | YP_001533168.1 | 1282 | *Dinoroseobacter shibae* DFL 12 |
| 254512869 | NZ_DS999532.1: 435221 . . . 436255 | 922 | ZP_05124935.1 | 1283 | *Rhodobacteraceae bacterium* KLH11 |
| 260432366 | complement (NZ_GG704596.1: 1443685 . . . 1444707) | 923 | ZP_05786337.1 | 1284 | *Silicibacter lacuscaerulensis* ITI-1157 |
| 150376990 | NC_009620.1: 1371590 . . . 1372624 | 924 | YP_001313586.1 | 1285 | *Sinorhizobium medicae* WSM419 |
| 16264720 | NC_003078.1: 1058537 . . . 1059529 | 925 | NP_437512.1 | 1286 | *Sinorhizobium meliloti* 1021 |
| 239833801 | complement (NZ_ACQA01000002.1: 595918 . . . 596886) | 926 | ZP_04682129.1 | 1287 | *Ochrobactrum intermedium* LMG 3301 |
| 153010822 | complement (NC_009668.1: 862920 . . . 863897) | 927 | YP_001372036.1 | 1288 | *Ochrobactrum anthropi* ATCC 49188 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 187919084 | complement (NC_010676.1: 423371 . . . 424405) | 928 | YP_001888115.1 | 1289 | *Burkholderia phytofirmans* PsJN |
| 91779405 | NC_007952.1: 2605754 . . . 2606791 | 929 | YP_554613.1 | 1290 | *Burkholderia xenovorans* LB400 |
| 186470979 | NC_010625.1: 763673 . . . 764704 | 930 | YP_001862297.1 | 1291 | *Burkholderia phymatum* STM815 |
| 73537607 | complement (NC_007348.1: 372720 . . . 373757) | 931 | YP_297974.1 | 1292 | *Ralstonia eutropha* JMP134 |
| 194292312 | NC_010530.1: 1692071 . . . 1693105 | 932 | YP_002008219.1 | 1293 | *Cupriavidus taiwanensis* |
| 161521061 | NC_010086.1: 1600765 . . . 1601856 | 933 | YP_001584488.1 | 1294 | *Burkholderia multivorans* ATCC 17616 |
| 206563034 | complement (NC_011001.1: 1288493 . . . 1289527) | 934 | YP_002233797.1 | 1295 | *Burkholderia cenocepacia* J2315 |
| 90412230 | complement (NZ_AAPH01000013.1: 616 . . . 1653) | 935 | ZP_01220235.1 | 1296 | *Photobacterium profundum* 3TCK |
| 224825256 | complement (NZ_ACIS01000005.1: 7593 . . . 8612) | 936 | ZP_03698361.1 | 1297 | *Lutiella nitroferrum* 2002 |
| 148973982 | complement (NZ_AAZW01000001.1: 115872 . . . 116945) | 937 | ZP_01811515.1 | 1298 | *Vibrionales bacterium* SWAT-3 |
| 84385317 | complement (NZ_AAMR01000001.1: 227808 . . . 228881) | 938 | ZP_00988349.1 | 1299 | *Vibrio splendidus* 12B01 |
| 149187938 | NZ_ABCH01000003.1: 163877 . . . 164926 | 939 | ZP_01866234.1 | 1300 | *Vibrio shilonii* AK1 |
| 260776268 | complement (NZ_ACZN01000015.1: 316917 . . . 317966) | 940 | ZP_05885163.1 | 1301 | *Vibrio coralliilyticus* ATCC BAA-450 |
| 45862014 | AY498613.1: 8897 . . . 9853 | 941 | AAS78789.1 | 1302 | *Paracoccus denitrificans* |
| 77404622 | NC_007488.1: 38175 . . . 39173 | 942 | YP_345196.1 | 1303 | *Rhodobacter sphaeroides* 2.4.1 |
| 23630309 | AY134843.1: 2180 . . . 3148 | 943 | AAN08490.1 | 1304 | *Castellaniella defragrans* |
| 83952615 | NZ_AALY01000004.1: 6833 . . . 7819 | 944 | ZP_00961345.1 | 1305 | *Roseovarius nubinhibens* ISM |
| 56698382 | complement (NC_003911.11: 3772593 . . . 3773606) | 945 | YP_168755.1 | 1306 | *Ruegeria pomeroyi* DSS-3 |
| 149912659 | NZ_ABCR01000001.1: 262172 . . . 263161 | 946 | ZP_01901193.1 | 1307 | *Roseobacter* sp. AzwK-3b |
| 126736835 | complement (NZ_AAYC01000001.1: 23010 . . . 24029) | 947 | ZP_01752570.1 | 1308 | *Roseobacter* sp. SK209-2-6 |
| 163732628 | complement (NZ_ABIG01000003.1: 152433 . . . 153374) | 948 | ZP_02140073.1 | 1309 | *Roseobacter litoralis* Och 149 |
| 89055338 | NC_007802.1: 2864232 . . . 2865239 | 949 | YP_510789.1 | 1310 | *Jannaschia* sp. CCS1 |
| 254459737 | NZ_DS995276.1: 713420 . . . 714472 | 950 | ZP_05073153.1 | 1311 | *Rhodobacterales bacterium* HTCC2083 |
| 116620211 | NC_008536.1: 1336713 . . . 1337708 | 951 | YP_822367.1 | 1312 | *Candidatus Solibacter* usitatus Ellin6076 |
| 95930364 | NZ_AAEW02000012.1: 74280 . . . 75281 | 952 | ZP_01313101.1 | 1313 | *Desulfuromonas acetoxidans* DSM 684 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 77920135 | NC_007498.2: 2984046 . . . 2985047 | 953 | YP_357950.1 | 1314 | *Pelobacter carbinolicus* DSM 2380 |
| 222054722 | complement (NC_011979.1: 1793784 . . . 1794785) | 954 | YP_002537084.1 | 1315 | *Geobacter* sp. FRC-32 |
| 148265418 | NC_009483.1: 3992460 . . . 3993461 | 955 | YP_001232124.1 | 1316 | *Geobacter uraniireducens* Rf4 |
| 39997800 | NC_002939.4: 2984470 . . . 2985471 | 956 | NP_953751.1 | 1317 | *Geobacter sulfurreducens* PCA |
| 78222253 | complement (NC_007517.1: 1150703 . . . 1151704) | 957 | YP_384000.1 | 1318 | *Geobacter metallireducens* GS-15 |
| 118579718 | complement (NC_008609.1: 1359173 . . . 1360177) | 958 | YP_900968.1 | 1319 | *Pelobacter propionicus* DSM 2379 |
| 189424275 | complement (NC_010814.1: 1256052 . . . 1257053) | 959 | YP_001951452.1 | 1320 | *Geobacter lovleyi* SZ |
| 255059775 | NZ_ACPJ01000030.1: 50425 . . . 51426 | 960 | ZP_05311922.1 | 1321 | *Geobacter* sp. M18 |
| 253700569 | complement (NC_012918.1: 2257017 . . . 2258018) | 961 | YP_003021758.1 | 1322 | *Geobacter* sp. M21 |
| 77920440 | complement (NC_007498.2: 3332135 . . . 3333136) | 962 | YP_358255.1 | 1323 | *Pelobacter carbinolicus* DSM 2380 |
| 227423754 | NZ_ABTN01000011.1: 41883 . . . 42872 | 963 | ZP_03906856.1 | 1324 | *Denitrovibrio acetiphilus* DSM 12809 |
| 193215894 | NC_011026.1: 2629909 . . . 2630916 | 964 | YP_001997093.1 | 1325 | *Chloroherpeton thalassium* ATCC 35110 |
| 150386298 | complement (NZ_ABDE01000122.1: 6609 . . . 7619) | 965 | ZP_01924858.1 | 1326 | *Victivallis vadensis* ATCC BAA-548 |
| 217034411 | NZ_ABSX01000018.1: 29972 . . . 31570 | 966 | ZP_03439825.1 | 1327 | *Helicobacter pylori* 98-10 |
| 254779508 | complement (NC_012973.1: 876982 . . . 878538) | 967 | YP_003057614.1 | 1328 | *Helicobacter pylori* B38 |
| 188527730 | complement (NC_010698.2: 936737 . . . 938293) | 968 | YP_001910417.1 | 1329 | *Helicobacter pylori* Shi470 |
| 15611908 | complement (NC_000921.1: 920263 . . . 921822) | 969 | NP_223559.1 | 1330 | *Helicobacter pylori* J99 |
| 109947805 | complement (NC_008229.1: 1105678 . . . 1107201) | 970 | YP_665033.1 | 1331 | *Helicobacter acinonychis* str. Sheeba |
| 148926656 | NZ_AASY01000008.1: 52243 . . . 53778 | 971 | ZP_01810337.1 | 1332 | *Campylobacter jejuni* subsp. *jejuni* CG8486 |
| 57167700 | complement (NZ_AAFL01000001.1: 232544 . . . 234046) | 972 | ZP_00366840.1 | 1333 | *Campylobacter coli* RM2228 |
| 57242590 | complement (NZ_AAFJ01000004.1: 6136 . . . 7638) | 973 | ZP_00370527.1 | 1334 | *Campylobacter upsaliensis* RM3195 |
| 222823645 | NC_012039.1: 612447 . . . 613916 | 974 | YP_002575219.1 | 1335 | *Campylobacter lari* RM2100 |
| 154148075 | complement (NC_009714.1: 1098161 . . . 1099597) | 975 | YP_001406718.1 | 1336 | *Campylobacter hominis* ATCC BAA-381 |
| 257459711 | NZ_ACYG01000019.1: 245785 . . . 247383 | 976 | ZP_05624820.1 | 1337 | *Campylobacter gracilis* RM3268 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 118475502 | complement (NC_008599.1: 824533 . . . 825927) | 977 | YP_891988.1 | 1338 | *Campylobacter fetus* subsp. *fetus* 82-40 |
| 157164211 | NC_009802.1: 1056736 . . . 1058103 | 978 | YP_001466901.1 | 1339 | *Campylobacter concisus* 13826 |
| 154173700 | complement (NC_009715.1: 947742 . . . 949112) | 979 | YP_001408221.1 | 1340 | *Campylobacter curvus* 525.92 |
| 255322202 | NZ_ACVQ01000017.1: 43696 . . . 45081 | 980 | ZP_05363348.1 | 1341 | *Campylobacter showae* RM3277 |
| 225351910 | NZ_ABXX02000003.1: 117844 . . . 119514 | 981 | ZP_03742933.1 | 1342 | *Bifidobacterium pseudocatenulatum* DSM 20438 |
| 171743080 | complement (NZ_ABIX02000002.1: 2348529 . . . 2350229) | 982 | ZP_02918887.1 | 1343 | *Bifidobacterium dentium* ATCC 27678 |
| 154487476 | complement (NZ_AAXD02000028.1: 209751 . . . 211442) | 983 | ZP_02028883.1 | 1344 | *Bifidobacterium adolescentis* L2-32 |
| 229817818 | complement (NZ_ABYS02000004.1: 899528 . . . 901234) | 984 | ZP_04448100.1 | 1345 | *Bifidobacterium angulatum* DSM 20098 |
| 223467350 | complement (NZ_ACCG01000014.1: 93417 . . . 95159) | 985 | ZP_03618886.1 | 1346 | *Bifidobacterium breve* DSM 20213 |
| 227546035 | NZ_ACHI01000009.1: 13043 . . . 14755 | 986 | ZP_03976084.1 | 1347 | *Bifidobacterium longum* subsp. *infantis* ATCC 55813 |
| 213692597 | NC_011593.1: 1898224 . . . 1899936 | 987 | YP_002323183.1 | 1348 | *Bifidobacterium longum* subsp. *infantis* ATCC 15697 |
| 224282865 | complement (NZ_ABQP01000009.1: 208984 . . . 210654) | 988 | ZP_03646187.1 | 1349 | *Bifidobacterium bifidum* NCIMB 41171 |
| 227507562 | NZ_ACGF01000124.1: 44384 . . . 46048 | 989 | ZP_03937611.1 | 1350 | *Gardnerella vaginalis* ATCC 14019 |
| 183601499 | complement (NZ_ABOT01000001.1: 192971 . . . 194653) | 990 | ZP_02962869.1 | 1351 | *Bifidobacterium animalis* subsp. *lactis* HN019 |
| 261337301 | complement (NZ_ABXB03000001.1: 137782 . . . 139455) | 991 | ZP_05965185.1 | 1352 | *Bifidobacterium gallicum* DSM 20093 |
| 154507766 | NZ_AAYI02000004.1: 231567 . . . 233045 | 992 | ZP_02043408.1 | 1353 | *Actinomyces odontolyticus* ATCC 17982 |
| 227494860 | complement (NZ_ACFG01000030.1: 86700 . . . 88295) | 993 | ZP_03925176.1 | 1354 | *Actinomyces coleocanis* DSM 15436 |
| 19553946 | complement (NC_003450.3: 2936506 . . . 2937891) | 994 | NP_601948.1 | 1355 | *Corynebacterium glutamicum* ATCC 13032 |
| 25029147 | complement (NC_004369.1: 2758982 . . . 2760496) | 995 | NP_739201.1 | 1356 | *Corynebacterium efficiens* YS-314 |
| 38234612 | complement (NC_002935.2: 2103677 . . . 2105128) | 996 | NP_940379.1 | 1357 | *Corynebacterium diphtheriae* NCTC 13129 |
| 252124104 | complement (NZ_ACSH01000003.1: 61905 . . . 63305) | 997 | ZP_04835255.1 | 1358 | *Corynebacterium matruchotii* ATCC 14266 |
| 227489285 | NZ_ABYP01000094.1: 61648 . . . 63048 | 998 | ZP_03919601.1 | 1359 | *Corynebacterium glucuronolyticum* ATCC 51867 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 258561950 | NZ_ACLJ01000070.1: 13162 . . . 14523 | 999 | ZP_05708623.1 | 1360 | *Corynebacterium genitalium* ATCC 33030 |
| 227547861 | NZ_ACHJ01000017.1: 9541 . . . 10899 | 1000 | ZP_03977910.1 | 1361 | *Corynebacterium lipophiloflavum* DSM 44291 |
| 227502015 | NZ_ACGD01000004.1: 82938 . . . 84305 | 1001 | ZP_03932064.1 | 1362 | *Corynebacterium accolens* ATCC 49725 |
| 255325798 | NZ_ACVP01000037.1: 5746 . . . 7107 | 1002 | ZP_05366890.1 | 1363 | *Corynebacterium tuberculostearicum* SK141 |
| 227505901 | NZ_ACGE01000122.1: 37468 . . . 38826 | 1003 | ZP_03935950.1 | 1364 | *Corynebacterium striatum* ATCC 6940 |
| 227834110 | complement (NC_012590.1: 2492850 . . . 2494214) | 1004 | YP_002835817.1 | 1365 | *Corynebacterium aurimucosum* ATCC 700975 |
| 68535315 | NC_007164.1: 307337 . . . 308848 | 1005 | YP_250020.1 | 1366 | *Corynebacterium jeikeium* K411 |
| 172041418 | complement (NC_010545.1: 2018026 . . . 2019369) | 1006 | YP_001801132.1 | 1367 | *Corynebacterium urealyticum* DSM 7109 |
| 237786249 | complement (NC_012704.1: 1975731 . . . 1977287) | 1007 | YP_002906954.1 | 1368 | *Corynebacterium kroppenstedtii* DSM 44385 |
| 213965099 | complement (NZ_ABZU01000003.1: 128017 . . . 129543) | 1008 | ZP_03393297.1 | 1369 | *Corynebacterium amycolatum* SK46 |
| 225075788 | complement (NZ_ACEN01000020.1: 5387 . . . 6889) | 1009 | ZP_03718987.1 | 1370 | *Neisseria flavescens* NRL30031/H210 |
| 255067101 | NZ_ACKO02000012.1: 64851 . . . 66353 | 1010 | ZP_05318956.1 | 1371 | *Neisseria sicca* ATCC 29256 |
| 161869564 | complement (NC_010120.1: 603202 . . . 604836) | 1011 | YP_001598731.1 | 1372 | *Neisseria meningitidis* 053442 |
| 238022551 | NZ_ACJW02000003.1: 751672 . . . 753150 | 1012 | ZP_04602977.1 | 1373 | *Kingella oralis* ATCC 51147 |
| 83592714 | complement (NC_007643.1: 1625036 . . . 1626802) | 1013 | YP_426466.1 | 1374 | *Rhodospirillum rubrum* ATCC 11170 |
| 32490929 | complement (NC_004344.2: 212680 . . . 214818) | 1014 | NP_871183.1 | 1375 | *Wigglesworthia glossinidia* endosymbiont of *Glossina brevipalpis* |
| 27904667 | NC_004545.1: 186377 . . . 188524 | 1015 | NP_777793.1 | 1376 | *Buchnera aphidicola* str. Bp (*Baizongia pistaciae*) |
| 261415723 | complement (NC_013410.1: 1639393 . . . 1640796) | 1016 | YP_003249406.1 | 1377 | *Fibrobacter succinogenes* subsp. *succinogenes* S85 |
| 219556226 | NZ_ABQH01000061.1: <3 . . . 1196 | 1017 | ZP_03535302.1 | 1378 | *Mycobacterium tuberculosis* T17 |
| 228471665 | complement (NZ_ACLQ01000003.1: 154599 . . . 155657) | 1018 | ZP_04056438.1 | 1379 | *Capnocytophaga gingivalis* ATCC 33624 |
| 256370675 | NC_013123.1: 116952 . . . 117950 | 1019 | YP_003108500.1 | 1380 | *Candidatus Sulcia muelleri* SMDSEM |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 6685772 | X89084.1: 1009 . . . 199 | 1020 | P77844 | 1381 | *Corynebacterium glutamicum* |
| 227876041 | NZ_ACKW01000045.1: 33898 . . . 34887 | 1021 | ZP_03994160.1 | 1382 | *Mobiluncus mulieris* ATCC 35243 |
| 227492324 | NZ_ACCQ01000004.1: 214416 . . . 215417 | 1022 | ZP_03922640.1 | 1383 | *Mobiluncus curtisii* ATCC 43063 |
| 225027017 | NZ_ACEP01000064.1: 10650 . . . 11609 | 1023 | ZP_03716209.1 | 1384 | *Eubacterium hallii* DSM 3353 |
| 225028951 | complement (NZ_ACEP01000172.1: 22364 . . . 23416) | 1024 | ZP_03718143.1 | 1385 | *Eubacterium hallii* DSM 3353 |
| 257438679 | complement (NZ_ACOP02000029.1: 99 . . . 1124) | 1025 | ZP_05614434.1 | 1386 | *Faecalibacterium prausnitzii* A2-165 |
| 154496156 | complement (NZ_AAXG02000004.1: 103391 . . . 104380) | 1026 | ZP_02034852.1 | 1387 | *Bacteroides capillosus* ATCC 29799 |
| 225376322 | NZ_ACFY01000086.1: 6940 . . . 7992 | 1027 | ZP_03753543.1 | 1388 | *Roseburia inulinivorans* DSM 16841 |
| 257414121 | complement (NZ_ABYJ02000202.1: 41125 . . . 42165) | 1028 | ZP_04745275.2 | 1389 | *Roseburia intestinalis* L1-82 |
| 238923816 | NC_012781.1: 1324280 . . . 1325263 | 1029 | YP_002937332.1 | 1390 | *Eubacterium rectale* ATCC 33656 |
| 160893459 | NZ_AAYW02000007.1: 63870 . . . 64919 | 1030 | ZP_02074244.1 | 1391 | *Clostridium* sp. L2-50 |
| 229829305 | complement (NZ_ACIP02000002.1: 495313 . . . 496299) | 1031 | ZP_04455374.1 | 1392 | *Shuttleworthia satelles* DSM 14600 |
| 218282181 | complement (NZ_ABYT01000061.1: 45 . . . 1016) | 1032 | ZP_03488480.1 | 1393 | *Eubacterium biforme* DSM 3989 |
| 160916120 | complement (NZ_ABAW02000025.1: 71684 . . . 72694) | 1033 | ZP_02078327.1 | 1394 | *Eubacterium dolichum* DSM 3991 |
| 160915347 | NZ_ABAW02000020.1: 14646 . . . 15638 | 1034 | ZP_02077559.1 | 1395 | *Eubacterium dolichum* DSM 3991 |
| 212697404 | NZ_ABXA01000047.1: 41715 . . . 42701 | 1035 | ZP_03305532.1 | 1396 | *Anaerococcus hydrogenalis* DSM 7454 |
| 256545936 | complement (NZ_ACXU01000022.1: 22101 . . . 23087) | 1036 | ZP_05473291.1 | 1397 | *Anaerococcus vaginalis* ATCC 51170 |
| 227501001 | NZ_ACGC01000115.1: 23122 . . . 24108 | 1037 | ZP_03931050.1 | 1398 | *Anaerococcus tetradius* ATCC 35098 |
| 257067207 | complement (NC_013171.1: 1868769 . . . 1869752) | 1038 | YP_003153463.1 | 1399 | *Anaerococcus prevotii* DSM 20548 |
| 227485732 | complement (NZ_ABYO01000196.1: 43814 . . . 44833) | 1039 | ZP_03916048.1 | 1400 | *Anaerococcus lactolyticus* ATCC 51172 |
| 19746077 | NC_003485.1: 903788 . . . 904783 | 1040 | NP_607213.1 | 1401 | *Streptococcus pyogenes* MGAS8232 |
| 13622266 | AE004092.1: 923921 . . . 924916 | 1041 | AAK34003.1 | 1402 | *Streptococcus pyogenes* M1 GAS |
| 222153008 | NC_012004.1: 834034 . . . 835026 | 1042 | YP_002562185.1 | 1403 | *Streptococcus uberis* 0140J |
| 225868503 | NC_012470.1: 1034662 . . . 1035663 | 1043 | YP_002744451.1 | 1404 | *Streptococcus equi* subsp. *Zooepidemicus* |
| 254997415 | AP010655.1: 1031526 . . . 1032521 | 1044 | BAH88016.1 | 1405 | *Streptococcus mutans* NN2025 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 171779341 | NZ_ABJK02000020.1: 38474 . . . 39472 | 1045 | ZP_02920305.1 | 1406 | *Streptococcus infantarius* subsp. *infantarius* ATCC BAA-102 |
| 76787123 | complement (NC_007432.1: 1155758 . . . 1156750) | 1046 | YP_329798.1 | 1407 | *Streptococcus agalactiae* A909 |
| 228477151 | complement (NZ_ACLO01000062.1: 54543 . . . 55526) | 1047 | ZP_04061789.1 | 1408 | *Streptococcus salivarius* SK126 |
| 55821439 | complement (NC_006448.1: 1286014 . . . 1286997) | 1048 | YP_139881.1 | 1409 | *Streptococcus thermophilus* LMG 18311 |
| 237650772 | NZ_ABZC01000093.1: 10653 . . . 11627 | 1049 | ZP_04525024.1 | 1410 | *Streptococcus pneumoniae* CCRI 1974 |
| 262282806 | complement (NZ_GG704941.1: 11119 . . . 12096) | 1050 | ZP_06060573.1 | 1411 | *Streptococcus* sp. 2_1_36FAA |
| 146318711 | complement (NC_009442.1: 1032399 . . . 1033379) | 1051 | YP_001198423.1 | 1412 | *Streptococcus suis* 05ZYH33 |
| 42518809 | NC_005362.1: 788505 . . . 789482 | 1052 | NP_964739.1 | 1413 | *Lactobacillus johnsonii* NCC 533 |
| 58337025 | NC_006814.3: 698578 . . . 699567 | 1053 | YP_193610.1 | 1414 | *Lactobacillus acidophilus* NCFM |
| 227893214 | NZ_ACGU01000037.1: 27358 . . . 28347 | 1054 | ZP_04011019.1 | 1415 | *Lactobacillus ultunensis* DSM 16047 |
| 227877224 | NZ_ACKR01000025.1: 14947 . . . 15936 | 1055 | ZP_03995297.1 | 1416 | *Lactobacillus crispatus* JV-V01 |
| 260102516 | NZ_ACLM01000112.1: 6924 . . . 7913 | 1056 | ZP_05752753.1 | 1417 | *Lactobacillus helveticus* DSM 20075 |
| 227525975 | NZ_ACGQ01000041.1: 59881 . . . 60858 | 1057 | ZP_03956024.1 | 1418 | *Lactobacillus jensenii* JV-V16 |
| 238854857 | complement (NZ_ACOY01000013.1: 251390 . . . 252367) | 1058 | ZP_04645187.1 | 1419 | *Lactobacillus jensenii* 269-3 |
| 104773739 | NC_008054.1: 547017 . . . 548006 | 1059 | YP_618719.1 | 1420 | *Lactobacillus delbrueckii* subsp. *bulgaricus* ATCC 11842 |
| 259501464 | NZ_ACLN01000013.1: 15438 . . . 16418 | 1060 | ZP_05744366.1 | 1421 | *Lactobacillus iners* DSM 13335 |
| 16080818 | complement (NC_000964.3: 3865355 . . . 3866326) | 1061 | NP_391646.1 | 1422 | *Bacillus subtilis* subsp. *subtilis* str. 168 |
| 154687884 | complement (NC_009725.1: 3590964 . . . 3591935) | 1062 | YP_001423045.1 | 1423 | *Bacillus amyloliquefaciens* FZB42 |
| 52082282 | complement (NC_006270.3: 3821313 . . . 3822284) | 1063 | YP_081073.1 | 1424 | *Bacillus licheniformis* ATCC 14580 |
| 194016487 | complement (NZ_ABRX01000004.1: 144981 . . . 145952) | 1064 | ZP_03055101.1 | 1425 | *Bacillus pumilus* ATCC 7061 |
| 212640578 | complement (NC_011567.1: 2748264 . . . 2749247) | 1065 | YP_002317098.1 | 1426 | *Anoxybacillus flavithermus* WK1 |
| 239828646 | complement (NC_012793.1: 3393094 . . . 3394068) | 1066 | YP_002951270.1 | 1427 | *Geobacillus* sp. WCH70 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 138896990 | complement (NC_009328.1: 3468960 . . . 3469934) | 1067 | YP_001127443.1 | 1428 | *Geobacillus thermodenitrificans* NG80-2 |
| 56421950 | complement (NC_006510.1: 3456185 . . . 3457165) | 1068 | YP_149268.1 | 1429 | *Geobacillus kaustophilus* HTA426 |
| 149182788 | NZ_ABCF01000043.1: 11583 . . . 12554 | 1069 | ZP_01861251.1 | 1430 | *Bacillus* sp. SG-1 |
| 205375387 | NZ_ABFU01000065.2: 12128 . . . 13099 | 1070 | ZP_03228176.1 | 1431 | *Bacillus coahuilensis* m4-4 |
| 89101108 | complement (NZ_AAOX01000058.1: 10738 . . . 11715) | 1071 | ZP_01173945.1 | 1432 | *Bacillus* sp. NRRL B-14911 |
| 23100477 | complement (NC_004193.1: 3134492 . . . 3135466) | 1072 | NP_693944.1 | 1433 | *Oceanobacillus iheyensis* HTE831 |
| 229187615 | complement (NZ_ACLU01000117.1: 31676 . . . 32647) | 1073 | ZP_04314753.1 | 1434 | *Bacillus cereus* BGSC6E1 |
| 46908338 | complement (NC_002973.6: 2171357 . . . 2172334) | 1074 | YP_014727.1 | 1435 | *Listeria monocytogenes* str. 4b F2365 |
| 229555968 | NZ_ACCR01000020.1: 18426 . . . 19403 | 1075 | ZP_04443757.1 | 1436 | *Listeria grayi* DSM 20601 |
| 15616385 | complement (NC_002570.2: 3947889 . . . 3948881) | 1076 | NP_244690.1 | 1437 | *Bacillus halodurans* C-125 |
| 56965668 | complement (NC_006582.1: 4069370 . . . 4070365) | 1077 | YP_177402.1 | 1438 | *Bacillus clausii* KSM-K16 |
| 229917170 | complement (NC_012673.1: 1410227 . . . 1411216) | 1078 | YP_002885816.1 | 1439 | *Exiguobacterium* sp. AT1b |
| 172056261 | NC_010556.1: 233988 . . . 234974 | 1079 | YP_001812721.1 | 1440 | *Exiguobacterium sibiricum* 255-15 |
| 163762281 | NZ_ABHZ01000002.1: 94480 . . . 95457 | 1080 | ZP_02169346.1 | 1441 | *Bacillus selenitireducens* MLS10 |
| 242372812 | NZ_ACJB01000048.1: 8122 . . . 9111 | 1081 | ZP_04818386.1 | 1442 | *Staphylococcus epidermidis* M23864: W1 |
| 223042925 | complement (NZ_ACFR01000002.1: 330954 . . . 331943) | 1082 | ZP_03612973.1 | 1443 | *Staphylococcus capitis* SK14 |
| 239636796 | complement (NZ_ACPZ01000027.1: 569915 . . . 570904) | 1083 | ZP_04677798.1 | 1444 | *Staphylococcus warneri* L37603 |
| 27467277 | NC_004461.1: 356818 . . . 357807 | 1084 | NP_763914.1 | 1445 | *Staphylococcus epidermidis* ATCC 12228 |
| 258422775 | NZ_ACKI01000006.1: 980 . . . 1966 | 1085 | ZP_05685678.1 | 1446 | *Staphylococcus aureus* A9635 |
| 70727403 | complement (NC_007168.1: 2403280 . . . 2404269) | 1086 | YP_254319.1 | 1447 | *Staphylococcus haemolyticus* JCSC1435 |
| 228475091 | NZ_ACLP01000011.1: 16037 . . . 17026 | 1087 | ZP_04059818.1 | 1448 | *Staphylococcus hominis* SK119 |
| 150011041 | EF456699.1: 1 . . . 987 | 1088 | ABR57177.1 | 1449 | *Staphylococcus xylosus* |
| 73663433 | complement (NC_007350.1: 2190871 . . . 2191857) | 1089 | YP_302214.1 | 1450 | *Staphylococcus saprophyticus* subsp. *saprophyticus* ATCC 15305 |

TABLE 12a-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 224475734 | NC_012121.1: 250258 . . . 251247 | 1090 | YP_002633340.1 | 1451 | *Staphylococcus carnosus* subsp. *carnosus* TM300 |
| 222152076 | complement (NC_011999.1: 1968130 . . . 1969119) | 1091 | YP_002561236.1 | 1452 | *Macrococcus caseolyticus* JCSC5402 |
| 227514417 | NZ_ACGI01000058.1: 71225 . . . 72199 | 1092 | ZP_03944466.1 | 1453 | *Lactobacillus fermentum* ATCC 14931 |
| 256848058 | complement (NZ_GG698804.1: 125094 . . . 126059) | 1093 | ZP_05553502.1 | 1454 | *Lactobacillus coleohominis* 101-4-CHN |
| 227529580 | NZ_ACGV01000117.1: 1634 . . . 2608 | 1094 | ZP_03959629.1 | 1455 | *Lactobacillus vaginalis* ATCC 49540 |
| 148543634 | NC_009513.1: 451991 . . . 452965 | 1095 | YP_001271004.1 | 1456 | *Lactobacillus reuteri* DSM 20016 |
| 259502766 | NZ_ACLL01000024.1: 18101 . . . 19072 | 1096 | ZP_05745668.1 | 1457 | *Lactobacillus antri* DSM 16041 |
| 116618560 | complement (NC_008531.1: 1461235 . . . 1462215) | 1097 | YP_818931.1 | 1458 | *Leuconostoc mesenteroides* subsp. *mesenteroides* ATCC 8293 |
| 170016912 | NC_010471.1: 577967 . . . 578959 | 1098 | YP_001727831.1 | 1459 | *Leuconostoc citreum* KM20 |
| 241894748 | complement (NZ_ACKU01000002.1: 15496 . . . 16476) | 1099 | ZP_04782044.1 | 1460 | *Weissella paramesenteroides* ATCC 33313 |
| 118587037 | NZ_AAUV01000054.1: 44038 . . . 45132 | 1100 | ZP_01544468.1 | 1461 | *Oenococcus oeni* ATCC BAA-1163 |
| 259046893 | complement (NZ_ACKZ01000012.1: 86436 . . . 87425) | 1101 | ZP_05737294.1 | 1462 | *Granulicatella adiacens* ATCC 49175 |
| 260584167 | complement (NZ_GG703805.1: 786281 . . . 787264) | 1102 | ZP_05851915.1 | 1463 | *Granulicatella elegans* ATCC 700633 |
| 163789527 | complement (NZ_ABHH01000002.1: 8081 . . . 9061) | 1103 | ZP_02183965.1 | 1464 | *Carnobacterium* sp. AT7 |
| 257870102 | NZ_GG670288.1: 145742 . . . 146725 | 1104 | ZP_05649755.1 | 1465 | *Enterococcus gallinarum* EG2 |
| 227517869 | NZ_ACGL01000051.1: 2376 . . . 3401 | 1105 | ZP_03947918.1 | 1466 | *Enterococcus faecalis* TX0104 |
| 227552175 | complement (NZ_ACHL01000118.1: 1216 . . . 2232) | 1106 | ZP_03982224.1 | 1467 | *Enterococcus faecium* TX1330 |
| 81428954 | complement (NC_007576.1: 1313600 . . . 1314586) | 1107 | YP_395954.1 | 1468 | *Lactobacillus sakei* subsp. *sakei* 23K |
| 229823693 | NZ_ACIL02000007.1: 6499 . . . 7482 | 1108 | ZP_04449762.1 | 1469 | *Catonella morbi* ATCC 51271 |
| 125623617 | NC_009004.1: 752099 . . . 753079 | 1109 | YP_001032100.1 | 1470 | *Lactococcus lactis* subsp. *cremoris* MG1363 |
| 116494500 | NC_008526.1: 981403 . . . 982380 | 1110 | YP_806234.1 | 1471 | *Lactobacillus casei* ATCC 334 |

TABLE 12a-continued

| SEQ ID NOs of phosphotransacetylase target gene coding regions and proteins | | | | | |
|---|---|---|---|---|---|
| GI Number | GENBANK Nucleotide Sequence Accession Information | Nucleic Acid SEQ ID NO: | GENBANK Amino Acid Sequence Accession No. | Amino Acid SEQ ID NO: | Source Organism |
| 28377658 | NC_004567.1: 748192 . . . 749169 | 1111 | NP_784550.1 | 1472 | *Lactobacillus plantarum* WCFS1 |
| 116333321 | NC_008497.1: 702374 . . . 703348 | 1112 | YP_794848.1 | 1473 | *Lactobacillus brevis* ATCC 367 |
| 227524782 | complement (NZ_ACGP01000192.1: 2135 . . . 3112) | 1113 | ZP_03954831.1 | 1474 | *Lactobacillus hilgardii* ATCC 8290 |
| 11862872 | AB035800.1: 1006 . . . 1992 | 1114 | BAB19267.1 | 1475 | *Lactobacillus sanfranciscensis* |
| 227528239 | NZ_ACGS01000093.1: 64718 . . . 65695 | 1115 | ZP_03958288.1 | 1476 | *Lactobacillus ruminis* ATCC 25644 |
| 90962126 | complement (NC_007929.1: 1183945 . . . 1184922) | 1116 | YP_536042.1 | 1477 | *Lactobacillus salivarius* UCC118 |
| 259504733 | NZ_ACLK01000016.1: 55937 . . . 56917 | 1117 | ZP_05747635.1 | 1478 | *Erysipelothrix rhusiopathiae* ATCC 19414 |
| 116492140 | NC_008525.1: 385259 . . . 386230 | 1118 | YP_803875.1 | 1479 | *Pediococcus pentosaceus* ATCC 25745 |
| 160946581 | NZ_ABEE02000016.1: 72101 . . . 73072 | 1119 | ZP_02093784.1 | 1480 | *Parvimonas micra* ATCC 33270 |
| 169825312 | complement (NC_010376.1: 1782855 . . . 1783826) | 1120 | YP_001692923.1 | 1481 | *Finegoldia magna* ATCC 29328 |
| 229542439 | NZ_AAWV02000001.1: 1452854 . . . 1453825 | 1121 | ZP_04431499.1 | 1482 | *Bacillus coagulans* 36D1 |
| 241888505 | NZ_ACDZ02000004.1: 11622 . . . 12602 | 1122 | ZP_04775813.1 | 1483 | *Gemella haemolysans* ATCC 10379 |

In addition, 201 phosphate acetyltransferase sequences that are characterized by two domains (DRTGG and PTA_PTB) are provided in Table 12b. MSA and phylogenetic analysis were performed as described above. Percent identity with respect to experimentally verified (or human curated) sequences is equal to or larger than 40, except for 4 sequences derived from plant organisms. Furthermore, hmmer search of the 201 sequences against the profile HMM of subfamily 2 (Table 14), clearly indicates that all Group 2 sequences belong to the PTA subfamily (least significant Evalue is 4.1e-93).

TABLE 12b

| SEQ ID NOs of phosphotransacetylase target gene coding regions and proteins | | | | | |
|---|---|---|---|---|---|
| GI Number | GENBANK Nucleotide Sequence Accession Information | Nucleic Acid SEQ ID NO: | GENBANK Amino Acid Sequence Accession No. | Amino Acid SEQ ID NO: | Source Organism |
| 152964825 | complement(NC_009664.2: 1430885 . . . 1432984) | 1484 | YP_001360609.1 | 1685 | *Kineococcus radiotolerans* SRS30216 |
| 88800302 | complement(NZ_AAOE01000024.1: 59450 . . . 61609) | 1485 | ZP_01115869.1 | 1686 | *Reinekea blandensis* MED297 |
| 254786809 | complement(NC_012997.1: 3139764 . . . 3141917) | 1486 | YP_003074238.1 | 1687 | *Teredinibacter turnerae* T7901 |
| 120554060 | complement(NC_008740.1: 1283732 . . . 1285885) | 1487 | YP_958411.1 | 1688 | *Marinobacter aquaeolei* VT8 |
| 83647145 | NC_007645.1: 4579211 . . . 4581358 | 1488 | YP_435580.1 | 1689 | *Hahella chejuensis* KCTC 2396 |
| 146308660 | NC_009439.1: 4021959 . . . 4024052 | 1489 | YP_001189125.1 | 1690 | *Pseudomonas mendocina* ymp |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 116048757 | NC_008463.1: 4740071 . . . 4742185 | 1490 | YP_792443.1 | 1691 | *Pseudomonas aeruginosa* UCBPP-PA14 |
| 28868382 | complement(NC_004578.1: 1283902 . . . 1285992) | 1491 | NP_791001.1 | 1692 | *Pseudomonas syringae* pv. tomato str. DC3000 |
| 70728320 | complement(NC_004129.6: 1081214 . . . 1083313) | 1492 | YP_258069.1 | 1693 | *Pseudomonas fluorescens* Pf-5 |
| 104780139 | complement(NC_008027.1: 952666 . . . 954756) | 1493 | YP_606637.1 | 1694 | *Pseudomonas entomophila* L48 |
| 226945506 | complement(NC_012560.1: 3530138 . . . 3532276) | 1494 | YP_002800579.1 | 1695 | *Azotobacter vinelandii* DJ |
| 146281510 | complement(NC_009434.1: 1238536 . . . 1240632) | 1495 | YP_001171663.1 | 1696 | *Pseudomonas stutzeri* A1501 |
| 30248315 | complement(NC_004757.1: 326321 . . . 328408) | 1496 | NP_840385.1 | 1697 | *Nitrosomonas europaea* ATCC 19718 |
| 226946148 | NC_012560.1: 4145609 . . . 4147684 | 1497 | YP_002801221.1 | 1698 | *Azotobacter vinelandii* DJ |
| 226357371 | NC_012526.1: 2779899 . . . 2782016 | 1498 | YP_002787111.1 | 1699 | *Deinococcus deserti* VCD115 |
| 94984159 | complement(NC_008025.1: 46701 . . . 48812) | 1499 | YP_603523.1 | 1700 | *Deinococcus geothermalis* DSM 11300 |
| 15805114 | complement(NC_001263.1: 69707 . . . 71875) | 1500 | NP_293799.1 | 1701 | *Deinococcus radiodurans* R1 |
| 89899079 | complement(NC_007908.1: 264127 . . . 266178) | 1501 | YP_521550.1 | 1702 | *Rhodoferax ferrireducens* T118 |
| 90422592 | NC_007925.1: 1181422 . . . 1183572 | 1502 | YP_530962.1 | 1703 | *Rhodopseudomonas palustris* BisB18 |
| 90423512 | NC_007925.1: 2183340 . . . 2185475 | 1503 | YP_531882.1 | 1704 | *Rhodopseudomonas palustris* BisB18 |
| 115525859 | NC_008435.1: 4320999 . . . 4323140 | 1504 | YP_782770.1 | 1705 | *Rhodopseudomonas palustris* BisA53 |
| 167574473 | complement(NZ_ABBG01000507.1: 7891 . . . 9969) | 1505 | ZP_02367347.1 | 1706 | *Burkholderia oklahomensis* C6786 |
| 83594327 | complement(NC_007643.1: 3449832 . . . 3451943) | 1506 | YP_428079.1 | 1707 | *Rhodospirillum rubrum* ATCC 11170 |
| 90422165 | NC_007925.1: 696325 . . . 698388 | 1507 | YP_530535.1 | 1708 | *Rhodopseudomonas palustris* BisB18 |
| 34496985 | complement(NC_005085.1: 1636285 . . . 1638366) | 1508 | NP_901200.1 | 1709 | *Chromobacterium violaceum* ATCC 12472 |
| 224825239 | complement(NZ_ACIS01000004.1: 398128 . . . 400215) | 1509 | ZP_03698345.1 | 1710 | *Lutiella nitroferrum* 2002 |
| 148652157 | complement(NC_009524.1: 415573 . . . 417720) | 1510 | YP_001279250.1 | 1711 | *Psychrobacter* sp. PRwf-1 |
| 93005047 | complement(NC_007969.1: 257926 . . . 260082) | 1511 | YP_579484.1 | 1712 | *Psychrobacter cryohalolentis* K5 |
| 257453691 | NZ_ACYI01000010.1: 16653 . . . 18797 | 1512 | ZP_05618978.1 | 1713 | *Enhydrobacter aerosaccus* SK60 |
| 255321153 | NZ_ACVR01000080.1: 44385 . . . 46529 | 1513 | ZP_05362319.1 | 1714 | *Acinetobacter radioresistens* SK82 |
| 50083778 | complement(NC_005966.1: 527524 . . . 529686) | 1514 | YP_045288.1 | 1715 | *Acinetobacter* sp. ADP1 |
| 260549093 | NZ_GG704496.1: 86045 . . . 88189 | 1515 | ZP_05823314.1 | 1716 | *Acinetobacter* sp. RUH2624 |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 226953952 | complement(NZ_ABYN01000201.1: 23157 . . . 25289) | 1516 | ZP_03824416.1 | 1717 | *Acinetobacter* sp. ATCC 27244 |
| 153005955 | NC_009675.1: 3624676 . . . 3626811 | 1517 | YP_001380280.1 | 1718 | *Anaeromyxobacter* sp. Fw109-5 |
| 86159318 | complement(NC_007760.1: 3267950 . . . 3270094) | 1518 | YP_466103.1 | 1719 | *Anaeromyxobacter dehalogenans* 2CP-C |
| 52425053 | complement(NC_006300.1: 977458 . . . 979596) | 1519 | YP_088190.1 | 1720 | *Mannheimia succiniciproducens* MBEL55E |
| 152979320 | NC_009655.1: 1823344 . . . 1825485 | 1520 | YP_001344949.1 | 1721 | *Actinobacillus succinogenes* 130Z |
| 251792685 | NC_012913.1: 968721 . . . 970856 | 1521 | YP_003007411.1 | 1722 | *Aggregatibacter aphrophilus* NJ8700 |
| 145633066 | NZ_AAZF01000004.1: 73469 . . . 75604 | 1522 | ZP_01788798.1 | 1723 | *Haemophilus influenzae* 3655 |
| 113460945 | complement(NC_008309.1: 873911 . . . 876049) | 1523 | YP_719012.1 | 1724 | *Haemophilus somnus* 129PT |
| 15602570 | NC_002663.1: 821181 . . . 823319 | 1524 | NP_245642.1 | 1725 | *Pasteurella multocida* subsp. *multocida* str. Pm70 |
| 260913970 | complement(NZ_ACZR01000013.1: 172766 . . . 174904) | 1525 | ZP_05920444.1 | 1726 | *Pasteurella dagmatis* ATCC 43325 |
| 53729159 | complement(NZ_AACK01000004.1: 12180 . . . 14318) | 1526 | ZP_00133992.2 | 1727 | *Actinobacillus pleuropneumoniae* serovar 1 str. 4074 |
| 240949203 | NZ_ACQL01000097.1: 15931 . . . 18069 | 1527 | ZP_04753547.1 | 1728 | *Actinobacillus minor* NM305 |
| 33152520 | NC_002940.2: 1192390 . . . 1194528 | 1528 | NP_873873.1 | 1729 | *Haemophilus ducreyi* 35000HP |
| 254362832 | NZ_DS264681.1: 4949 . . . 7084 | 1529 | ZP_04978908.1 | 1730 | *Mannheimia haemolytica* PHL213 |
| 219870647 | NC_011852.1: 435431 . . . 437566 | 1530 | YP_002475022.1 | 1731 | *Haemophilus parasuis* SH0165 |
| 258637834 | NZ_ACYJ01000022.1: 41620 . . . 43764 | 1531 | ZP_05730581.1 | 1732 | *Pantoea* sp. At-9b |
| 188533336 | complement(NC_010694.1: 1324250 . . . 1326379) | 1532 | YP_001907133.1 | 1733 | *Erwinia tasmaniensis* Et1/99 |
| 85059585 | NC_007712.1: 2759501 . . . 2761645 | 1533 | YP_455287.1 | 1734 | *Sodalis glossinidius* str. '*morsitans*' |
| 258631105 | complement(NZ_ACYK01000004.1: 104546 . . . 106687) | 1534 | ZP_05723922.1 | 1735 | *Dickeya dadantii* Ech586 |
| 261820783 | complement(NC_013421.1: 1606509 . . . 1608647) | 1535 | YP_003258889.1 | 1736 | *Pectobacterium wasabiae* WPP163 |
| 242239978 | NC_012880.1: 3004583 . . . 3006724 | 1536 | YP_002988159.1 | 1737 | *Dickeya dadantii* Ech703 |
| 22125515 | complement(NC_004088.1: 1788905 . . . 1791058) | 1537 | NP_668938.1 | 1738 | *Yersinia pestis* KIM 10 |
| 157371554 | NC_009832.1: 3673293 . . . 3675482 | 1538 | YP_001479543.1 | 1739 | *Serratia proteamaculans* 568 |
| 238920583 | NC_012779.1: 2589897 . . . 2592035 | 1539 | YP_002934098.1 | 1740 | *Edwardsiella ictaluri* 93-146 |
| 197285630 | NC_010554.1: 1898593 . . . 1900737 | 1540 | YP_002151502.1 | 1741 | *Proteus mirabilis* HI4320 |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 37526984 | NC_005126.1: 3612456 . . . 3614597 | 1541 | NP_930328.1 | 1742 | *Photorhabdus luminescens* subsp. *laumondii* TTO1 |
| 238895817 | NC_012731.1: 3763302 . . . 3765449 | 1542 | YP_002920553.1 | 1743 | *Klebsiella pneumoniae* NTUH-K2044 |
| 146312483 | NC_009436.1: 3080629 . . . 3082770 | 1543 | YP_001177557.1 | 1744 | *Enterobacter* sp. 638 |
| 260598715 | NC_013282.1: 3057676 . . . 3059814 | 1544 | YP_003211286.1 | 1745 | *Cronobacter turicensis* |
| 601935 | D21123.1: 77 . . . 2218 | 1545 | BAA04663.1 | 1746 | *Escherichia coli* |
| 238898722 | complement(NC_012751.1: 1494526 . . . 1496655) | 1546 | YP_002924403.1 | 1747 | *Candidatus Hamiltonella defensa* 5AT (*Acyrthosiphon pisum*) |
| 227114079 | NZ_ABVX01000029.1: 23117 . . . 25261 | 1547 | ZP_03827735.1 | 1748 | *Pectobacterium carotovorum* subsp. *brasiliensis* PBR1692 |
| 89072717 | complement(NZ_AAOU01000004.1: 98074 . . . 100221) | 1548 | ZP_01159282.1 | 1749 | *Photobacterium* sp. SKA34 |
| 54309953 | NC_006370.1: 3245262 . . . 3247418 | 1549 | YP_130973.1 | 1750 | *Photobacterium profundum* SS9 |
| 262274670 | NZ_ADAQ01000011.1: 496361 . . . 498520 | 1550 | ZP_06052481.1 | 1751 | *Grimontia hollisae* CIP 101886 |
| 260768101 | complement(NZ_ACZP01000013.1: 239301 . . . 241427) | 1551 | ZP_05877035.1 | 1752 | *Vibrio furnissii* CIP 102972 |
| 260773044 | NZ_ACZO01000006.1: 1066216 . . . 1068360 | 1552 | ZP_05881960.1 | 1753 | *Vibrio metschnikovii* CIP 69.14 |
| 163802859 | complement(NZ_ABGR01000013.1: 61871 . . . 64036) | 1553 | ZP_02196748.1 | 1754 | *Vibrio* sp. AND4 |
| 37680318 | NC_005139.1: 2144915 . . . 2147059 | 1554 | NP_934927.1 | 1755 | *Vibrio vulnificus* YJ016 |
| 149188151 | complement(NZ_ABCH01000004.1: 163878 . . . 166022) | 1555 | ZP_01866446.1 | 1756 | *Vibrio shilonii* AK1 |
| 218708991 | complement(NC_011753.1: 1031606 . . . 1033810) | 1556 | YP_002416612.1 | 1757 | *Vibrio splendidus* LGP32 |
| 209695557 | NC_011312.1: 2262635 . . . 2264806 | 1557 | YP_002263486.1 | 1758 | *Aliivibrio salmonicida* LFI1238 |
| 229525709 | complement(NZ_ACHV01000001.1: 2574339 . . . 2576483) | 1558 | ZP_04415114.1 | 1759 | *Vibrio cholerae* bv. *albensis* VL426 |
| 145300284 | NC_009348.1: 3681431 . . . 3683584 | 1559 | YP_001143125.1 | 1760 | *Aeromonas salmonicida* subsp. *salmonicida* A449 |
| 237807651 | complement(NC_012691.1: 958413 . . . 960569) | 1560 | YP_002892091.1 | 1761 | *Tolumonas auensis* DSM 9187 |
| 90407162 | complement(NZ_AAPG01000006.1: 41954 . . . 44116) | 1561 | ZP_01215350.1 | 1762 | *Psychromonas* sp. CNPT3 |
| 119946918 | NC_008709.1: 4084304 . . . 4086466 | 1562 | YP_944598.1 | 1763 | *Psychromonas ingrahamii* 37 |
| 157374843 | complement(NC_009831.1: 2041698 . . . 2043839) | 1563 | YP_001473443.1 | 1764 | *Shewanella sediminis* HAW-EB3 |
| 170727231 | NC_010506.1: 3531467 . . . 3533608 | 1564 | YP_001761257.1 | 1765 | *Shewanella woodyi* ATCC 51908 |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 127513322 | NC_009092.1: 2807561 . . . 2809699 | 1565 | YP_001094519.1 | 1766 | *Shewanella loihica* PV-4 |
| 167624517 | NC_010334.1: 3149368 . . . 3151515 | 1566 | YP_001674811.1 | 1767 | *Shewanella halifaxensis* HAW-EB4 |
| 117919999 | complement(NC_008577.1: 1806421 . . . 1808574) | 1567 | YP_869191.1 | 1768 | *Shewanella* sp. ANA-3 |
| 119774631 | complement(NC_008700.1: 1807689 . . . 1809827) | 1568 | YP_927371.1 | 1769 | *Shewanella amazonensis* SB2B |
| 114563647 | NC_008345.1: 2956515 . . . 2958662 | 1569 | YP_751160.1 | 1770 | *Shewanella frigidimarina* NCIMB 400 |
| 91793762 | NC_007954.1: 2868611 . . . 2870791 | 1570 | YP_563413.1 | 1771 | *Shewanella denitrificans* OS217 |
| 157376672 | NC_009831.1: 4313346 . . . 4315484 | 1571 | YP_001475272.1 | 1772 | *Shewanella sediminis* HAW-EB3 |
| 167624655 | complement(NC_010334.1: 3320048 . . . 3322198) | 1572 | YP_001674949.1 | 1773 | *Shewanella halifaxensis* HAW-EB4 |
| 239996136 | complement(NZ_ABQB01000564.1: 6079 . . . 8301) | 1573 | ZP_04716660.1 | 1774 | *Alteromonas macleodii* ATCC 27126 |
| 109898905 | NC_008228.1: 3144369 . . . 3146513 | 1574 | YP_662160.1 | 1775 | *Pseudoalteromonas atlantica* T6c |
| 119469286 | NZ_AAVS01000006.1: 30053 . . . 32206 | 1575 | ZP_01612225.1 | 1776 | *Alteromonadales bacterium* TW-7 |
| 88860001 | complement(NZ_AAOH01000005.1: 230650 . . . 232797) | 1576 | ZP_01134640.1 | 1777 | *Pseudoalteromonas tunicata* D2 |
| 71282469 | NC_003910.7: 3309465 . . . 3311585 | 1577 | YP_269873.1 | 1778 | *Colwellia psychrerythraea* 34H |
| 152996332 | NC_009654.1: 2608121 . . . 2610220 | 1578 | YP_001341167.1 | 1779 | *Marinomonas* sp. MWYL1 |
| 87121463 | NZ_AANE01000011.1: 112021 . . . 114096 | 1579 | ZP_01077352.1 | 1780 | *Marinomonas* sp. MED121 |
| 146328905 | NC_009446.1: 489780 . . . 491837 | 1580 | YP_001209362.1 | 1781 | *Dichelobacter nodosus* VCS1703A |
| 258544959 | NZ_ACKY01000059.1: 4448 . . . 6562 | 1581 | ZP_05705193.1 | 1782 | *Cardiobacterium hominis* ATCC 15826 |
| 262104765 | complement(DS028152.1: 677306 . . . 679621) | 1582 | EEY62817.1 | 1783 | *Phytophthora infestans* T30-4 |
| 262104764 | complement(DS028152.1: 674496 . . . 676781) | 1583 | EEY62816.1 | 1784 | *Phytophthora infestans* T30-4 |
| 159472743 | XM_001694452.1: 258 . . . 2636 | 1584 | XP_001694504.1 | 1785 | *Chlamydomonas reinhardtii* |
| 168000833 | XM_001753068.1: 1 . . . 2367 | 1585 | XP_001753120.1 | 1786 | *Physcomitrella patens* subsp. *Patens* |
| 172038009 | complement(NC_010546.1: 3214848 . . . 3216944) | 1586 | YP_001804510.1 | 1787 | *Cyanothece* sp. ATCC 51142 |
| 126658068 | NZ_AAXW01000014.1: 79066 . . . 81162 | 1587 | ZP_01729220.1 | 1788 | *Cyanothece* sp. CCY0110 |
| 257060449 | NC_013161.1: 2659296 . . . 2661419 | 1588 | YP_003138337.1 | 1789 | *Cyanothece* sp. PCC 8802 |
| 218441705 | complement(NC_011729.1: 5341705 . . . 5343810) | 1589 | YP_002380034.1 | 1790 | *Cyanothece* sp. PCC 7424 |
| 166368837 | NC_010296.1: 5646854 . . . 5648950 | 1590 | YP_001661110.1 | 1791 | *Microcystis aeruginosa NIES-843* |
| 220909840 | NC_011884.1: 4551169 . . . 4553265 | 1591 | YP_002485151.1 | 1792 | *Cyanothece* sp. PCC 7425 |
| 16330299 | NC_000911.1: 1250442 . . . 1252535 | 1592 | NP_441027.1 | 1793 | *Synechocystis* sp. PCC 6803 |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 86142732 | NZ_AANC01000005.1: 209172 . . . 211268 | 1593 | ZP_01061171.1 | 1794 | *Leeuwenhoekiella blandensis MED217* |
| 146301271 | complement(NC_009441.1: 4208789 . . . 4210882) | 1594 | YP_001195862.1 | 1795 | *Flavobacterium johnsoniae* UW101 |
| 260061847 | NC_013222.1: 1408358 . . . 1410454 | 1595 | YP_003194927.1 | 1796 | *Robiginitalea biformata* HTCC2501 |
| 88713711 | complement(NZ_AAOC01000008.1: 22821 . . . 24917) | 1596 | ZP_01107792.1 | 1797 | *Flavobacteriales bacterium* HTCC2170 |
| 86133149 | complement(NZ_CH902588.1: 146636 . . . 148729) | 1597 | ZP_01051731.1 | 1798 | *Polaribacter* sp. MED152 |
| 88803680 | NZ_AAOG01000005.1: 54861 . . . 56951 | 1598 | ZP_01119204.1 | 1799 | *Polaribacter irgensii* 23-P |
| 213962668 | NZ_ABZV01000006.1: 103363 . . . 105438 | 1599 | ZP_03390929.1 | 1800 | *Capnocytophaga sputigena* ATCC 33612 |
| 256820698 | complement(NC_013162.1: 2243972 . . . 2246047) | 1600 | YP_003141977.1 | 1801 | *Capnocytophaga ochracea* DSM 7271 |
| 46581432 | NC_002937.3: 3152216 . . . 3154330 | 1601 | YP_012240.1 | 1802 | *Desulfovibrio vulgaris* str. *Hildenborough* |
| 218886955 | NC_011769.1: 2286534 . . . 2288648 | 1602 | YP_002436276.1 | 1803 | *Desulfovibrio vulgaris* str. 'Miyazaki F' |
| 78358281 | NC_007519.1: 3235663 . . . 3237822 | 1603 | YP_389730.1 | 1804 | *Desulfovibrio desulfuricans* subsp. *desulfuricans* str. G20 |
| 242280036 | complement(NC_012881.1: 2812652 . . . 2814769) | 1604 | YP_002992165.1 | 1805 | *Desulfovibrio salexigens* DSM 2638 |
| 258405159 | complement(NC_013223.1: 1218708 . . . 1220816) | 1605 | YP_003197901.1 | 1806 | *Desulfohalobium retbaense* DSM 5692 |
| 256828849 | NC_013173.1: 1143375 . . . 1145477 | 1606 | YP_003157577.1 | 1807 | *Desulfomicrobium baculatum* DSM 4028 |
| 225198782 | complement(NZ_ACJN01000010.1: 60728 . . . 62824) | 1607 | ZP_03737911.1 | 1808 | *Desulfonatronospira thiodismutans* ASO3-1 |
| 242278203 | NC_012881.1: 802309 . . . 804414 | 1608 | YP_002990332.1 | 1809 | *Desulfovibrio salexigens* DSM 2638 |
| 212704109 | complement(NZ_ABXU01000065.1: 34368 . . . 36470) | 1609 | ZP_03312237.1 | 1810 | *Desulfovibrio piger* ATCC 29098 |
| 220903578 | complement(NC_011883.1: 357004 . . . 359112) | 1610 | YP_002478890.1 | 1811 | *Desulfovibrio desulfuricans* subsp. *desulfuricans* str. ATCC 27774 |
| 51244410 | NC_006138.1: 608983 . . . 611115 | 1611 | YP_064294.1 | 1812 | *Desulfotalea psychrophila* LSv54 |
| 94986723 | NC_008011.1: 347892 . . . 350012 | 1612 | YP_594656.1 | 1813 | *Lawsonia intracellularis* PHE/MN1-00 |
| 119488858 | complement(NZ_AAVU01000021.1: 33384 . . . 35414) | 1613 | ZP_01621820.1 | 1814 | *Lyngbya* sp. PCC 8106 |
| 209524350 | NZ_ABYK01000010.1: 35808 . . . 37916 | 1614 | ZP_03272899.1 | 1815 | *Arthrospira maxima* CS-328 |
| 116748909 | NC_008554.1: 1826816 . . . 1828915 | 1615 | YP_845596.1 | 1816 | *Syntrophobacter fumaroxidans* MPOB |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 241776655 | NZ_ACQQ01000008.1: 86078 . . . 88198 | 1616 | ZP_04773932.1 | 1817 | *Allochromatium vinosum* DSM 180 |
| 32476008 | NC_005027.1: 5198833 . . . 5200932 | 1617 | NP_869002.1 | 1818 | *Rhodopirellula baltica* SH 1 |
| 78776256 | NC_007575.1: 60204 . . . 62282 | 1618 | YP_392571.1 | 1819 | *Sulfurimonas denitrificans* DSM 1251 |
| 254458291 | complement(NZ_DS995288.1: 173480 . . . 175561) | 1619 | ZP_05071717.1 | 1820 | *Campylobacterales bacterium* GD 1 |
| 229532518 | NZ_ABUV01000006.1: 73569 . . . 75677 | 1620 | ZP_04421899.1 | 1821 | *Sulfurospirillum deleyianum* DSM 6946 |
| 152993574 | NC_009663.1: 2069625 . . . 2071724 | 1621 | YP_001359295.1 | 1822 | *Sulfurovum* sp. NBC37-1 |
| 120401715 | NC_008726.1: 740616 . . . 742694 | 1622 | YP_951544.1 | 1823 | *Mycobacterium vanbaalenii* PYR-1 |
| 145220810 | complement(NC_009338.1: 189392 . . . 191515) | 1623 | YP_001131488.1 | 1824 | *Mycobacterium gilvum* PYR-GCK |
| 108797517 | NC_008146.1: 594117 . . . 596231 | 1624 | YP_637714.1 | 1825 | *Mycobacterium* sp. MCS |
| 118473540 | NC_008596.1: 867578 . . . 869656 | 1625 | YP_885188.1 | 1826 | *Mycobacterium smegmatis* str. MC2 155 |
| 169631304 | complement(NC_010397.1: 4294451 . . . 4296532) | 1626 | YP_001704953.1 | 1827 | *Mycobacterium abscessus* |
| 240168870 | NZ_ACBV01000011.1: 33884 . . . 35974 | 1627 | ZP_04747529.1 | 1828 | *Mycobacterium kansasii* ATCC 12478 |
| 183980733 | NC_010612.1: 853987 . . . 856071 | 1628 | YP_001849024.1 | 1829 | *Mycobacterium marinum* M |
| 15607549 | NC_000962.2: 491786 . . . 493858 | 1629 | NP_214922.1 | 1830 | *Mycobacterium tuberculosis* H37Rv |
| 41409983 | NC_002944.2: 4345845 . . . 4347932 | 1630 | NP_962819.1 | 1831 | *Mycobacterium avium* subsp. *paratuberculosis* K-10 |
| 254818871 | complement(NZ_ABIN01000026.1: 2280 . . . 4439) | 1631 | ZP_05223872.1 | 1832 | *Mycobacterium intracellulare* ATCC 13950 |
| 226304961 | NC_012490.1: 1605870 . . . 1607948 | 1632 | YP_002764919.1 | 1833 | *Rhodococcus erythropolis* PR4 |
| 111019190 | complement(NC_008268.1: 2308925 . . . 2311045) | 1633 | YP_702162.1 | 1834 | *Rhodococcus jostii* RHA1 |
| 54027320 | complement(NC_006361.1: 5652808 . . . 5654895) | 1634 | YP_121562.1 | 1835 | *Nocardia farcinica* IFM 10152 |
| 227978095 | NZ_ABVA01000001.1: 785441 . . . 787570 | 1635 | ZP_04025361.1 | 1836 | *Tsukamurella paurometabola* DSM 20162 |
| 262204223 | complement(NC_013441.1: 4704088 . . . 4706208) | 1636 | YP_003275431.1 | 1837 | *Gordonia bronchialis* DSM 43247 |
| 256831883 | complement(NC_013174.1: 683848 . . . 685947) | 1637 | YP_003160610.1 | 1838 | *Jonesia denitrificans* DSM 20603 |
| 260517199 | complement(NZ_ABUN01000002.1: 90744 . . . 92939) | 1638 | ZP_05816650.1 | 1839 | *Sanguibacter keddieii* DSM *10542* |
| 229243856 | complement(NZ_ABTJ01000131.1: 4381 . . . 6468) | 1639 | ZP_04368027.1 | 1840 | *Cellulomonas flavigena* DSM 20109 |
| 229821528 | NC_012669.1: 3401218 . . . 3403323 | 1640 | YP_002883054.1 | 1841 | *Beutenbergia cavernae* DSM 12333 |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 227428424 | complement(NZ_ABVC01000008.1: 150308 . . . 152407) | 1641 | ZP_03911481.1 | 1842 | *Xylanimonas cellulosilytica* DSM 15894 |
| 119717178 | complement(NC_008699.1: 3139954 . . . 3142044) | 1642 | YP_924143.1 | 1843 | *Nocardioides* sp. JS614 |
| 227381337 | complement(NZ_ABUC01000011.1: 233655 . . . 235784) | 1643 | ZP_03864789.1 | 1844 | *Kribbella flavida* DSM 17836 |
| 88856399 | NZ_AAOB01000010.1: 2970 . . . 5138 | 1644 | ZP_01131057.1 | 1845 | *marine actinobacterium* PHSC20C1 |
| 170780609 | NC_010407.1: 179995 . . . 182112 | 1645 | YP_001708941.1 | 1846 | *Clavibacter michiganensis* subsp. *Sepedonicus* |
| 50954174 | NC_006087.1: 335128 . . . 337257 | 1646 | YP_061462.1 | 1847 | *Leifsonia xyli* subsp. *xyli* str. CTCB07 |
| 114331961 | complement(NC_008344.1: 2107910 . . . 2110039) | 1647 | YP_748183.1 | 1848 | *Nitrosomonas eutropha* C91 |
| 256395328 | complement(NC_013131.1: 7130890 . . . 7133034) | 1648 | YP_003116892.1 | 1849 | *Catenulispora acidiphila* DSM 44928 |
| 258650827 | NC_013235.1: 639398 . . . 641491 | 1649 | YP_003199983.1 | 1850 | *Nakamurella multipartita* DSM 44233 |
| 257068066 | complement(NC_013172.1: 995592 . . . 997667) | 1650 | YP_003154321.1 | 1851 | *Brachybacterium faecium* DSM 4810 |
| 227497260 | complement(NZ_ACFH01000109.1: 3054 . . . 5108) | 1651 | ZP_03927492.1 | 1852 | *Actinomyces urogenitalis* DSM 15434 |
| 256824971 | NC_013169.1: 1149994 . . . 1152081 | 1652 | YP_003148931.1 | 1853 | *Kytococcus sedentarius* DSM 20547 |
| 260455562 | NZ_ACZH01000022.1: 9845 . . . 11917 | 1653 | ZP_05803950.1 | 1854 | *Streptomyces flavogriseus* ATCC 33331 |
| 182435904 | NC_010572.1: 2506931 . . . 2509012 | 1654 | YP_001823623.1 | 1855 | *Streptomyces griseus* subsp. *griseus* NBRC 13350 |
| 254387454 | NZ_DS570624.1: 26512 . . . 28596 | 1655 | ZP_05002693.1 | 1856 | *Streptomyces clavuligerus* ATCC 27064 |
| 254400535 | NZ_DS570905.1: 178100 . . . 180199 | 1656 | ZP_05015493.1 | 1857 | *Streptomyces sviceus* ATCC 29083 |
| 256813645 | NZ_ACFA01000303.1: 9482 . . . 11584 | 1657 | ZP_05538660.1 | 1858 | *Streptomyces griseoflavus* Tu4000 |
| 239928836 | NZ_ABYA01000185.1: 2180 . . . 4282 | 1658 | ZP_04685789.1 | 1859 | *Streptomyces ghanaensis* ATCC 14672 |
| 256804684 | complement(NZ_ACEZ01000169.1: 8822 . . . 10924) | 1659 | ZP_05534308.1 | 1860 | *Streptomyces viridochromogenes* DSM 40736 |
| 256785123 | NZ_ACEY01000098.1: 97187 . . . 99280 | 1660 | ZP_05523554.1 | 1861 | *Streptomyces lividans* TK24 |
| 29829365 | NC_003155.4: 3467325 . . . 3469415 | 1661 | NP_823999.1 | 1862 | *Streptomyces avermitilis* MA-4680 |
| 260646824 | FN554889.1: 3224239 . . . 3226344 | 1662 | CBG69921.1 | 1863 | *Streptomyces scabiei* 87.22 |
| 239982381 | complement(NZ_ABYC01000362.1: 40088 . . . 42163) | 1663 | ZP_04704905.1 | 1864 | *Streptomyces albus* J1074 |
| 254382385 | complement(NZ_DS570390.1: 111950 . . . 114034) | 1664 | ZP_04997745.1 | 1865 | *Streptomyces* sp. Mg1 |
| 256769973 | complement(NZ_ACEW01000403.1: 16454 . . . 18541) | 1665 | ZP_05509147.1 | 1866 | *Streptomyces* sp. C |

TABLE 12b-continued

SEQ ID NOs of phosphotransacetylase target gene coding regions and proteins

| GI Number | GENBANK Nucleotide Sequence Accession Information | Nucleic Acid SEQ ID NO: | GENBANK Amino Acid Sequence Accession No. | Amino Acid SEQ ID NO: | Source Organism |
|---|---|---|---|---|---|
| 256776255 | NZ_ACEX01000277.1: 2545 . . . 4641 | 1666 | ZP_05514718.1 | 1867 | *Streptomyces hygroscopicus* ATCC 53653 |
| 254378850 | NZ_DS570550.1: 40417 . . . 42507 | 1667 | ZP_04994290.1 | 1868 | *Streptomyces* sp. SPB74 |
| 229854086 | complement(NZ_ABUU01000066.1: 39364 . . . 41415) | 1668 | ZP_04474082.1 | 1869 | *Streptosporangium roseum* DSM 43021 |
| 145596204 | NC_009380.1: 4234932 . . . 4237007 | 1669 | YP_001160501.1 | 1870 | *Salinispora tropica* CNB-440 |
| 159039600 | NC_009953.1: 4631907 . . . 4633976 | 1670 | YP_001538853.1 | 1871 | *Salinispora arenicola* CNS-205 |
| 238060866 | NZ_GG657738.1: 2330097 . . . 2332163 | 1671 | ZP_04605575.1 | 1872 | *Micromonospora* sp. ATCC 39149 |
| 116671783 | complement(NC_008541.1: 3648900 . . . 3651011) | 1672 | YP_832716.1 | 1873 | *Arthrobacter* sp. FB24 |
| 148807608 | complement(EF601880.1: 72 . . . 2150) | 1673 | ABR13603.1 | 1874 | *Arthrobacter oxydans* |
| 239916738 | complement(NC_012803.1: 190981 . . . 193056) | 1674 | YP_002956296.1 | 1875 | *Micrococcus luteus* NCTC 2665 |
| 255326162 | NZ_ACVO01000004.1: 127571 . . . 129661 | 1675 | ZP_05367249.1 | 1876 | *Rothia mucilaginosa* ATCC 25296 |
| 184199797 | complement(NC_010617.1: 164688 . . . 166781) | 1676 | YP_001854004.1 | 1877 | *Kocuria rhizophila* DC2201 |
| 254368446 | NZ_DS264133.1: 69966 . . . 72062 | 1677 | ZP_04984463.1 | 1878 | *Francisella tularensis* subsp. *holarctica* FSC022 |
| 167626922 | complement(NC_010336.1: 741506 . . . 743602) | 1678 | YP_001677422.1 | 1879 | *Francisella philomiragia* subsp. *philomiragia* ATCC 25017 |
| 94676965 | NC_007984.1: 392877 . . . 395012 | 1679 | YP_588827.1 | 1880 | *Baumannia cicadellinicola* str. Hc (*Homalodisca coagulata*) |
| P57273 | BA000003.2: 189582 . . . 191708 | 1680 | NP_240007.1 | 1881 | *Buchnera aphidicola* str. APS (*Acyrthosiphon pisum*) |
| 254444018 | NZ_DS990592.1: 1298899 . . . 1301010 | 1681 | ZP_05057494.1 | 1882 | *Verrucomicrobiae bacterium* DG1235 |
| 171914782 | NZ_ABIZ01000001.1: 6593044 . . . 6595128 | 1682 | ZP_02930252.1 | 1883 | *Verrucomicrobium spinosum* DSM 4136 |
| 114777389 | NZ_AATS01000006.1: 50467 . . . 52602 | 1683 | ZP_01452386.1 | 1884 | *Mariprofundus ferrooxydans* PV-1 |
| 94500866 | NZ_AAQH01000011.1: 33324 . . . 35456 | 1684 | ZP_01307392.1 | 1885 | *Bermanella marisrubri* |

In other embodiments, a polynucleotide, gene and/or polypeptide encoding phosphotransacetylase can have at least about 70% to about 75%, about 80% to about 85%, about 85% to about 90%, about 90% to about 95%, about 96%, about 97%, about 98%, or about 99% sequence identity to any one of the sequences of Tables 10 or 12a or 12b, wherein the polynucleotide, gene and/or polypeptide encodes a polypeptide having phosphotransacetylase activity.

In embodiments, a polynucleotide, gene and/or polypeptide encoding phosphotransacetylase corresponds to the Enzyme Commission Number EC 2.3.1.8.

In other embodiments, the phosphotransacetylase polynucleotide, gene and/or polypeptide sequences described herein or those recited in the art can be used to identify phosphotransacetylase sequences or phosphotransacetylase homologs in other cells, as described above for PDC.

Methods for gene expression in recombinant host cells, including, but not limited to, yeast cells are known in the art (see, for example, *Methods in Enzymology*, Volume 194, Guide to Yeast Genetics and Molecular and Cell Biology (Part A, 2004, Christine Guthrie and Gerald R. Fink (Eds.), Elsevier Academic Press, San Diego, Calif.). In embodiments, the coding region for the phosphoketolase and/or phosphotransacetylase genes to be expressed can be codon optimized for the target host cell, as well known to one skilled in the art. Expression of genes in recombinant host cells, including but not limited to yeast cells, can require a promoter operably linked to a coding region of interest, and a transcriptional terminator. A number of promoters can be used in constructing expression cassettes for genes, including, but not limited to, the following constitutive promoters suitable for use in yeast: FBA1, TDH3 (GPD), ADH1, and GPM1; and the following inducible promoters suitable for use in yeast: GAL1, GAL10 and CUP1. Other yeast promoters include hybrid promoters UAS(PGK1)-FBA1p (SEQ ID NO: 1893), UAS(PGK1)-ENO2p (SEQ ID NO: 1894), UAS(FBA1)-PDC1p (SEQ ID NO: 1895), UAS(PGK1)-PDC1p (SEQ ID NO: 1896), and UAS(PGK)-OLE1p (SEQ ID NO: 1897). Suitable transcriptional terminators that can be used in a chimeric gene construct for expression include, but are not limited to, FBA1t, TDH3t, GPM1t, ERG10t, GAL1t, CYC1t, and ADH1t.

Recombinant polynucleotides are typically cloned for expression using the coding sequence as part of a chimeric gene used for transformation, which includes a promoter operably linked to the coding sequence as well as a ribosome binding site and a termination control region. The coding region may be from the host cell for transformation and combined with regulatory sequences that are not native to the natural gene encoding phosphoketolase and/or phosphotransacetylase. Alternatively, the coding region may be from another host cell.

Vectors useful for the transformation of a variety of host cells are common and described in the literature. Typically the vector contains a selectable marker and sequences allowing autonomous replication or chromosomal integration in the desired host. In addition, suitable vectors can comprise a promoter region which harbors transcriptional initiation controls and a transcriptional termination control region, between which a coding region DNA fragment may be inserted, to provide expression of the inserted coding region. Both control regions can be derived from genes homologous to the transformed host cell, although it is to be understood that such control regions can also be derived from genes that are not native to the specific species chosen as a production host.

In embodiments, suitable promoters, transcriptional terminators, and phosphoketolase and/or phosphotransacetylase coding regions can be cloned into *E. coli*-yeast shuttle vectors, and transformed into yeast cells. Such vectors allow strain propagation in both *E. coli* and yeast strains, and can contain a selectable marker and sequences allowing autonomous replication or chromosomal integration in the desired host. Typically used plasmids in yeast include, but are not limited to, shuttle vectors pRS423, pRS424, pRS425, and pRS426 (American Type Culture Collection, Rockville, Md.), which contain an *E. coli* replication origin (e.g., pMB1), a yeast 2-micron origin of replication, and a marker for nutritional selection. The selection markers for these four vectors are HIS3 (vector pRS423), TRP1 (vector pRS424), LEU2 (vector pRS425) and URA3 (vector pRS426).

In embodiments, construction of expression vectors with a chimeric gene encoding the described phosphoketolases and/or phosphotransacetylases can be performed by the gap repair recombination method in yeast. In embodiments, a yeast vector DNA is digested (e.g., in its multiple cloning site) to create a "gap" in its sequence. A number of insert DNAs of interest are generated that contain an approximately 21 bp sequence at both the 5' and the 3' ends that sequentially overlap with each other, and with the 5' and 3' terminus of the vector DNA. For example, to construct a yeast expression vector for "Gene X," a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. In embodiments, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding region X-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

The presence of phosphoketolase and phosphotransacetylase activity in the recombinant host cells disclosed herein can be confirmed using routine methods known in the art. In a non-limiting example, and as described in the Examples herein, transformants can be screened by PCR using primers for the phosphoketolase and phosphotransacetylase genes. In embodiments, and as described in the Examples herein, transformants can be screened by PCR with primers N1039 and N1040 (SEQ ID NOs: 639 and 640) to confirm integration of the xpk1 gene, and primers N1041 and N1042 (SEQ ID NOs: 641 and 642) can be used to confirm integration of the eutD gene. In another non-limiting example, and as described in the Examples herein, transformants can be screened for integration of phosphoketolase constructs and/or phosphotransacetylase constructs at the Δpdc1::ilvD(Sm) locus by the loss of ilvD(Sm) in the host cells.

In another non-limiting example, and as described in the examples herein, phosphoketolase activity can be assayed by expressing phosphoketolase identifiable by the methods disclosed herein in a recombinant host cell disclosed herein that lacks endogenous phosphoketolase activity. If phosphoketolase activity is present, such cells exhibit a reduced or eliminated requirement for exogenous two-carbon substrate supplementation for growth in culture.

In another non-limiting example, and as described in the examples herein, phosphoketolase and phosphotransacetylase activity can be assayed by expressing phosphoketolase and phosphotransacetylase activity identifiable by the methods disclosed herein in a recombinant host cell disclosed herein that lacks endogenous phosphoketolase and phosphotransacetylase activity. If phosphoketolase activity and phosphoketolase activity are present, such cells exhibit a reduced or eliminated requirement for exogenous two-carbon substrate supplementation for growth in culture.

In another non-limiting example, phosphoketolase and/or phosphotransacetylase activity can be confirmed by more indirect methods, such as by assaying for a downstream product in a pathway requiring phosphoketolase activity. For example, a polypeptide having phosphoketolase activity can catalyze the conversion of xylulose-5-phosphate into glyceraldehyde-3-phosphate and acetyl-phosphate and/or the conversion of fructose-6-phosphate into erythrose-4-phosphate and acetyl-phosphate. Also, a polypeptide having phosphotransacetylase activity can catalyze the conversion of acetyl-phosphate into acetyl-CoA.

Suitable Pathway Carbon Substrates and Exogenous Two-Carbon Substrate Supplementation PDC-KO cells fail to grow in glucose-containing media (e.g., 2% glucose), but PDC-KO cells carrying a functional butanediol biosynthetic pathway have been shown to grow on glucose supplemented with exogenous two-carbon substrates such as ethanol (see for example, US Patent Application Publication No. 20090305363, herein incorporated by reference). In embodiments, the host cells disclosed herein can be grown in fermentation media which contains a suitable pathway carbon substrate and two-substrate supplement, including combinations of suitable pathway carbon substrates with C2-substrate supplement. Non-limiting examples of suitable pathway carbon substrates include, but are not limited to, monosaccharides such as fructose, oligosaccharides such as lactose maltose, galactose, or sucrose, polysaccharides such as starch or cellulose or mixtures thereof and unpurified mixtures from renewable feedstocks such as cheese whey permeate, cornsteep liquor, sugar beet molasses, and barley malt, including any combinations thereof. In other embodiments, the suitable pathway carbon substrates can include lactate, glycerol, or combinations thereof.

In embodiments, a suitable carbon substrate can be a one-carbon substrate such as carbon dioxide, or methanol for which metabolic conversion into key biochemical intermediates has been demonstrated, or combinations thereof. In other embodiments related to methylotrophic organisms, the carbon substrate can be carbon containing compounds such as methylamine, glucosamine and a variety of amino acids for metabolic activity. In a non-limiting example, methylotrophic yeasts are known to utilize the carbon from methylamine to form trehalose or glycerol (Bellion et al., *Microb. Growth C1 Compd.*, [Int. Symp.], 7th (1993), 415-32, Editor(s): Murrell, J. Collin; Kelly, Don P. Publisher: Intercept, Andover, UK). In another non-limiting example, various species of *Candida* can metabolize alanine (Sulter et al., *Arch. Microbiol.* 153:485-489 (1990)). Hence it is contemplated that the source of carbon utilized in the present invention can encompass a wide variety of carbon containing substrates and will only be limited by the choice of organism.

In other embodiments, the suitable pathway carbon substrate can be glucose, fructose, and sucrose, or mixtures of these with five-carbon (C5) sugars such as xylose and/or arabinose for yeasts cells modified to use C5 sugars. In embodiments, sucrose can be derived from renewable sugar sources such as sugar cane, sugar beets, cassava, sweet sorghum, and mixtures thereof. In other embodiment, glucose and dextrose can derived from renewable grain sources through saccharification of starch based feedstocks including grains such as corn, wheat, rye, barley, oats, and mixtures thereof. In embodiments, the pathway carbon substrates can be derived from renewable cellulosic or lignocellulosic biomass through processes of pretreatment and saccharification, as described, for example, in U.S. Patent Application Publication No. US 20070031918 A1, which is herein incorporated by reference.

As used herein, "biomass" refers to any cellulosic or lignocellulosic material and includes, but is not limited to, materials comprising cellulose, and optionally further comprising hemicellulose, lignin, starch, oligosaccharides and/or monosaccharides. In embodiments, biomass can also comprise additional components, such as protein and/or lipid. In other embodiments, biomass can be derived from a single source, or biomass can comprise a mixture derived from more than one source; for example, biomass can comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Other non-limiting examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

The recombinant host cells described herein can be cultured using standard laboratory techniques known in the art (see, e.g., *Methods in Yeast Genetics,* 2005, Cold Spring Harbor Laboratory Press, Cold Spring Harbor, N.Y., pp. 201-202). In embodiments related to media supplemented with exogenous two-carbon substrates, and as described in the Examples, recombinant host cells can be grown in synthetic complete medium supplemented with one or more exogenous two-carbon substrates as described herein at a concentration of about 0.01%, about 0.05%, about 0.1%, about 0.5%, about 1.0%, about 1.5%, about 1.5% or about 2% (v/v) of the media. In embodiments, the recombinant host cells can be grown in synthetic complete culture without uracil or histidine, supplemented with 0.5% (v/v) ethanol. In embodiments related to growth in media that is not supplemented with exogenous two-carbon substrates, the recombinant host cells described herein can be first grown in culture medium comprising an exogenous two-carbon substrate and then diluted (e.g., starting OD=0.1, 20 ml medium in a 125 ml vented flask) into media that is not supplemented with exogenous two-carbon substrate.

The growth of the recombinant host cells described herein can be measured by methods known in the art (see, e.g., *Methods in Yeast Genetics,* 2005, Cold Spring Harbor Laboratory Press, Cold Spring Harbor, N.Y., pp. 201-202). In a non-limiting example, the growth of the recombinant host cells described herein can be determined by measuring the optical density (OD) of cell cultures over time. For example, the OD at 600 nm for a yeast culture is proportional to yeast cell number. In another non-limiting example, the growth of the recombinant host cells described herein can be determined by counting viable cells in a sample of the culture over time.

Applicants have provided cells that have a reduced or eliminated requirement for two-carbon substrate supplementation for growth. In embodiments, such cells comprise (i) a deletion, mutation, and/or substitution in an endogenous gene encoding a polypeptide that converts pyruvate to acetaldehyde, acetyl-phosphate or acetyl-CoA that results in a requirement for exogenous two-carbon substrate supplementation for optimal growth; (ii) a heterologous polynucleotide encoding a polypeptide having phosphoketolase activity; and optionally (iii) a heterologous polynucleotide encoding a polypeptide having phosphotransacetylase activity. In embodiments, such cells comprise (i) a modification in an endogenous polypeptide having PDC activity which results in reduced or eliminated PDC activity; (ii) a heterologous polynucleotide encoding a polypeptide having phosphoketolase activity; and optionally (iii) a heterologous polynucleotide encoding a polypeptide having phosphotransacetylase activity. As such, Applicants have also provided methods of improving the growth of a recombinant host cell comprising at least one modification in an endogenous polypeptide that converts pyruvate to acetaldehyde, acetyl-phosphate or acetyl-CoA that results in a requirement for exogenous two-carbon substrate supplementation for optimal growth comprising transforming the host cell with a heterologous polynucleotide encoding a polypeptide having phosphoketolase activity. Applicants have also provided methods of improving the growth of a recombinant host cell comprising at least one modification in an endogenous polypeptide having pyruvate decarboxylase activity (e.g., having at least one deletion, mutation or substitution in an endogenous gene encoding a polypeptide having PDC activity that results in reduced or eliminated PDC activity) comprising transforming the host cell with a heterologous polynucleotide encoding a polypeptide having phosphoketolase activity. In other embodiments, the method further comprises transforming a recombinant host cell described herein with a heterologous polynucleotide encoding a polypeptide having phosphotransacetylase activity.

Applicants have also provided methods of reducing or eliminating the requirement for an exogenous two-carbon substrate for the growth of a recombinant host cell comprising at least one modification in an endogenous activity that converts pyruvate to acetaldehyde, acetyl-phosphate or acetyl-CoA that results in a requirement for exogenous two-carbon substrate supplementation for optimal growth comprising transforming the host cell with a heterologous polynucleotide encoding a polypeptide having phosphoketolase activity comprising transforming the recombinant host cell with a heterologous polynucleotide encoding a polypeptide having phosphoketolase activity. In other embodiments, the method further comprises transforming the recombinant host cell with a heterologous polynucleotide encoding a polypeptide having phosphotransacetylase activity.

Applicants have also provided methods of reducing the requirement for an exogenous two-carbon substrate for the growth of a recombinant host cell comprising at least one modification in an endogenous polypeptide having PDC activity (e.g., having at least one deletion, mutation or substitution in an endogenous gene encoding a polypeptide having pyruvate decarboxylase activity) comprising transforming the recombinant host cell with a heterologous polynucleotide encoding a polypeptide having phosphoketolase activity. In other embodiments, the method further comprises transforming the recombinant host cell with a heterologous polynucleotide encoding a polypeptide having phosphotransacetylase activity.

In addition, Applicants have provided methods of eliminating the requirement for an exogenous two-carbon substrate for the growth of a recombinant host cell comprising at least one modification in an endogenous polypeptide having PDC activity (e.g., having at least one deletion, mutation or substitution in an endogenous gene encoding a polypeptide having PDC activity that results in reduced or eliminated PDC activity) comprising transforming the recombinant host cell with a heterologous polynucleotide encoding a polypeptide having phosphoketolase activity. In other embodiments, the method further comprises transforming the recombinant host cell with a heterologous polynucleotide encoding a polypeptide having phosphotransacetylase activity.

In embodiments, a reduced requirement for exogenous two-carbon substrate supplementation can be a growth rate of the recombinant host cells described herein in media that is not supplemented with an exogenous two-carbon substrate that is the same or substantially equivalent to the growth rate of a recombinant host cell comprising a modification in an endogenous activity that converts pyruvate to acetaldehyde, acetyl-phosphate or acetyl-CoA grown in media that is supplemented with an exogenous two-carbon substrate. In embodiments, such a growth rate can be at least about 70%, at least about 75%, at least about 80%, at least about 85%, at least about 90%, at least about 95%, at least about 96%, at least about 97%, at least about 98%, or at least about 99% of the growth rate of a recombinant host cell comprising a modification in an endogenous activity that converts pyruvate to acetaldehyde, acetyl-phosphate or acetyl-CoA grown in media that is supplemented with an exogenous two-carbon substrate.

In embodiments, a reduced requirement for exogenous two-carbon substrate supplementation can be a growth rate of the recombinant host cells described herein in media that is not supplemented with an exogenous two-carbon substrate that is the same or substantially equivalent to the growth rate of a recombinant host cell comprising a modification in an endogenous PDC activity grown in media that is supplemented with an exogenous two-carbon substrate. In embodiments, such a growth rate can be at least about 70%, at least about 75%, at least about 80%, at least about 85%, at least about 90%, at least about 95%, at least about 96%, at least about 97%, at least about 98%, or at least about 99% of the growth rate of a recombinant host cell comprising a modification in an endogenous PDC activity grown in media that is supplemented with an exogenous two-carbon substrate.

In other embodiments, the recombinant host cells described herein have a growth rate in media that is not supplemented with an exogenous two-carbon substrate that is greater than the growth rate of a recombinant host cell comprising a modification in an endogenous activity that converts pyruvate to acetaldehyde, acetyl-phosphate or acetyl-CoA in media that is not supplemented with an exogenous two-carbon substrate.

In other embodiments, the recombinant host cells described herein have a growth rate in media that is not supplemented with an exogenous two-carbon substrate that is greater than the growth rate of a recombinant host cell comprising a modification in an endogenous PDC activity in media that is not supplemented with an exogenous two-carbon substrate.

In other embodiments, the recombinant host cells described herein can have an increased glucose consumption compared to a recombinant host cell comprising a modification in an endogenous polypeptide that converts pyruvate to acetaldehyde, acetyl-phosphate or acetyl-CoA.

In other embodiments, the recombinant host cells described herein can have an increased glucose consumption compared to a recombinant host cell comprising a modification in an endogenous polypeptide having PDC activity (e.g., at least one deletion, mutation, and/or substitution in an endogenous gene encoding a polypeptide having PDC activity that reduces or eliminates PDC activity).

Glucose consumption of the recombinant host cells described herein can be measured by methods known in the art (see, e.g., *Methods in Yeast Genetics,* 2005, Cold Spring Harbor Laboratory Press, Cold Spring Harbor, N.Y., pp. 201-202). In a non-limiting example, glucose consumption can be measured by quantitating the amount of glucose in culture media by HPLC or with a YSI Biochemistry Analyzer (YSI, Inc., Yellow Springs, Ohio).

In other embodiments, methods of producing a recombinant host cell are provided comprising transforming a recombinant host cell comprising a modification in an endogenous polynucleotide, gene or polypeptide encoding pyruvate decarboxylase (e.g., at least one deletion, mutation, and/or substitution in an endogenous gene encoding a polypeptide having pyruvate decarboxylase activity) with a heterologous polynucleotide encoding a polypeptide having phosphoketolase activity. In other embodiments, the method further comprises transforming the recombinant host cell with a heterologous polynucleotide encoding a polypeptide having phosphotransacetylase activity.

In other embodiments, methods for the conversion of xylulose 5-phosphate or fructose 6-phosphate into acetyl-phosphate are provided comprising (i) providing a recombinant host cell as described herein, or combinations thereof; and (ii) growing the recombinant host cell under conditions wherein xylulose 5-phosphate or fructose-6-phosphate is converted into acetyl-phosphate. In other embodiments, methods for the conversion of xylulose 5-phosphate or fructose-6-phosphate into acetyl-CoA are provided comprising (i) providing a recombinant host cell as described herein, or combinations thereof; and (ii) growing the recombinant host cell under conditions where xylulose 5-phosphate or fructose-6-phosphate is converted into acetyl-CoA.

In other embodiments, methods for the conversion of acetyl-phosphate to acetyl-CoA are provided comprising (i) providing a recombinant host cell as described herein, or combinations thereof; and (ii) growing the recombinant host cell under conditions where acetyl-phosphate is converted into acetyl-CoA. In other embodiments, methods for increasing the specific activity of a heterologous polypeptide having phosphoketolase activity in a recombinant host cell are provided comprising (i) providing a recombinant host cell as described herein, or combinations thereof; and (ii) growing the recombinant host cell under conditions wherein the heterologous polypeptide having phosphoketolase activity is expressed in functional form having a specific activity greater than the same recombinant host cell lacking the heterologous polypeptide having phosphoketolase activity.

In other embodiments, methods for increasing the specific activity of a heterologous polypeptide having phosphotransacetylase activity in a recombinant host cell are provided comprising (i) providing a recombinant host cell described herein, or combinations thereof; and (ii) growing the recombinant host cell under conditions whereby the heterologous polypeptide having phosphotransacetylase activity is expressed in functional form having a specific activity greater than the same recombinant host cell lacking a heterologous polypeptide having phosphotransacetylase activity.

In still other embodiments, methods for increasing the activity of the phosphoketolase pathway in a recombinant host cell are provided comprising (i) providing a recombinant host cell as described herein, or combinations thereof; and (ii) growing the host cell under conditions whereby the activity of the phosphoketolase pathway in the host cell is increased.

Threonine aldolase (E.C. number 4.1.2.5) catalyzes cleavage of threonine to produce glycine and acetaldehyde. Plasmid-based overexpression of a gene encoding this enzyme in *S. cerevisiae* PDC-KO strains was shown to eliminate the requirement for exogenous C2 supplementation (van Maris et al, Appl Environ Microbiol. 2003 April; 69(4):2094-9). In embodiments, recombinant host cells comprise (i) a deletion, mutation, and/or substitution in an endogenous gene encoding a polypeptide that converts pyruvate to acetaldehyde, acetyl-phosphate or acetyl-CoA that results in a requirement for exogenous two-carbon substrate supplementation for optimal growth; and (ii) a heterologous polynucleotide encoding a polypeptide having threonine aldolase activity.

Engineered Biosynthetic Pathways Using Pyruvate

In embodiments, the recombinant host cells described herein can be engineered to have a biosynthetic pathway for production of a product from pyruvate. A product from such a pyruvate-utilizing biosynthetic pathway includes, but is not limited to, 2,3-butanediol, isobutanol, 2-butanol, 2-butanone, valine, leucine, alanine, lactic acid, malic acid, fumaric acid, succinic acid and isoamyl alcohol. The features of any pyruvate-utilizing biosynthetic pathway may be engineered in the recombinant host cells described herein in any order. Any product made using a biosynthetic pathway that has pyruvate as the initial substrate can be produced with greater effectiveness in a recombinant host cell disclosed herein having a modification in an endogenous polypeptide that converts pyruvate to acetaldehyde, acetyl-phosphate or acetyl-CoA (such as pyruvate decarboxylase, pyruvate formate lyase, pyruvate dehydrogenase, pyruvate oxidase, or pyruvate: ferredoxin oxioreductase) and having heterologous phosphoketolase and/or phosphotransacetylase activity, compared to a recombinant host cell having a modification in an endogenous polypeptide that converts pyruvate to acetaldehyde, acetyl-phosphate or acetyl-CoA (such as pyruvate decarboxylase, pyruvate formate lyase, pyruvate dehydrogenase, pyruvate oxidase, or pyruvate:ferredoxin oxioreductase). Any product made using a biosynthetic pathway that has pyruvate as the initial substrate can be produced with greater effectiveness in a recombinant host cell disclosed herein having a modification in an endogenous polypeptide having PDC activity that reduces or eliminates PDC activity and having heterologous phosphoketolase and/or phosphotransacetylase activity, compared to a recombinant host cell having a modification in an endogenous polypeptide having PDC activity that reduces or eliminates PDC activity.

The biosynthetic pathway of the recombinant host cells described herein can be any pathway that utilizes pyruvate and produces a desired product. The pathway genes may include endogenous genes and/or heterologous genes. Typically at least one gene in the biosynthetic pathway is a heterologous gene. Suitable biosynthetic pathways for production of butanol are known in the art, and certain suitable pathways are described herein. In some embodiments, the butanol biosynthetic pathway comprises at least one gene that is heterologous to the host cell. In some embodiments, the butanol biosynthetic pathway comprises more than one gene that is heterologous to the host cell. In some embodiments, the butanol biosynthetic pathway comprises heterologous genes encoding polypeptides corresponding to every step of a biosynthetic pathway.

Genes and polypeptides that can be used for substrate to product conversions described herein as well as methods of identifying such genes and polypeptides, are described herein and/or in the art, for example, for isobutanol, in the Examples and in U.S. Pat. No. 7,851,188. Ketol-acid reductoisomerase (KARI) enzymes are described in U.S. Patent Appl. Pub. Nos. 20080261230 A1, 20090163376 A1, 20100197519 A1, and PCT Appl. Pub. No. WO/2011/041415. Examples of KARIs disclosed therein are those from *Lactococcus lactis, Vibrio cholera, Pseudomonas aeruginosa* PAO1, and *Pseudomonas fluorescens* PF5 mutants. KARIs include *Anaerostipes caccae* KARI variants "K9G9" and "K9D3" (SEQ ID NOs: 1911 and 1910, respectively). US Appl. Pub. No. 20100081154 A1, and U.S. Pat. No. 7,851,188 describe dihydroxyacid dehydratases (DHADs), including a DHAD from *Streptococcus mutans*. U.S. Patent Appl. Publ. No. 20090269823 A1 describes SadB, an alcohol dehydrogenase (ADH) from *Achromobacter xylosoxidans*. Alcohol dehydrogenases also include horse liver ADH and *Beijerinkia indica* ADH (protein SEQ ID NO: 1923).

An example of a biosynthetic pathway for producing 2,3-butanediol can be engineered in the recombinant host cells described herein, as described in U.S. Patent Application No. 20090305363, which is herein incorporated by reference. The 2,3-butanediol pathway is a portion of the 2-butanol biosynthetic pathway that is disclosed in U.S. Patent Application Publication No. US 20070292927 A1, which is herein incorporated by reference. Such pathway steps include, but are not limited to, conversion of pyruvate to acetolactate by acetolactate synthase, conversion of acetolactate to acetoin by acetolactate decarboxylase, and conversion of acetoin to 2,3-butanediol by butanediol dehydrogenase. The skilled person will appreciate that polypeptides having the activity of such pathway steps can be isolated from a variety of sources can be used in the recombinant host cells described herein.

In addition, examples of biosynthetic pathways for production of 2-butanone or 2-butanol that can be engineered in the recombinant host cells described herein are disclosed in U.S. Patent Application Publication Nos. US 20070292927 A1 and US 20070259410 A1, which are herein incorporated by reference. The pathway in U.S. Patent Application Publication No. US 20070292927 A1 is the same as described for butanediol production with the addition of the following steps:

2,3-butanediol to 2-butanone as catalyzed for example by diol dehydratase or glycerol dehydratase; and 2-butanone to 2-butanol as catalyzed for example by butanol dehydrogenase.

Described in U.S. Patent Application Publication No. US 20090155870 A1, which is herein incorporated by reference, is the construction of chimeric genes and genetic engineering of yeast for 2-butanol production using the U.S. Patent Application Publication No. US 20070292927 A1 disclosed biosynthetic pathway. Further description for gene construction and expression related to these pathways can be found, for example, in International Publication No. WO 2009046370 (e.g., butanediol dehydratases); and U.S. Patent Application Publication No. US 20090269823 A1 (e.g., butanol dehydrogenase) and U.S. Patent Application Publication No. US 20070259410 A1 which are herein incorporated by reference. The skilled person will appreciate that polypeptides having the activity of such pathway steps can be isolated from a variety of sources can be used in the recombinant host cells described herein.

Biosynthetic pathways for the production of isobutanol that may be used include those described in U.S. Pat. No. 7,851,188 and PCT Publication WO 2007050671, incorporated herein by reference. One isobutanol biosynthetic pathway comprises the following substrate to product conversions:

pyruvate to acetolactate, which may be catalyzed, for example, by acetolactate synthase;

acetolactate to 2,3-dihydroxyisovalerate, which may be catalyzed, for example, by acetohydroxy acid reductoisomerase;

2,3-dihydroxyisovalerate to a-ketoisovalerate, which may be catalyzed, for example, by acetohydroxy acid dehydratase;

α-ketoisovalerate to isobutyraldehyde, which may be catalyzed, for example, by a branched-chain keto acid decarboxylase; and isobutyraldehyde to isobutanol, which may be catalyzed, for example, by a branched-chain alcohol dehydrogenase. In some embodiments, the isobutanol biosynthetic pathway comprises at least one gene, at least two genes, at least three genes, or at least four genes that is/are heterologous to the yeast cell. In embodiments, each substrate to product conversion of an isobutanol biosynthetic pathway in a recombinant host cell is catalyzed by a heterologous polypeptide. In embodiments, the polypeptide catalyzing the substrate to product conversions of acetolactate to 2,3-dihydroxyisovalerate and/or the polypeptide catalyzing the substrate to product conversion of isobutyraldehyde to isobutanol are capable of utilizing NADH as a cofactor.

An example of a biosynthetic pathway for production of valine that can be engineered in the recombinant host cells described herein includes the steps of acetolactate conversion to 2,3-dihydroxy-isovalerate by acetohydroxyacid reductoisomerase (ILV5), conversion of 2,3-dihydroxy-isovalerate to 2-keto-isovalerate by dihydroxy-acid dehydratase (ILV3), and conversion of 2-keto-isovalerate to valine by branched-chain amino acid transaminase (BAT2) and branched-chain amino acid aminotransferase (BAT1). Biosynthesis of leucine includes the same steps to 2-keto-isovalerate, followed by conversion of 2-keto-isovalerate to alpha-isopropylmalate by alpha-isopropylmalate synthase (LEU9, LEU4), conversion of alpha-isopropylmalate to beta-isopropylmalate by isopropylmalate isomerase (LEU1), conversion of beta-isopropylmalate to alpha-ketoisocaproate by beta-IPM dehydrogenase (LEU2), and finally conversion of alpha-ketoisocaproate to leucine by branched-chain amino acid transaminase (BAT2) and branched-chain amino acid aminotransferase (BAT1). It is desired for production of valine or leucine to overexpress at least one of the enzymes in these described pathways.

An example of a biosynthetic pathway for production of isoamyl alcohol that can be engineered in the recombinant host cells described herein includes the steps of leucine conversion to alpha-ketoisocaproate by branched-chain amino acid transaminase (BAT2) and branched-chain amino acid aminotransferase (BAT1), conversion of alpha-ketoisocaproate to 3-methylbutanal by ketoisocaproate decarboxylase (THI3) or decarboxylase ARO10, and finally conversion of 3-methylbutanal to isoamyl alcohol by an alcohol dehydrogenase such as ADH1 or SFA1. Production of isoamyl alcohol benefits from increased production of leucine or the alpha-ketoisocaproate intermediate by overexpression of one or more enzymes in biosynthetic pathways for these chemicals. In addition, one or both enzymes for the final two steps can be overexpressed.

An example of a biosynthetic pathway for production of lactic acid that can be engineered in the recombinant host cells described herein includes pyruvate conversion to lactic acid by lactate dehydrogenase. Engineering yeast for lactic acid production using lactate dehydrogenase, known as EC 1.1.1.27, is well known in the art such as in Ishida et al. (*Appl. Environ. Microbiol.* 71:1964-70 (2005)).

An example of a biosynthetic pathway for production of alanine that can be engineered in the recombinant host cells described herein includes pyruvate conversion to alanine by aminotransferase.

An example of a biosynthetic pathway for production of malate that can be engineered in the recombinant host cells described herein includes pyruvate conversion to oxaloacetate by pyruvate carboxylase, and conversion of oxaloacetate to malate by malate dehydrogenase as described in Zelle et al. (*Applied and Environmental Microbiology* 74:2766-77 (2008)). In addition, a malate transporter can be expressed.

An example of a biosynthetic pathway for production of fumarate that can be engineered in the recombinant host cells described herein includes pyruvate conversion to oxaloacetate by pyruvate carboxylase, and conversion of oxaloacetate to malate by malate dehydrogenase as described in Zelle et al. (*Applied and Environmental Microbiology* 74:2766-77 (2008)). In addition, a fumarase and a fumarate transporter can be expressed. Favorable production conditions and engineering of fungi for fumarate production is well known in the art, described e.g. by Goldberg et al. (*Journal of Chemical Technology and Biotechnology* 81:1601-1611 (2006)).

An example of a biosynthetic pathway for production of succinate that can be engineered in the recombinant host cells described herein includes pyruvate conversion to oxaloacetate by pyruvate carboxylase, and conversion of oxaloacetate to malate by malate dehydrogenase as described in Zelle et al. (*Applied and Environmental Microbiology* 74:2766-77 (2008)). In addition, a fumarase, a succinate dehydrogenase and a succinate transporter can be expressed.

The skilled person will appreciate that polypeptides having activities of the above-mentioned biosynthetic pathways can be isolated from a variety of sources can be used in the recombinant host cells described herein.

It will be appreciated that host cells comprising a butanol biosynthetic pathway such as an isobutanol biosynthetic pathway as provided herein may further comprise one or more additional modifications. U.S. Appl. Pub. No. 20090305363 (incorporated by reference) discloses increased conversion of pyruvate to acetolactate by engineering yeast for expression of a cytosol-localized acetolactate synthase and substantial elimination of pyruvate decarboxylase activity. Modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl. Pub. No. 20090305363 (incorporated herein by reference), modifications to a host cell that provide for increased carbon flux through an Entner-Doudoroff Pathway or reducing equivalents balance as described in U.S. Patent Appl. Pub. No. 20100120105 (incorporated herein by reference). Other modifications include integration of at least one polynucleotide encoding a polypeptide that catalyzes a step in a pyruvate-utilizing biosynthetic pathway. Other modifications include at least one deletion, mutation, and/or substitution in an endogenous polynucleotide encoding a polypeptide having acetolactate reductase activity. In embodiments, the polypeptide having acetolactate reductase activity is YMR226C (SEQ ID NO: 1912) of *Saccharomyces cerevisae* or a homolog thereof. Additional modifications include a deletion, mutation, and/or substitution in an endogenous polynucleotide encoding a polypeptide having aldehyde dehydrogenase and/or aldehyde oxidase activity. In embodiments, the polypeptide having aldehyde dehydrogenase activity is ALD6 (SEQ ID NO: 1909) from *Saccharomyces cerevisiae* or a homolog thereof. A genetic modification which has the effect of reducing glucose repression wherein the yeast production host cell is pdc− is described in U.S. Appl. Publication No. 20110124060, incorporated herein by reference.

Recombinant host cells may further comprise (a) at least one heterologous polynucleotide encoding a polypeptide having dihydroxy-acid dehydratase activity; and (b)(i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In embodiments, the polypeptide affecting Fe—S cluster biosynthesis is encoded by AFT1 (nucleic acid SEQ ID NO: 1913, amino acid SEQ ID NO: 1914), AFT2 (SEQ ID NOs: 1915 and 1916), FRA2 (SEQ ID NOs: 1917 and 1918), GRX3 (SEQ ID NOs: 1919 and 1920), or CCC1 (SEQ ID NOs: 1921 and 1922). In embodiments, the polypeptide affecting Fe—S cluster biosynthesis is constitutive mutant AFT1 L99A, AFT1 L102A, AFT1 C291F, or AFT1 C293F.

Fermentation Media

The recombinant host cells disclosed herein can be grown in fermentation media for production of a product utilizing pyruvate. For maximal production of some products, such as 2,3-butanediol, isobutanol, 2-butanone, or 2-butanol, the recombinant host cells disclosed herein used as production hosts preferably have enhanced tolerance to the produced chemical, and have a high rate of carbohydrate utilization. These characteristics can be conferred by mutagenesis and selection, genetic engineering, or can be natural.

Fermentation media for production of the products disclosed herein may contain glucose. Additional carbon substrates for product production pathways can include but are not limited to those described above. It is contemplated that the source of carbon utilized can encompass a wide variety of carbon containing substrates and will only be limited by the choice of organism.

In addition to an appropriate carbon source, fermentation media can contain suitable minerals, salts, cofactors, buffers and other components, known to those skilled in the art, suitable for the growth of the cultures and promotion of the enzymatic pathway necessary for production of the desired product.

Culture Conditions

Typically cells are grown at a temperature in the range of about 20° C. to about 37° C. in an appropriate medium. Suitable growth media for the recombinant host cells described herein are common commercially prepared media such as broth that includes yeast nitrogen base, ammonium sulfate, and dextrose as the carbon/energy source) or YPD Medium, a blend of peptone, yeast extract, and dextrose in optimal proportions for growing most *Saccharomyces cerevisiae* strains. Other defined or synthetic growth media may also be used and the appropriate medium for growth of the particular microorganism will be known by one skilled in the art of microbiology or fermentation science.

Suitable pH ranges for the fermentation are between pH 3.0 to pH 7.5, where pH 4.5 to pH 6.5 is preferred as the initial condition.

Fermentations can be performed under aerobic or anaerobic conditions, where anaerobic or microaerobic conditions are preferred.

The amount of product in the fermentation medium can be determined using a number of methods known in the art, for example, high performance liquid chromatography (HPLC) or gas chromatography (GC).

Industrial Batch and Continuous Fermentations

A batch method of fermentation can be used with the recombinant host cells described herein. A classical batch fermentation is a closed system where the composition of the medium is set at the beginning of the fermentation and not subject to artificial alterations during the fermentation. Thus, at the beginning of the fermentation the medium is inoculated with the desired organism or organisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells progress through a static lag phase to a high growth log phase and finally to a stationary phase where growth rate is diminished or halted. If untreated, cells in the stationary phase will eventually die. Cells in log phase generally are responsible for the bulk of production of end product or intermediate.

A Fed-Batch system can also be used with the recombinant host cells described herein. A Fed-Batch system is similar to a typical batch system with the exception that the carbon source substrate is added in increments as the fermentation progresses. Fed-Batch systems are useful when catabolite repression (e.g. glucose repression) is apt to inhibit the metabolism of the cells and where it is desirable to have limited amounts of substrate in the media. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992), herein incorporated by reference.

Although a batch mode can be performed, it is also contemplated that continuous fermentation methods could also be performed with the recombinant host cells described herein. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth.

Continuous fermentation allows for the modulation of one factor or any number of factors that affect cell growth or end product concentration. For example, one method will maintain a limiting nutrient such as the carbon source or nitrogen level at a fixed rate and allow all other parameters to vary. In other systems a number of factors affecting growth can be altered continuously while the cell concentration, measured by media turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that the present invention can be practiced using either batch, fed-batch or continuous processes and that any known mode of fermentation would be suitable. Additionally, it is contemplated that cells can be immobilized on a substrate as whole cell catalysts and subjected to fermentation conditions for production.

Product Isolation from Fermentation Medium

Products can be isolated from the fermentation medium by methods known to one skilled in the art. For example, bioproduced isobutanol may be isolated from the fermentation medium using methods known in the art for ABE fermentations (see, e.g., Durre, Appl. Microbiol. Biotechnol. 49:639-648 (1998), Groot et al., Process. Biochem. 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, pervaporation or vacuum flash fermentation (see e.g., U.S. Pub. No. 20090171129 A1, and International Pub. No. WO2010/151832 A1, both incorporated herein by reference in their entirety).

Because butanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see, e.g., Doherty and Malone, Conceptual Design of Distillation Systems, McGraw Hill, New York, 2001).

The butanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The butanol can also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the butanol from the solvent.

Distillation in combination with adsorption can also be used to isolate isobutanol from the fermentation medium. In this method, the fermentation broth containing the isobutanol is distilled to near the azeotropic composition and then the remaining water is removed by use of an adsorbent, such as molecular sieves (Aden et al., Lignocellulosic Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., J. Membr. Sci. 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 20090305370, the disclosure of which is hereby incorporated in its entirety. U.S. Patent Appl. Pub. No. 20090305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, the alcohol can be esterfied by contacting the alcohol in a fermentation medium with an organic acid (e.g., fatty acids) and a catalyst (e.g. enzyme such as a lipase) capable of esterfiying the alcohol with the organic acid. In such embodiments, the organic acid can serve as an ISPR extractant into which the alcohol esters partition. The organic acid can be supplied to the fermentation vessel and/or derived from the biomass supplying fermentable carbon fed to the fermentation vessel. Lipids present in the feedstock can be catalytically hydrolyzed to organic acid, and the same catalyst (e.g., enzymes) can esterify the organic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into organic acid and substantially simultaneous esterification of the organic acid with butanol present in the fermentation vessel. Organic acid and/or native oil not derived from the feedstock can also be fed to the fermentation vessel, with the native oil being hydrolyzed into organic acid. Any organic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester reduces the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to organic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the organic acid extractant can contact the fermentation medium at a time before the butanol concentration reaches a toxic level, so as to esterify the butanol with the organic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

EXAMPLES

The meaning of abbreviations used is as follows: "min" means minute(s), "h" means hour(s), "sec" means second(s), "μl" means microliter(s), "ml" means milliliter(s), "L" means liter(s), "nm" means nanometer(s), "mm" means millimeter(s), "cm" means centimeter(s), "μm" means micrometer(s), "mM" means millimolar, "M" means molar, "mmol" means millimole(s), "μmole" means micromole(s), "g" means gram(s), "μg" means microgram(s), "mg" means milligram(s), "rpm" means revolutions per minute, "w/v" means weight/volume, "v/v" means volume/volume, "OD" means optical density, "bp" means base pair(s), and "PCR" means polymerase chain reaction.

General Methods:

Standard recombinant DNA and molecular cloning techniques used in the Examples are well known in the art and are described by Sambrook, J., Fritsch, E. F. and Maniatis, T., *Molecular Cloning: A Laboratory Manual*, Cold Spring Harbor Laboratory Press, Cold Spring Harbor, N.Y., 1989, by T. J. Silhavy, M. L. Bennan, and L. W. Enquist, *Experiments with Gene Fusions*, Cold Spring Harbor Laboratory, Cold Spring Harbor, N.Y., 1984, and by Ausubel, F. M. et al., *Current Protocols in Molecular Biology*, Greene Publishing Assoc. and Wiley-Interscience, N.Y., 1987. Phusion® HF Master Mix (NEB Cat. No. F-531) and HotStarTaq® Master Mix (Qiagen Cat. No. 203443) were used for PCR in gene cloning and clone screening, respectively.

Materials and methods suitable for the maintenance and growth of bacterial cultures are also well known in the art. Techniques suitable for use in the following Examples may be found in *Manual of Methods for General Bacteriology*, Phillipp Gerhardt, R. G. E. Murray, Ralph N. Costilow, Eugene W. Nester, Willis A. Wood, Noel R. Krieg and G. Briggs Phillips, eds., American Society for Microbiology, Washington, D.C., 1994, or by Thomas D. Brock in *Biotechnology: A Textbook of Industrial Microbiology*, Second Edition, Sinauer Associates, Inc., Sunderland, Mass., 1989. All reagents, restriction enzymes and materials used for the growth and maintenance of bacterial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.), unless otherwise specified.

HPLC

Analysis for fermentation by-product composition is well known to those skilled in the art. For example, one high performance liquid chromatography (HPLC) method utilizes a Shodex SH-1011 column with a Shodex SH-G guard column (both available from Waters Corporation, Milford, Mass.), with refractive index (RI) detection. Chromatographic separation is achieved using 0.01 M $H_2SO_4$ as the mobile phase with a flow rate of 0.5 mL/min and a column temperature of 50° C. Isobutanol retention time is 47.6 minutes. For butanediol, meso-butanediol eluted at 26.0 min and 2R,3R-butanediol eluted at 27.7 min.

Example 1

Construction of Phosphoketolase/Phosphotransacetylase Expression Cassette

The xpk1 and eutD genes (GenBank GI numbers 28379168 (SEQ ID NO: 172) and 28377658 (SEQ ID NO: 1111), respectively) were obtained from *Lactobacillus plantarum* (ATCC No. BAA-793) via polymerase chain reaction (PCR) using primers N1039 and N1040 (for xpk1) and N1041 and N1042 (for eutD). The primer sequences of N1039, N1040, N1041 and N1042 correspond to SEQ ID Nos. 639-642, respectively.

The xpk1 and eutD genes were fused to a DNA fragment containing opposing yeast terminator sequences (CYC and ADH terminators, obtained from Pad digestion of pRS423::CUP1-alsS+FBA-budA, described in U.S. Patent Application Publication No. 20090155870, herein incorporated by reference) by overlap PCR method (Yu et al., *Fungal Genet. Biol.* 41: 973-981; 2003). The resulting PCR product was cloned into an *E. coli*-yeast shuttle vector using gap repair methodology (Ma et al., *Genetics* 58:201-216; 1981). The shuttle vector was based on pRS426 (ATCC No. 77107) and contained both GPD (also known as TDH3) and ADH1 promoters. The resulting vector contained xpk1 under control of the GPD promoter and eutD under control of the ADH1 promoter in opposing orientation. The sequence of the resulting vector (pRS426::GPD-xpk1+ADH1-eutD) is provided as SEQ ID No: 643 (see FIG. 5 for a map of this vector).

Example 2

Construction of Phosphoketolase/Phosphotransacetylase Integration Vector

An expression cassette of the pRS426::GPD-xpk1+ADH1-eutD vector (GPD-xpk1+ADH1-eutD) was prepared by digestion with EcoRI and Sad restriction enzymes. The resulting cassette was ligated into the yeast integration vector pUC19-URA3-MCS which was also prepared by digestion with EcoRI and Sad restriction enzymes.

Vector pUC19-URA3MCS is pUC19-based and contains the sequence of the URA3 gene from *Saccaromyces cerevisiae* situated within a multiple cloning site (MCS). pUC19 (American Type Culture Collection, Manassas, Va.; ATCC#37254) contains the pMB 1 replicon and a gene coding for beta-lactamase for replication and selection in *Escherichia coli*. In addition to the coding sequence for URA3, the sequences from upstream and downstream of this gene are included for expression of the URA3 gene in yeast. The vector can be used for cloning purposes and can be used as a yeast integration vector.

The DNA encompassing the URA3 coding region along with 250 bp upstream and 150 bp downstream of the URA3 coding region from *Saccaromyces cerevisiae* CEN.PK 113-7D (CBS 8340; Centraalbureau voor Schimmelcultures (CBS) Fungal Biodiversity Centre, Netherlands) genomic DNA was amplified with primers oBP438 (SEQ ID NO: 644), containing BamHI, AscI, PmeI, and FseI restriction sites, and oBP439 (SEQ ID NO: 645), containing XbaI, PacI, and NotI restriction sites. Genomic DNA was prepared using a Gentra Puregene Yeast/Bact kit (Qiagen). The PCR product and pUC19 were ligated with T4 DNA ligase after digestion with BamHI and XbaI to create vector pUC19-URA3MCS. The vector was confirmed by PCR and sequencing with primers oBP264 (SEQ ID NO:646) and oBP265 (SEQ ID NO:647).

The ligation reaction was transformed into *E. coli* Stbl3 cells, according to the manufacturer's instructions (Invitrogen, Carlsbad, Calif., Cat. No. C7373). Transformants were screened by polymerase chain reaction (PCR) to detect the eutD gene using the primers N1041 and N1042 (SEQ ID NOs: 641 and 642, respectively). Positive clones for eutD gene expression detected by PCR were further confirmed for eutD gene incorporation by digestion of the vector with SacII restriction enzyme.

Two confirmed clones were selected and an integration targeting sequence was added to the clones as follows. PCR was used to amplify regions of the genome of *S. cerevisiae* strain BY4700 (ATCC No. 200866) both 5' and 3' of the PDC1 gene using the following primers: N1049 and N1050 (5') and N1047 and N1048 (3') (SEQ ID NOs: 648-651, respectively). Primer N1049 enables the 3' end of the 161-bp PDC1 3' sequence to be fused to the 5' end of the 237 bp PDC1 5' sequence via PCR. This pdc1 3'-5'-fusion fragment (368 bp in length) was cloned into the pCRII-Blunt TOPO vector according to the manufacturer's instructions (Invitrogen, Carlsbad, Calif., Cat. No. K2800).

Transformants were screened by PCR to detect the pdc1 3'-5'-fusion fragment using primers N1047 and N1050. The pdc1 3'-5'-fusion fragment was isolated from positive clones and released from the vector by digestion with EcoRI enzyme, and ligated into a pUC19-URA3::GPD-xpk1+ADH-eutD vector that had been linearized by digestion with EcoRI restriction enzyme to generate the "phosphoketolase pathway" vector. Additionally, the pdc1 3'-5'-fusion fragment was ligated with pUC19-URA3-MCS digested with EcoRI restriction enzyme to generate the control vector. Both ligation reactions were transformed into *E. coli* Stbl3 cells according to the manufacturer's instructions (Invitrogen, Carlsbad, Calif., Cat. No. C7373). The resulting transformants were screened by PCR to detect the pdc1 3'-5'-fusion fragment using primers N1047 and N1050. Positive clones containing the pdc1 3'-5'-fusion fragment were identified and the vectors were digested with either NcoI restriction enzyme (control vector) or BsgI restriction enzyme (phosphoketolase pathway vector) to confirm cloning orientation. One control clone (=pUC19-URA3::pdc1) and one phosphoketolase pathway clone (=pUC19-URA3::pdc1::GPD-xpk1+ADH1-eutD; SEQ ID NO: 1898) were selected for integration.

Example 3

Construction of Pyruvate Decarboxylase Knockout (PDC-KO) Yeast Strain Containing Phosphoketolase and Phosphotransacetylase Genes The control and phosphoketolase pathway vectors described in Example 2 were linearized with AIM restriction enzyme and transformed into strain BP913 (CEN.PK113-7D Δura3::loxP Δhis3 Δpdc6 Δpdc1::ilvD(Sm) Δpdc5::sadB) to form control and phosphoketolase pathway strains. Strain BP913 is further described in Example 10.

Transformed cells were plated on synthetic complete medium without uracil containing ethanol as the sole carbon source (1% vol/vol) and screened by PCR using primers N238 and oBP264 (SEQ ID Nos. 652 and 646, respectively to confirm integration at the pdc1 locus. Integration at the Δpdc1::ilvD(Sm) locus resulted in the loss of ilvD(Sm).

Example 4

Figure 2:
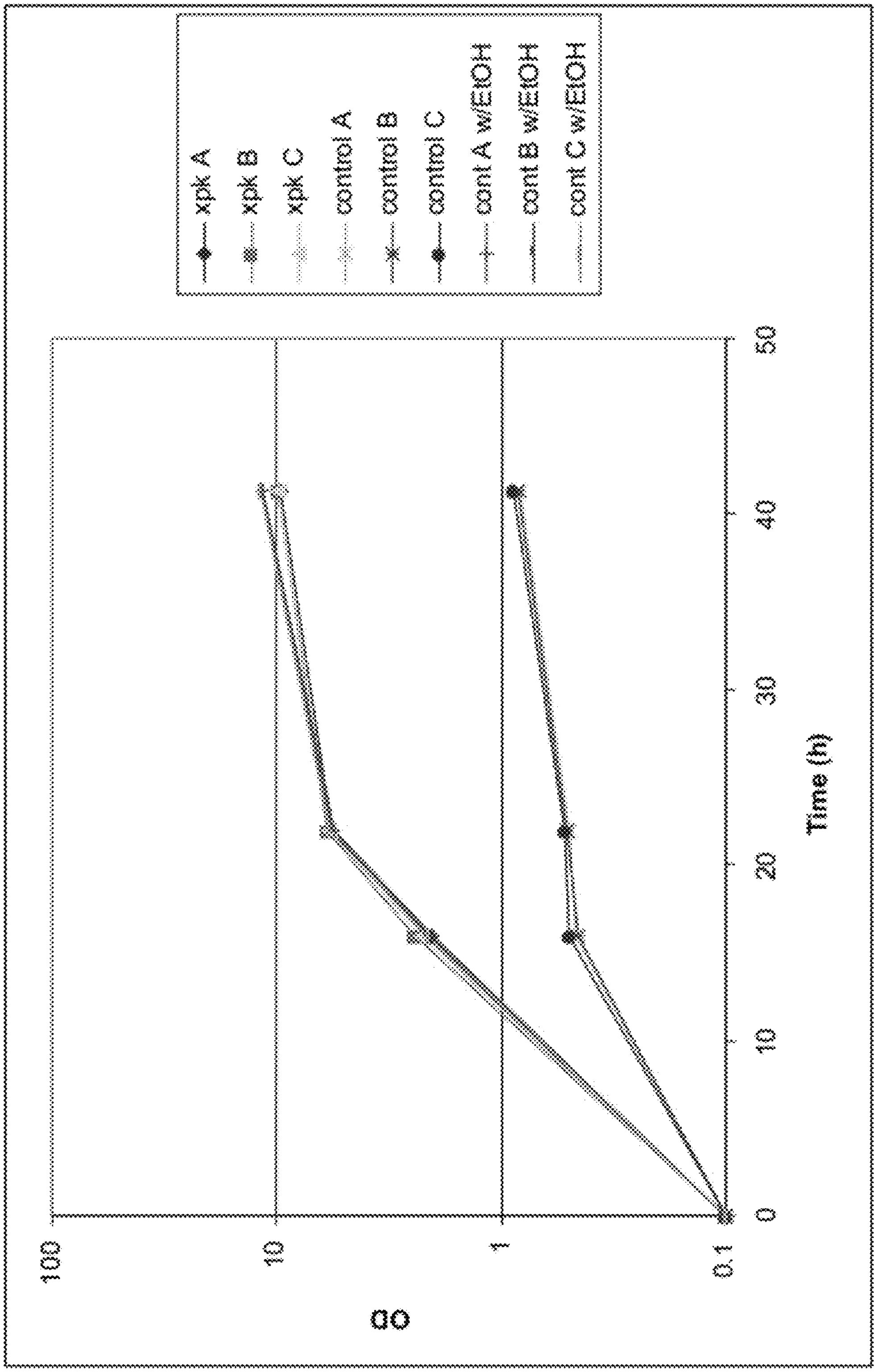
FIG. 2 depicts the growth of PDC-KO yeast strains expressing phosphoketolase and phosphotransacetylase without exogenous carbon substrate supplementation.

Introduction of Phosphoketolase and Phosphotransacetylase Allows Growth of PDC-KO Cells Without Exogenous Two-Carbon Substrate Supplementation Pyruvate decarboxylase knockout (PDC-KO) yeast strains are unable to grow in media containing 2% glucose as the sole carbon source, but can grow in 2% glucose supplemented with ethanol as shown with a strain transformed with one or more plasmids encoding members of the butanediol pathway (described in U.S. Patent Application Publication No. 20090305363, herein incorporated by reference). To test whether the introduction of the phosphoketolase and phosphotransacetylase genes could support growth of PDC-KO cells, PDC-KO yeast were transformed with the phosphoketolase and phosphotransacetylase gene (as described in Example 3) and with the vector pRS423::CUP1-alsS+FBA-budA (described in U.S. Patent Application Publication No. 20090155870, herein incorporated by reference) encoding members of the butanediol pathway. After cultivation in media containing 2% glucose (synthetic complete minus his and ura) supplemented with 0.05% v/v ethanol, cultures were diluted into the same media lacking ethanol (starting OD=0.1, 20 ml medium in a 125 ml vented flask). For comparison, a control PDC-KO strain without introduction of the phosphoketolase and phosphotransacetylase genes was also diluted into medium supplemented with ethanol (0.05% vol/vol). The optical density at 600 nm was measured during growth (results shown in FIG. 2 and Table 13).

TABLE 13

| | Condition | | | |
|---|---|---|---|---|
| Strain | 0 h OD | 16 h OD | 22 h OD | 41.3 h OD |
| xpk A | 0.1 | 2.07 | 5.63 | 9.64 |
| xpk B | 0.1 | 2.44 | 5.93 | 9.78 |
| xpk C | 0.1 | 2.26 | 5.83 | 9.96 |
| control A | 0.1 | 0.47 | 0.5 | 0.822 |
| control B | 0.1 | 0.45 | 0.51 | 0.849 |
| control C | 0.1 | 0.5 | 0.52 | 0.879 |
| cont A w/EtOH | 0.1 | 2.01 | 5.49 | 11.44 |
| cont B w/EtOH | 0.1 | 2.16 | 5.7 | 11.5 |
| cont C w/EtOH | 0.1 | 2.12 | 5.76 | 11.76 |

The growth of PDC-KO yeast transformed with phosphoketolase and phosphotransacetylase in media that was not supplemented with ethanol (xpkA-xpkC, representing n=3 results) was indistinguishable from the growth of PDC-KO yeast strains grown in media containing 2% glucose that was supplemented with ethanol (cont A-cont C w/EtOH, representing n=3 results). The average growth rate of the phosphoketolase- and phosphotransacetylase-transformed strains under these conditions was 0.19 $h^{-1}$. A growth rate of 0.23 $h^{-1}$ for the phosphoketolase- and phosphotransacetylase-transformed strains was observed upon culturing under the same conditions with higher aeration (data not shown). PDC-KO yeast strains grown in media containing 2% glucose that was not supplemented with ethanol showed some growth in the first 16 hours, but then grew at a rate of only 0.01 $h^{-1}$ (control A-control C, representing n=3 results).

Example 5

Construction of Pyruvate Decarboxylase Knockout (PDC-KO) Yeast Strains Containing Either Phosphoketolase or Phosphotransacetylase Genes The integration vector described above (pUC19-URA3::pdc1::GPD-xpk1+ADH1-eutD) was modified to eliminate either the xpk1 phosphoketolase gene or the eutD phosphotransacetylase gene. Specifically, to remove eutD, the integration vector was digested with the ClaI and SpeI restriction enzymes to remove a 0.6 kb region from the eutD coding sequence, forming the vector pUC19-URA3::pdc1::GPD-xpk1. To remove xpk1, the integration vector was digested with the SpeI and KpnI restriction enzymes to remove the 3.4 kb region from SpeI to KpnI, forming the vector pUC19-URA3::pdc1::ADH-eutD. The resulting vectors, were linearized with digestion with the AflII restriction enzyme and transformed into BP913/pRS423::CUP1-alsS+FBA-budA cells (described in Example 3). Transformed cells were screened by PCR to confirm integration at the pdc1 locus and cultured, as described above.

Example 6

Introduction of Phosphoketolase Allows Growth of PDC-KO Cells Without Exogenous Two-Carbon Substrate Supplementation To test whether the introduction of either the phosphoketolase or phosphotransacetylase genes could support the growth of PDC-KO cells, PDC-KO yeast were transformed with either the phosphoketolase or phosphotransacetylase genes (as described in Example 5) and with the vector pRS423::CUP1-alsS+FBA-budA encoding members of the butanediol pathway (as described in Example 4). After cultivation in media containing 2% glucose (synthetic complete minus his and ura) supplemented with 0.05% v/v ethanol, cultures were diluted into the same media lacking ethanol (starting OD=0.1, 20 ml medium in a 125 ml vented flask).

For comparison, a PDC-KO strain without introduction of the phosphoketolase or phosphotransacetylase genes were grown under the same conditions. The optical density at 600 nm was measured during growth (results shown in FIG. 3 and Table 15).

TABLE 15

| Strain | 0 h OD | 24 h OD |
|---|---|---|
| xpk1 + eutD | 0.1 | 7.48 |
| none (control) | 0.1 | 0.575 |
| eutD only | 0.1 | 0.338 |
| eutD only | 0.1 | 0.28 |
| xpk1 only | 0.1 | 6.74 |
| xpk1 only | 0.1 | 7.26 |

Figure 3:
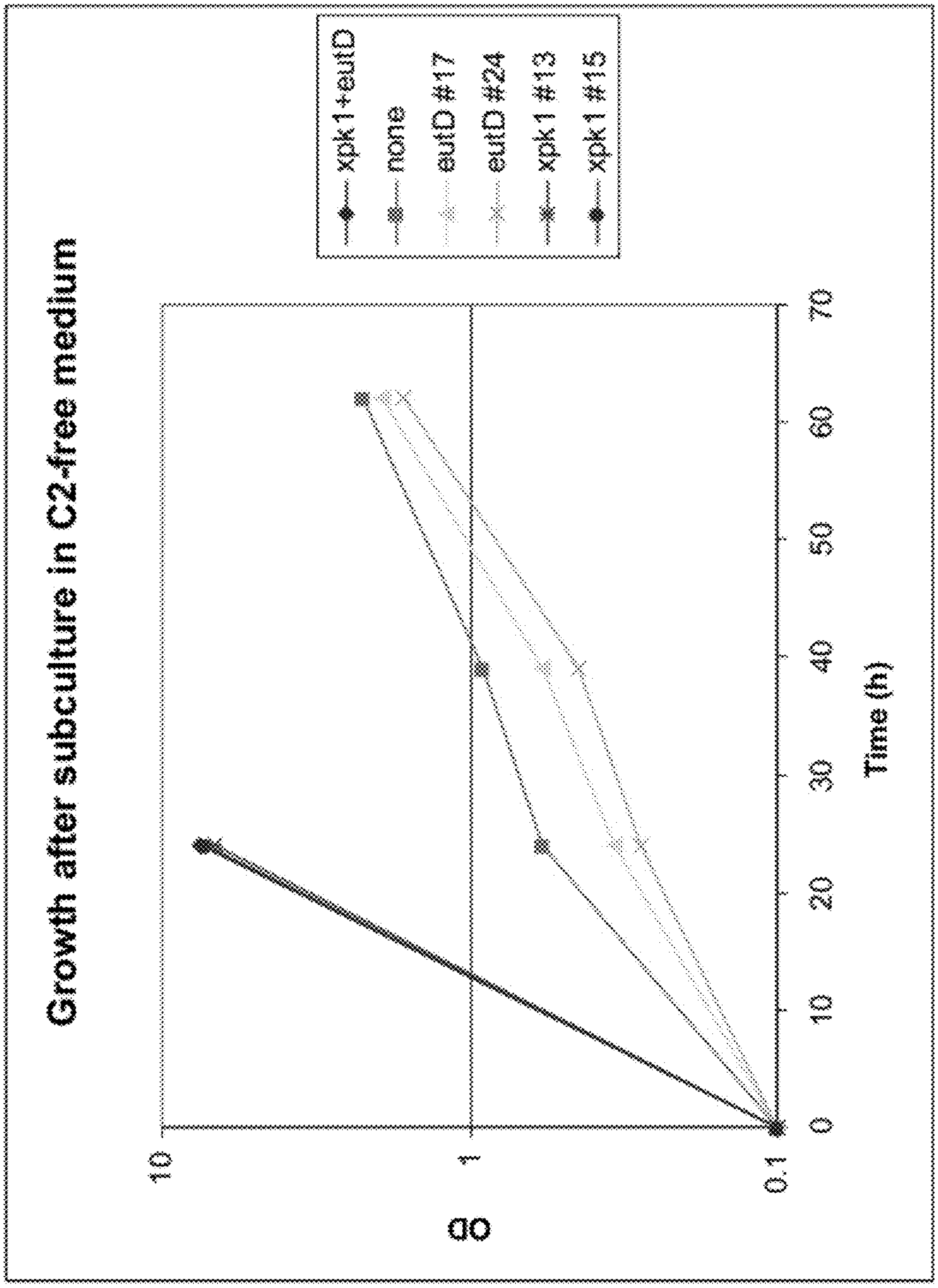
FIG. 3 depicts the growth of PDC-KO yeast strains expressing phosphoketolase and/or phosphotransacetylase in without exogenous carbon substrate supplementation.

The growth of PDC-KO yeast transformed with phosphoketolase in media that was not supplemented with exogenous carbon substrate (xpk1, FIG. 3) was indistinguishable from the growth of PDC-KO yeast transformed with phosphoketolase and phosphotransacetylase grown in media containing 2% glucose that was supplemented with ethanol (xpk1+eutD, FIG. 3). The growth of PDC-KO yeast transformed with phosphotransacetylase (eutD, FIG. 3) was not significantly improved compared to PDC-KO yeast strains in media that was not supplemented with exogenous two-carbon substrate (none, FIG. 3).

Example 7

Introduction of Phosphoketolase to PDC-KO Cells Increases Glucose Consumption and Butanediol Yield To test the effects of introduction of phosphoketolase into PDC-KO cells on glucose consumption and butanediol yield, PDC-KO yeast were transformed with either (1) phosphoketolase and phosphotransacetylase (as described in Example 4) and the vector pRS423::CUP1-alsS+FBA-budA encoding members of the butanediol (BDO) pathway (as described in Example 4) ("Xpk" in Table 16 below); or with (2) the vector pRS423::CUP1-alsS+FBA-budA encoding members of the butanediol pathway ("Control" in Table 6 below).

After cultivation in medium containing 2% glucose (synthetic complete minus histidine and uracil) supplemented with 0.05% ethanol, Xpk and Control cultures were diluted into medium without ethanol (starting OD=0.1, 20 ml medium in a 125 ml vented flask). Glucose consumption and butanediol yield of Xpk and Control cultures were measured by HPLC analysis of culture media for amount of glucose and butanediol as shown in the Table below.

TABLE 16

Introduction of Phosphoketolase Increases Glucose Consumption and Butanediol Yield of PDC-KO Cells.

| Strains | Glucose consumed (mM) | Butanediol Molar Yield |
|---|---|---|
| Xpk (n = 3) | 73.9 ± 2.4 | 0.475 ± 0.001 |
| Control (n = 3) | 48.3 ± 0.6 | 0.359 ± 0.003 |

The glucose consumption of Xpk cells (n=3) was nearly twice the amount of glucose consumption of control strains (n=3). In addition, the butanediol molar yield of Xpk cells was increased compared to the butanediol molar yield of Control cells.

Example 8

Construction of an Additional Phosphoketolase Pathway Integration Vector

A phosphoketolase/phosphotransacetylase integration vector similar to the one described in Example 2 was constructed. In this case the xpk1 and eutD gene constructs were cloned so that they would be integrated immediately downstream of the Δpdc1::ilvD(Sm) locus of BP913. To do this, the intergenic region between ilvD(Sm) and TRX1 was amplified from BP913 genomic DNA using primers N1110 and N1111 (SEQ ID Nos. 653 and 654). This was cloned into pUC19-URA3-MCS at the PmeI site, as follows. The ilvD-TRX1 PCR product was phosphorylated with polynucleotide kinase (NEB Cat. No. M0201), the vector was prepared by digesting with PmeI and treating with calf intestinal phosphatase, the two fragments were ligated overnight and cloned into *E. coli* Stbl3 cells. Clones were screened by PCR (using N1110 and N1111 primers) and then digested with BsgI to determine the orientation of the ilvD-TRX1 insertion. One clone from each orientation (pUC19-URA3::ilvD-TRX1 A and B) was carried over to the next step: addition of the xpk1/eutD expression cassette. The xpk1/eutD expression cassette from pRS426::GPD-xpk1+ADH1-eutD was obtained by digestion with B gill and EcoRV. The 5' overhanging DNA was filled in using Klenow Fragment. pUC19-URA3::ilvD-TRX1 was linearized with AflII and the 5' overhanging DNA was filled in using Klenow fragment. This vector was then ligated with the prepared xpk1/eutD cassette. Ligation reactions were transformed into *E. coli* Stbl3 cells. Clones were screened using primers for eutD (N1041 and N1042) and then digested with BamHI to determine orientation of the xpk1/eutD cassette relative to the ilvD-TRX1 DNA sequence.

The URA3 marker gene was then replaced with a geneticin resistance marker as follows. A chimeric geneticin resistance gene was constructed that contained the *Kluyveromyces lactis* TEF1 promoter and terminator (TEF1p-kan-TEF1t gene, provided as SEQ ID No. 655). This gene was maintained in a pUC19 vector (cloned at the SmaI site). The kan gene was isolated from pUC19 by first digesting with KpnI, removal of 3' overhanging DNA using Klenow Fragment (NEB, Cat. No. M212), digesting with HincII and then gel purifying the 1.8 kb gene fragment (Zymoclean™ Gel DNA Recovery Kit, Cat. No. D4001, Zymo Research, Orange, Calif.). The URA3 marker was removed from pUC19-URA3::ilvD::GPD-xpk1+ADH1-eutD::TRX1 (paragraph above) using NsiI and NaeI (the 3' overhanging DNA from NsiI digestion was removed with Klenow fragment). The vector and kan gene were ligated overnight and transformed into *E. coli* Stbl3 cells. Clones were screened by PCR using primers BK468 and either N1090 or N1113 (SEQ ID Nos. 656, 657, and 658, respectively)—positive PCR results indicate presence and orientation of kan gene. Clones in both orientations were digested with PmeI and transformed into BP913 with selection on yeast extract-peptone medium supplied with 1% (v/v) ethanol as carbon source and 200 μg/ml geneticin (G418). A single transformant was obtained, as confirmed by PCR (primers N886 and oBP264 for the 5' end N1090 and oBP512 for the 3' end, SEQ ID Nos. 659, 646, 657, and 660, respectively). FIG. 6 depicts the locus after integration of the plasmid.

Example 9

Construction of an Isobutanol-Producing Strain Carrying the Phosphoketolase Pathway The strain described in Example 8 was transformed with 2 plasmids containing genes for an isobutanol pathway pYZ090 and pYZ067 (SEQ ID NOs: 1892 and 1891).

pYZ090 was constructed to contain a chimeric gene having the coding region of the alsS gene from *Bacillus subtilis* (nt position 457-2172) expressed from the yeast CUP1 promoter (nt 2-449) and followed by the CYC1 terminator (nt 2181-2430) for expression of ALS, and a chimeric gene having the coding region of the ilvC gene from *Lactococcus lactis* (nt 3634-4656) expressed from the yeast ILV5 promoter (2433-3626) and followed by the ILV5 terminator (nt 4682-5304) for expression of KARI.

pYZ067 was constructed to contain the following chimeric genes: 1) the coding region of the ilvD gene from *S. mutans* UA159 with a C-terminal Lumio tag (nt 2260-3972) expressed from the yeast FBA1 promoter (nt 1661-2250) followed by the FBA1 terminator (nt 40005-4317) for expression of dihydroxy acid dehydratase, 2) the coding region for horse liver ADH (nt 4680-5807) expressed from the yeast GPM1 promoter (nt 5819-6575) followed by the ADH1 terminator (nt 4356-4671) for expression of alcohol dehydrogenase, and 3) the coding region of the kivD gene from *Lactococcus lactis* (nt 7175-8821) expressed from the yeast TDH3 promoter (nt 8830-9493) followed by the TDH3 terminator (nt 6582-7161) for expression of ketoisovalerate decarboxylase.

Transformants were obtained on synthetic complete medium lacking uracil and histidine with 1% (v/v) ethanol as carbon source and 100 μg/ml geneticin. Control strains (BP913) were also transformed with the same plasmids and plated without geneticin. A number of transformants were then patched to the same medium containing 2% glucose as carbon source and supplemented with 0.05% (v/v) ethanol. After 36 hours, patches were used to inoculate liquid medium (same composition as the plates). After 48 hours, ODs for both phosphoketolase pathway and control strains were similar (ca. 4-50D) and all were subcultured into medium lacking ethanol (i.e. no exogenous two-carbon substrate source). The phosphoketolase cultures grew without ethanol supplementation, similar to ethanol supplemented control strains. Results are shown in FIG. 7A (and Table 17A). These were subcultured again to confirm growth rates, and results are shown in FIG. 7B (and Table 17B). Phosphoketolase strains appeared to have a decreased lag phase compared to controls, but the exponential growth rates were not statistically different (average rate of 0.16 $h^{-1}$).

TABLE 17A

| | Condition | |
|---|---|---|
| Strain | 0 h OD | 18.3 h OD |
| xpk ISO 1 | 0.1 | 2.3 |
| xpk ISO 2 | 0.1 | 2.2 |
| xpk ISO 3 | 0.1 | 2.2 |
| ISO (no EtOH) 1 | 0.1 | 0.48 |
| ISO (no EtOH) 2 | 0.1 | 0.41 |
| ISO (no EtOH) 3 | 0.1 | 0.47 |
| ISO (+EtOH) 1 | 0.1 | 2.5 |
| ISO (+EtOH) 2 | 0.1 | 2.6 |
| ISO (+EtOH) 3 | 0.1 | 2.4 |

TABLE 17B

| | Condition | | | | |
|---|---|---|---|---|---|
| Strain | 0 h OD | 6.5 h OD | 23 h OD | 27 h OD | 48 h OD |
| xpk ISO 1 | 0.1 | 0.18 | 2.91 | 4 | 4.4 |
| xpk ISO 2 | 0.1 | 0.14 | 1.54 | 2.88 | 4.6 |
| xpk ISO 3 | 0.1 | 0.16 | 2.15 | 3.54 | 4.3 |
| ISO (+EtOH) 1 | 0.1 | 0.14 | 2.21 | 3.46 | 4.4 |
| ISO (+EtOH) 2 | 0.1 | 0.11 | 1.13 | 2.18 | 4.2 |
| ISO (+EtOH) 3 | 0.1 | 0.1 | 0.84 | 1.6 | 4.4 |

Example 10

Construction of *Saccharomyces cerevisiae* Strain BP913

The purpose of this example is to describe the construction of *Saccharomyces cerevisiae* strain BP913. The strain was derived from CEN.PK 113-7D (CBS 8340; Centraalbureau voor Schimmelcultures (CBS) Fungal Biodiversity Centre, Netherlands) and contains deletions of the following genes: URA3, HIS3, PDC1, PDC5, and PDC6.

Deletions, which completely removed the entire coding sequence, were created by homologous recombination with PCR fragments containing regions of homology upstream and downstream of the target gene and either a G418 resistance marker or URA3 gene for selection of transformants. The G418 resistance marker, flanked by loxP sites, was removed using Cre recombinase. The URA3 gene was removed by homologous recombination to create a scarless deletion.

In general, the PCR cassette for each scarless deletion was made by combining four fragments, A-B-U-C, by overlapping PCR. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene). Fragments A and C, each 500 bp long, corresponded to the 500 bp immediately upstream of the target gene (Fragment A) and the 3' 500 bp of the target gene (Fragment C). Fragments A and C were used for integration of the cassette into the chromosome by homologous recombination. Fragment B (500 bp long) corresponded to the 500 bp immediately downstream of the target gene and was used for excision of the URA3 marker and Fragment C from the chromosome by homologous recombination, as a direct repeat of the sequence corresponding to Fragment B was created upon integration of the cassette into the chromosome. Using the PCR product ABUC cassette, the URA3 marker was first integrated into and then excised from the chromosome by homologous recombination. The initial integration deleted the gene, excluding the 3' 500 bp. Upon excision, the 3' 500 bp region of the gene was also deleted. For integration of genes using this method, the gene to be integrated was included in the PCR cassette between fragments A and B.

URA3 Deletion

To delete the endogenous URA3 coding region, a ura3::loxP-kanMX-loxP cassette was PCR-amplified from pLA54 template DNA (SEQ ID NO: 661). pLA54 contains the *K. lactis* TEF 1 promoter and kanMX marker, and is flanked by loxP sites to allow recombination with Cre recombinase and removal of the marker. PCR was done using Phusion DNA polymerase and primers BK505 and BK506 (SEQ ID NOs: 662 and 663). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (Methods in Yeast Genetics, 2005, Cold Spring Harbor Laboratory Press, Cold Spring Harbor, N.Y., pp. 201-202) and transformants were selected on YPD containing G418 (100 μg/ml) at 30 C. Transformants were screened to verify correct integration by PCR using primers LA468 and LA492 (SEQ ID NOs:664 and 665) and designated CEN.PK 113-7D Δura3::kanMX.

HIS3 Deletion

The four fragments for the PCR cassette for the scarless HIS3 deletion were amplified using Phusion High Fidelity PCR Master Mix (New England BioLabs) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO: 666) and primer oBP453 (SEQ ID NO: 667), containing a 5' tail with homology to the 5' end of HIS3 Fragment B. HIS3 Fragment B was amplified with primer oBP454 (SEQ ID NO: 668), containing a 5' tail with homology to the 3' end of HIS3 Fragment A, and primer oBP455 (SEQ ID NO: 669), containing a 5' tail with homology to the 5' end of HIS3 Fragment U. HIS3 Fragment U was amplified with primer oBP456 (SEQ ID NO: 670), containing a 5' tail with homology to the 3' end of HIS3 Fragment B, and primer oBP457 (SEQ ID NO: 671), containing a 5' tail with homology to the 5' end of HIS3 Fragment C. HIS3 Fragment C was amplified with primer oBP458 (SEQ ID NO: 672), containing a 5' tail with homology to the 3' end of HIS3 Fragment U, and primer oBP459 (SEQ ID NO: 673). PCR products were purified with a PCR Purification kit (Qiagen, Valencia, Calif.). HIS3 Fragment AB was created by overlapping PCR by mixing HIS3 Fragment A and HIS3 Fragment B and amplifying with primers oBP452 (SEQ ID NO: 666) and oBP455 (SEQ ID NO: 669). HIS3 Fragment UC was created by overlapping PCR by mixing HIS3 Fragment U and HIS3 Fragment C and amplifying with primers oBP456 (SEQ ID NO: 670) and oBP459 (SEQ ID NO: 673). The resulting PCR products were purified on an agarose gel followed by a Gel Extraction kit (Qiagen, Valencia, Calif.). The HIS3 ABUC cassette was created by overlapping PCR by mixing HIS3 Fragment AB and HIS3 Fragment UC and amplifying with primers oBP452 (SEQ ID NO: 666) and oBP459 (SEQ ID NO: 673). The PCR product was purified with a PCR Purification kit (Qiagen, Valencia, Calif.).

Competent cells of CEN.PK 113-7D Δura3::kanMX were made and transformed with the HIS3 ABUC PCR cassette using a Frozen-EZ Yeast Transformation II kit (Zymo Research, Orange, Calif.). Transformation mixtures were plated on synthetic complete media lacking uracil supplemented with 2% glucose at 30 C. Transformants with a his3 knockout were screened for by PCR with primers oBP460 (SEQ ID NO: 674) and oBP461 (SEQ ID NO: 671) using genomic DNA prepared with a Gentra Puregene Yeast/Bact kit (Qiagen). A correct transformant was selected as strain CEN.PK 113-7D Δura3::kanMX Δhis3::URA3.

KanMX Marker Removal from the Δura3 Site and URA3 Marker Removal from the Δhis3 Site The KanMX marker was removed by transforming CEN.PK 113-7D Δura3::kanMX Δhis3::URA3 with pRS423::PGAL1-cre (SEQ ID NO: 715) using a Frozen-EZ Yeast Transformation II kit (Zymo Research, Orange, Calif.) and plating on synthetic complete medium lacking histidine and uracil supplemented with 2% glucose at 30 C. Transformants were grown in YP supplemented with 1% galactose at 30 C for ~6 hours to induce the Cre recombinase and KanMX marker excision and plated onto YPD (2% glucose) plates at 30 C for recovery. An isolate was grown overnight in YPD and plated on synthetic complete medium containing 5-fluoro-orotic acid (0.1%) at 30 C to select for isolates that lost the URA3 marker. 5-FOA resistant isolates were grown in and plated on YPD for removal of the pRS423::PGAL1-cre plasmid. Isolates were checked for loss of the KanMX marker, URA3 marker, and pRS423::PGAL1-cre plasmid by assaying growth on YPD+G418 plates, synthetic complete medium lacking uracil plates, and synthetic complete medium lacking histidine plates. A correct isolate that was sensitive to G418 and auxotrophic for uracil and histidine was selected as strain CEN.PK 113-7D Δura3::loxP Δhis3 and designated as BP857. The deletions and marker removal were confirmed by PCR and sequencing with primers oBP450 (SEQ ID NO: 676) and oBP451 (SEQ ID NO: 677) for Δura3 and primers oBP460 (SEQ ID NO: 674) and oBP461 (SEQ ID NO: 675) for Δhis3 using genomic DNA prepared with a Gentra Puregene Yeast/Bact kit (Qiagen, Valencia, Calif.).

PDC6 Deletion

The four fragments for the PCR cassette for the scarless PDC6 deletion were amplified using Phusion High Fidelity PCR Master Mix (New England BioLabs, Ipswich, Mass.) and CEN.PK 113-7D genomic DNA as template, prepared with a Gentra Puregene Yeast/Bact kit (Qiagen). PDC6 Fragment A was amplified with primer oBP440 (SEQ ID NO: 670) and primer oBP441 (SEQ ID NO: 679), containing a 5' tail with homology to the 5' end of PDC6 Fragment B. PDC6 Fragment B was amplified with primer oBP442 (SEQ ID NO: 680), containing a 5' tail with homology to the 3' end of PDC6 Fragment A, and primer oBP443 (SEQ ID NO: 681), containing a 5' tail with homology to the 5' end of PDC6 Fragment U. PDC6 Fragment U was amplified with primer oBP444 (SEQ ID NO: 682), containing a 5' tail with homology to the 3' end of PDC6 Fragment B, and primer oBP445 (SEQ ID NO: 683), containing a 5' tail with homology to the 5' end of PDC6 Fragment C. PDC6 Fragment C was amplified with primer oBP446 (SEQ ID NO: 684), containing a 5' tail with homology to the 3' end of PDC6 Fragment U, and primer oBP447 (SEQ ID NO: 685). PCR products were purified with a PCR Purification kit (Qiagen). PDC6 Fragment AB was created by overlapping PCR by mixing PDC6 Fragment A and PDC6 Fragment B and amplifying with primers oBP440 (SEQ ID NO: 678) and oBP443 (SEQ ID NO: 681). PDC6 Fragment UC was created by overlapping PCR by mixing PDC6 Fragment U and PDC6 Fragment C and amplifying with primers oBP444 (SEQ ID NO: 682) and oBP447 (SEQ ID NO: 685). The resulting PCR products were purified on an agarose gel followed by a Gel Extraction kit (Qiagen). The PDC6 ABUC cassette was created by overlapping PCR by mixing PDC6 Fragment AB and PDC6 Fragment UC and amplifying with primers oBP440 (SEQ ID NO: 678) and oBP447 (SEQ ID NO: 685). The PCR product was purified with a PCR Purification kit (Qiagen).

Competent cells of CEN.PK 113-7D Δura3::loxP Δhis3 were made and transformed with the PDC6 ABUC PCR cassette using a Frozen-EZ Yeast Transformation II kit (Zymo Research). Transformation mixtures were plated on synthetic complete media lacking uracil supplemented with 2% glucose at 30 C. Transformants with a pdc6 knockout were screened for by PCR with primers oBP448 (SEQ ID NO: 686) and oBP449 (SEQ ID NO: 687) using genomic DNA prepared with a Gentra Puregene Yeast/Bact kit (Qiagen). A correct transformant was selected as strain CEN.PK 113-7D Δura3::loxP Δhis3 Δpdc6::URA3.

CEN.PK 113-7D Δura3::loxP Δhis3 Δpdc6::URA3 was grown overnight in YPD and plated on synthetic complete medium containing 5-fluoro-orotic acid (0.1%) at 30 C to select for isolates that lost the URA3 marker. The deletion and marker removal were confirmed by PCR and sequencing with primers oBP448 (SEQ ID NO: 686) and oBP449 (SEQ ID NO: 687) using genomic DNA prepared with a Gentra Puregene Yeast/Bact kit (Qiagen). The absence of the PDC6 gene from the isolate was demonstrated by a negative PCR result using primers specific for the coding sequence of PDC6, oBP554 (SEQ ID NO: 688) and oBP555 (SEQ ID NO: 689). The correct isolate was selected as strain CEN.PK 113-7D Δura3::loxP Δhis3 Δpdc6 and designated as BP891.

PDC1 Deletion ilvDSm Integration

The PDC1 gene was deleted and replaced with the ilvD coding region from *Streptococcus mutans* ATCC #700610 (SEQ ID NO: 1886). The A fragment followed by the ilvD coding region from *Streptococcus mutans* for the PCR cassette for the PDC 1 deletion-ilvDSm integration was amplified using Phusion High Fidelity PCR Master Mix (New England BioLabs) and NYLA83 genomic DNA as template (construction of strain NYLA83 is described in U.S. Application Pub. No. 20110124060 A1, incorporated herein by reference), prepared with a Gentra Puregene Yeast/Bact kit (Qiagen). PDC1 Fragment A-ilvDSm was amplified with primer oBP513 (SEQ ID NO: 690) and primer oBP515 (SEQ ID NO: 691), containing a 5' tail with homology to the 5' end of PDC1 Fragment B. The B, U, and C fragments for the PCR cassette for the PDC1 deletion-ilvDSm integration were amplified using Phusion High Fidelity PCR Master Mix (New England BioLabs) and CEN.PK 113-7D genomic DNA as template, prepared with a Gentra Puregene Yeast/Bact kit (Qiagen). PDC1 Fragment B was amplified with primer oBP516 (SEQ ID NO: 692), containing a 5' tail with homology to the 3' end of PDC1 Fragment A-ilvDSm, and primer oBP517 (SEQ ID NO: 693), containing a 5' tail with homology to the 5' end of PDC1 Fragment U. PDC1 Fragment U was amplified with primer oBP518 (SEQ ID NO: 694), containing a 5' tail with homology to the 3' end of PDC1 Fragment B, and primer oBP519 (SEQ ID NO: 695), containing a 5' tail with homology to the 5' end of PDC1 Fragment C. PDC1 Fragment C was amplified with primer oBP520 (SEQ ID NO: 696), containing a 5' tail with homology to the 3' end of PDC1 Fragment U, and primer oBP521 (SEQ ID NO: 697). PCR products were purified with a PCR Purification kit (Qiagen). PDC1 Fragment A-ilvDSm-B was created by overlapping PCR by mixing PDC1 Fragment A-ilvDSm and PDC1 Fragment B and amplifying with primers oBP513 (SEQ ID NO: 690) and oBP517 (SEQ ID NO: 693). PDC1 Fragment UC was created by overlapping PCR by mixing PDC1 Fragment U and PDC1 Fragment C and amplifying with primers oBP518 (SEQ ID NO: 694) and oBP521 (SEQ ID NO: 697). The resulting PCR products were purified on an agarose gel followed by a Gel Extraction kit (Qiagen). The PDC1 A-ilvDSm-BUC cassette was created by overlapping PCR by mixing PDC1 Fragment A-ilvDSm-B and PDC1 Fragment UC and amplifying with primers oBP513 (SEQ ID NO: 690) and oBP521 (SEQ ID NO: 697). The PCR product was purified with a PCR Purification kit (Qiagen).

Competent cells of CEN.PK 113-7D Δura3::loxP Δhis3 Δpdc6 were made and transformed with the PDC1 A-ilvDSm-BUC PCR cassette using a Frozen-EZ Yeast Transformation II kit (Zymo Research). Transformation mixtures were plated on synthetic complete media lacking uracil supplemented with 2% glucose at 30 C. Transformants with a pdc1 knockout ilvDSm integration were screened for by PCR with primers oBP511 (SEQ ID NO: 698) and oBP512 (SEQ ID NO: 699) using genomic DNA prepared with a Gentra Puregene Yeast/Bact kit (Qiagen). The absence of the PDC1 gene from the isolate was demonstrated by a negative PCR result using primers specific for the coding sequence of PDC1, oBP550 (SEQ ID NO: 700) and oBP551 (SEQ ID NO: 701). A correct transformant was selected as strain CEN.PK 113-7D Δura3::loxP Δhis3 Δpdc6 Δpdc1::ilvDSm-URA3.

CEN.PK 113-7D Δura3::loxP Δhis3 Δpdc6 Δpdc1::ilvDSm-URA3 was grown overnight in YPD and plated on synthetic complete medium containing 5-fluoro-orotic acid (0.1%) at 30 C to select for isolates that lost the URA3 marker. The deletion of PDC1, integration of ilvDSm, and marker removal were confirmed by PCR and sequencing with primers oBP511 (SEQ ID NO: 698) and oBP512 (SEQ ID NO: 699) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm and designated as BP907.

PDC5 Deletion sadB Integration

The PDC5 gene was deleted and replaced with the sadB coding region from *Achromobacter xylosoxidans*. A segment of the PCR cassette for the PDC5 deletion-sadB integration was first cloned into plasmid pUC19-URA3MCS (described in Example 2). The coding sequence of sadB (SEQ ID NO: 718) and PDC5 Fragment B were cloned into pUC19-URA3MCS to create the sadB-BU portion of the PDC5 A-sadB-BUC PCR cassette. The coding sequence of sadB was amplified using pLH468-sadB (SEQ ID NO: 716) as template with primer oBP530 (SEQ ID NO: 702), containing an AscI restriction site, and primer oBP531 (SEQ ID NO: 703), containing a 5' tail with homology to the 5' end of PDC5 Fragment B. PDC5 Fragment B was amplified from CEN.PK 113-7D genomic DNA with primer oBP532 (SEQ ID NO: 704), containing a 5' tail with homology to the 3' end of sadB, and primer oBP533 (SEQ ID NO: 705), containing a PmeI restriction site. PCR products were purified with a PCR Purification kit (Qiagen). sadB-PDC5 Fragment B was created by overlapping PCR by mixing the sadB and PDC5 Fragment B PCR products and amplifying with primers oBP530 (SEQ ID NO: 702) and oBP533 (SEQ ID NO: 705). The resulting PCR product was digested with AscI and PmeI and ligated with T4 DNA ligase into the corresponding sites of pUC19-URA3MCS after digestion with the appropriate enzymes. The resulting plasmid was used as a template for amplification of sadB-Fragment B-Fragment U using primers oBP536 (SEQ ID NO: 706) and oBP546 (SEQ ID NO: 707), containing a 5' tail with homology to the 5' end of PDC5 Fragment C. PDC5 Fragment C was amplified from CEN.PK 113-7D genomic DNA with primer oBP547 (SEQ ID NO: 708), containing a 5' tail with homology to the 3' end of PDC5 sadB-Fragment B-Fragment U, and primer oBP539 (SEQ ID NO: 709). PCR products were purified with a PCR Purification kit (Qiagen). PDC5 sadB-Fragment B-Fragment U-Fragment C was created by overlapping PCR by mixing PDC5 sadB-Fragment B-Fragment U and PDC5 Fragment C and amplifying with primers oBP536 (SEQ ID NO: 706) and oBP539 (SEQ ID NO: 709). The resulting PCR product was purified on an agarose gel followed by a Gel Extraction kit (Qiagen). The PDC5 A-sadB-BUC cassette was created by amplifying PDC5 sadB-Fragment B-Fragment U-Fragment C with primers oBP542 (SEQ ID NO: 710) containing a 5' tail with homology to the 50 nucleotides immediately upstream of the native PDC5 coding sequence, and oBP539 (SEQ ID NO: 709). The PCR product was purified with a PCR Purification kit (Qiagen).

Competent cells of CEN.PK 113-7D Δura3::loxP Δhis3 Δpdc6 Δpdc1::ilvDSm were made and transformed with the PDC5 A-sadB-BUC PCR cassette using a Frozen-EZ Yeast Transformation II kit (Zymo Research). Transformation mixtures were plated on synthetic complete media lacking uracil supplemented with 1% ethanol (no glucose) at 30 C. Transformants with a pdc5 knockout sadB integration were screened for by PCR with primers oBP540 (SEQ ID NO: 711) and oBP541 (SEQ ID NO: 712) using genomic DNA prepared with a Gentra Puregene Yeast/Bact kit (Qiagen). The absence of the PDC5 gene from the isolate was demonstrated by a negative PCR result using primers specific for the coding sequence of PDC5, oBP552 (SEQ ID NO: 713) and oBP553 (SEQ ID NO: 714). A correct transformant was selected as strain CEN.PK 113-7D Δura3::loxP Δhis3 Δpdc6 Δpdc1::ilvDSm Δpdc5::sadB-URA3.

CEN.PK 113-7D Δura3::loxP Δhis3 Δpdc6 Δpdc1::ilvDSm Δpdc5::sadB-URA3 was grown overnight in YPE (1% ethanol) and plated on synthetic complete medium supplemented with ethanol (no glucose) and containing 5-fluoro-orotic acid (0.1%) at 30 C to select for isolates that lost the URA3 marker. The deletion of PDC5, integration of sadB, and marker removal were confirmed by PCR with primers oBP540 (SEQ ID NO: 711) and oBP541 (SEQ ID NO: 712) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm Δpdc5::sadB and designated as BP913.

Example 11

Construction of Strain NYLA83

This example describes insertion-inactivation of endogenous PDC1 and PDC6 genes of *S. cerevisiae*. PDC1, PDC5, and PDC6 genes encode the three major isozymes of pyruvate decarboxylase. The resulting strain was used as described in Example 10.

Construction of pRS425::GPM-sadB

A DNA fragment encoding a butanol dehydrogenase (SEQ ID NO: 717) from *Achromobacter xylosoxidans* (disclosed in US Patent Application Publication No. US20090269823) was cloned. The coding region of this gene called sadB for secondary alcohol dehydrogenase (SEQ ID NO: 718) was amplified using standard conditions from *A. xylosoxidans* genomic DNA, prepared using a Gentra Puregene kit (Gentra Systems, Inc., Minneapolis, Minn.; catalog number D-5500A) following the recommended protocol for gram negative organisms using forward and reverse primers N473 and N469 (SEQ ID NOs:725 and 726), respectively. The PCR product was TOPO-Blunt cloned into pCR4 BLUNT (Invitrogen) to produce pCR4Blunt::sadB, which was transformed into *E. coli* Mach-1 cells. Plasmid was subsequently isolated from four clones, and the sequence verified.

The sadB coding region was PCR amplified from pCR4Blunt::sadB. PCR primers contained additional 5' sequences that would overlap with the yeast GPM1 promoter and the ADH1 terminator (N583 and N584, provided as SEQ ID NOs:727 and 728). The PCR product was then cloned using "gap repair" methodology in *Saccharomyces cerevisiae* (Ma et al. ibid) as follows. The yeast-*E. coli* shuttle vector pRS425::GPM::kivD::ADH which contains the GPM1 promoter (SEQ ID NO:721), kivD coding region from *Lactococcus lactis* (SEQ D NO:719), and ADH1 terminator (SEQ ID NO:722) (described in U.S. Pat. No. 7,851,188, Example 17) was digested with BbvCI and Pad restriction enzymes to release the kivD coding region. Approximately 1 μg of the remaining vector fragment was transformed into *S. cerevisiae* strain BY4741 along with 1 μg of sadB PCR product. Transformants were selected on synthetic complete medium lacking leucine. The proper recombination event, generating pRS425::GPM-sadB, was confirmed by PCR using primers N142 and N459 (SEQ ID NOs:729 and 730).

Construction of pdc6:: $P_{GPM1}$-sadB Integration Cassette and PDC6 Deletion:

A pdc6::$P_{GPM1}$-sadB-ADH1t-URA3r integration cassette was made by joining the GPM-sadB-ADHt segment (SEQ ID NO:723) from pRS425::GPM-sadB (SEQ ID NO: 720) to the URA3r gene from pUC19-URA3r. pUC19-URA3r (SEQ ID NO:724) contains the URA3 marker from pRS426 (ATCC #77107) flanked by 75 bp homologous repeat sequences to allow homologous recombination in vivo and removal of the URA3 marker. The two DNA segments were joined by SOE PCR (as described by Horton et al. (1989) Gene 77:61-68) using as template pRS425::GPM-sadB and pUC19-URA3r plasmid DNAs, with Phusion DNA polymerase (New England Biolabs Inc., Beverly, Mass.; catalog no. F-5405) and primers 114117-11A through 114117-11D (SEQ ID NOs:731, 732, 733 and 734), and 114117-13A and 114117-13B (SEQ ID NOs:735 and 736).

The outer primers for the SOE PCR (114117-13A and 114117-13B) contained 5' and 3' ~50 bp regions homologous to regions upstream and downstream of the PDC6 promoter and terminator, respectively. The completed cassette PCR fragment was transformed into BY4700 (ATCC #200866) and transformants were maintained on synthetic complete media lacking uracil and supplemented with 2% glucose at 30° C. using standard genetic techniques (*Methods in Yeast Genetics,* 2005, Cold Spring Harbor Laboratory Press, Cold Spring Harbor, N.Y., pp. 201-202). Transformants were screened by PCR using primers 112590-34G and 112590-34H (SEQ ID NOs:737 and 738), and 112590-34F and 112590-49E (SEQ ID NOs: 739 and 740) to verify integration at the PDC6 locus with deletion of the PDC6 coding region. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain has the genotype: BY4700 pdc6::$P_{GPM1}$-sadB-ADH1t.

Construction of pdc1::$P_{PDC1}$-ilvD Integration Cassette and PDC1 Deletion:

A pdc1:: $P_{PDC1}$-ilvD-FBA1t-URA3r integration cassette was made by joining the ilvD-FBA1t segment (SEQ ID NO:741) from pLH468 (SEQ ID NO: 1888) to the URA3r gene from pUC19-URA3r by SOE PCR (as described by Horton et al. (1989) Gene 77:61-68) using as template pLH468 and pUC19-URA3r plasmid DNAs, with Phusion DNA polymerase (New England Biolabs Inc., Beverly, Mass.; catalog no. F-540S) and primers 114117-27A through 114117-27D (SEQ ID NOs:742, 743, 744 and 745).

The outer primers for the SOE PCR (114117-27A and 114117-27D) contained 5' and 3' ~50 bp regions homologous to regions downstream of the PDC1 promoter and downstream of the PDC1 coding sequence. The completed cassette PCR fragment was transformed into BY4700 pdc6::$P_{GPM1}$-sadB-ADH1t and transformants were maintained on synthetic complete media lacking uracil and supplemented with 2% glucose at 30° C. using standard genetic techniques (*Methods in Yeast Genetics,* 2005, Cold Spring Harbor Laboratory Press, Cold Spring Harbor, N.Y., pp. 201-202). Transformants were screened by PCR using primers 114117-36D and 135 (SEQ ID NOs 746 and 747), and primers 112590-

49E and 112590-30F (SEQ ID NOs 740 and 748) to verify integration at the PDC1 locus with deletion of the PDC1 coding sequence. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain "NYLA67" has the genotype: BY4700 pdc6:: $P_{GPM1}$-sadB-ADH1t pdc1::_$P_{PDC1}$-ilvD-FBA1t.

HIS3 Deletion

To delete the endogenous HIS3 coding region, a his3::URA3r2 cassette was PCR-amplified from URA3r2 template DNA (SEQ ID NO: 749). URA3r2 contains the URA3 marker from pRS426 (ATCC #77107) flanked by 500 bp homologous repeat sequences to allow homologous recombination in vivo and removal of the URA3 marker. PCR was done using Phusion DNA polymerase and primers 114117-45A and 114117-45B (SEQ ID NOs:750 and 751) which generated a ~2.3 kb PCR product. The HIS3 portion of each primer was derived from the 5' region upstream of the HIS3 promoter and 3' region downstream of the coding region such that integration of the URA3r2 marker results in replacement of the HIS3 coding region. The PCR product was transformed into NYLA67 using standard genetic techniques (*Methods in Yeast Genetics,* 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened to verify correct integration by replica plating of transformants onto synthetic complete media lacking histidine and supplemented with 2% glucose at 30° C. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain, called NYLA73, has the genotype: BY4700 pdc6:: $P_{GPM1}$-sadB-ADH1t pdc1:: $P_{PDC1}$-ilvD-FBA1t Δhis3.

Construction of pdc5::kanMX Integration Cassette and PDC5 Deletion:

A pdc5::kanMX4 cassette was PCR-amplified from strain YLR134W chromosomal DNA (ATCC No. 4034091) using Phusion DNA polymerase and primers PDC5::KanMXF and PDC5::KanMXR (SEQ ID NOs:752 and 753) which generated a ~2.2 kb PCR product. The PDC5 portion of each primer was derived from the 5' region upstream of the PDC5 promoter and 3' region downstream of the coding region such that integration of the kanMX4 marker results in replacement of the PDC5 coding region. The PCR product was transformed into NYLA73 using standard genetic techniques (*Methods in Yeast Genetics,* 2005, Cold Spring Harbor Laboratory Press, Cold Spring Harbor, N.Y., pp. 201-202) and transformants were selected on YP media supplemented with 1% ethanol and geneticin (200 μg/ml) at 30° C. Transformants were screened by PCR to verify correct integration at the PDC locus with replacement of the PDC5 coding region using primers PDC5kofor and N175 (SEQ ID NOs: 754 and 755). The identified correct transformants have the genotype: BY4700 pdc6:: $P_{GPM1}$-sadB-ADH1t pdc1:: $P_{PDC1}$-ilvD-FBA1t Δhis3 pdc5::kanMX4. The strain was named NYLA74.

Deletion of HXK2 (Hexokinase II):

A hxk2::URA3r cassette was PCR-amplified from URA3r2 template (described above) using Phusion DNA polymerase and primers 384 and 385 (SEQ ID NOs:756 and 757) which generated a ~2.3 kb PCR product. The HXK2 portion of each primer was derived from the 5' region upstream of the HXK2 promoter and 3' region downstream of the coding region such that integration of the URA3r2 marker results in replacement of the HXK2 coding region. The PCR product was transformed into NYLA73 using standard genetic techniques (Methods in Yeast Genetics, 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened by PCR to verify correct integration at the HXK2 locus with replacement of the HXK2 coding region using primers N869 and N871 (SEQ ID NOs:758 and 759). The URA3r2 marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth, and by PCR to verify correct marker removal using primers N946 and N947 (SEQ ID NOs:760 and 761). The resulting identified strain named NYLA83 has the genotype: BY4700 pdc6:: $P_{GPM1}$-sadB-ADH1t pdc1:: $P_{PDC1}$-ilvD-FBA1t Δhis3 Δhxk2.

Example 12

Construction of *Saccharomyces cerevisiae* Strain PNY2257

Strain PNY2242 was constructed in several steps from BP913 (described above). First, the native GPD2 gene on Chromsome XV was deleted. The coding region was deleted using CRE-lox mediated marker removal (methodology described above), so the resulting locus contains one loxP site. The sequence of the modified locus is provided as SEQ ID NO: 1899 (Upstream region=nt 1-500; loxP site=nt 531-564; Downstream region=nt 616-1115). Second, the native FRA2 gene on Chromosome VII was deleted. Elimination of FRA2 was a scarless deletion of only the coding region. The sequence of the modified locus is provided as SEQ ID NO: 1900 (Upstream region=nt 1-501; Downstream region=nt 526-1025). Next, the ADH1 gene on Chromosome XV was deleted along with insertion of a chimeric gene comprised of the UAS(PGK1)—FBA1 promoter and the kivD coding region. The native ADH1 terminator was used to complete the gene. The sequence of the modified locus is provided as SEQ ID No. 1901 (Upstream region=nt 1-500; UAS(PGK1)FBA promoter=nt 509-1233; kivD coding region=nt 1242-2888; Downstream region (includes terminator)=nt 2889-3388). Next, a chimeric gene comprised of the FBA1 promoter, the alsS coding region and the CYC1 terminator was integrated into Chromosome XII, upstream of the TRX1 gene. The sequence of the modified locus is provided as SEQ ID No. 1902(Upstream region=nt 1-154; FBA1 promoter=nt 155-802; alsS CDS=nt 810-2525; CYC1 terminator=nt 2534-2788; Downstream region=nt 2790-3015). Next, two copies of a gene encoding horse liver alcohol dehydrogenase were integrated into Chromsomes VII and XVI. On Chromosome VII, a chimeric gene comprised of the PDC1 promoter, the hADH coding region and the ADH1 terminator were placed into the fra2Δ locus (the original deletion of FRA2 is described above). The sequence of the modified locus is provided as SEQ ID No. 1903 (Upstream region=nt 1-300; PDC1 promoter=nt 309-1178; hADH coding region=nt 1179-2306; ADH1 terminator=nt 2315-2630; Downstream region=nt 2639-2900). On Chromosome XVI, a chimeric gene comprised of the PDC5 promoter, the hADH coding region and the ADH1 terminator were integrated in the region formerly occupied by the long term repeat element YPRCdelta15. The sequence of the modified locus is provided as SEQ ID No. 1904 (Upstream region=nt 1-150; PDC5 promoter=nt 159-696; hADH coding region=nt 697-1824; ADH1 terminator=nt 1833-2148; Downstream region=nt 2157-2656). Then the native genes YMR226c and ALD6 were deleted. Elimination of YMR226c was a scarless deletion of only the coding region. The sequence of the modified locus is provided as SEQ ID No. 1905 (Upstream region=nt 1-250; Downstream region=nt 251-451). The ALD6 coding region plus 700 bp of upstream sequence were deleted using CRE-lox mediated marker removal, so the resulting locus contains one loxP site. The sequence of the modified locus is provided as SEQ ID No. 1906(Upstream region=nt 1-500; loxP site=nt 551-584; Downstream region=nt 678-1128). The geneticin-selectable phosphoketolase expression vector described in Example 8 was transformed into the strain and confirmed as described above (the locus is depicted in FIG. 6). Finally, plasmids were introduced into the strain for expression of KARI (pLH702, plasmid SEQ ID. No. 1907) and DHAD (pYZ067DkivDDhADH, SEQ ID. No. 1908), resulting in the strain named PNY2257. A control strain containing all of the elements above except for the phosphoketolase pathway construct is called PNY2242.

Growth rates were assessed as described in previous examples. Over a 24 hour period, PNY2257 displayed growth rates without ethanol or other two-carbon supplement similar to those growth rates observed for PNY2242 with supplementation.

TABLE 6

HMMER2.0 [2.2 g]
NAME XFP_XPK_exp_seqs
LENG 845
ALPH Amino
RF no
CS no
MAP yes
COM/app/public/hmmer/current/bin/hmmbuild XFP_XPK_HMM XFP_XPK_exp_seqs.aln
COM/app/public/hmmer/current/bin/hmmcalibrate --mean 800 XFP_XPK_HMM
NSEQ 8
DATE Fri Dec. 4, 15:29:49 2009
CKSUM 6589
XT −8455 −4 −1000 −1000 −8455 −4 −8455 −4
NULT −4 −8455
NULE 595 −1558 85 338 −294 453 −1158 197 249 902 −1085 −142 −21 −313 45 531 201 384 −1998 −644
EVD −614.573792 0.077043

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | -476 | * | -1831 | | | | | | | | | | | | | | | | | | |
| 1(M) | -579 | -646 | -1823 | -1279 | -241 | -1949 | -816 | 340 | -991 | 1145 | 2778 | -1234 | 1286 | -828 | -1131 | -1025 | -537 | 205 | -1033 | -696 | 11 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -25 | -6428 | -7470 | -894 | -1115 | -701 | -1378 | * | * | | | | | | | | | | | | |
| 2(W) | -424 | -1143 | -649 | -112 | -1118 | -1430 | -73 | -944 | 1343 | -1091 | -364 | -285 | 1428 | 217 | 174 | -480 | -363 | -730 | 3083 | -756 | 12 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -25 | -6428 | -7470 | -894 | -1115 | -701 | -1378 | * | * | | | | | | | | | | | | |
| 3(O) | -411 | -1812 | 202 | 1278 | -2120 | 997 | 53 | -1844 | 1011 | -1806 | -940 | 170 | -1370 | 1483 | 39 | -277 | -358 | -1435 | -1985 | -1327 | 13 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -25 | -6428 | -7470 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 4(M) | -544 | -1770 | -500 | 1294 | -2084 | -1496 | -45 | -1741 | 1490 | -1726 | 2375 | -163 | -1571 | 384 | 1179 | -467 | -467 | -1393 | -1906 | -1358 | 14 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6836 | -7878 | -894 | -1115 | -701 | -1378 | * | * | | | | | | | | | | | | |
| 5(V) | 582 | -614 | -1167 | 546 | -657 | -1623 | -419 | -47 | -453 | 583 | 188 | -696 | -1707 | -324 | -741 | -630 | 773 | 1221 | -1069 | -649 | 15 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6836 | -7878 | -894 | -1115 | -701 | -1378 | * | * | | | | | | | | | | | | |
| 6(M) | -388 | -632 | 233 | -716 | -648 | -1697 | -471 | 1170 | -550 | -499 | 1779 | 218 | -1768 | -407 | -821 | -698 | 1278 | 799 | -1059 | -646 | 16 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 7(D) | 54 | -2137 | 2020 | 1380 | -2436 | -1385 | -196 | -2201 | 126 | -2144 | -1250 | 1219 | -1583 | 239 | 702 | -471 | -581 | -1750 | -2320 | -1600 | 17 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 8(Y) | -508 | -822 | -1280 | -702 | -673 | -1748 | -430 | 832 | -332 | -675 | -3 | -776 | 809 | -344 | 1190 | -762 | -446 | -274 | -1076 | 2458 | 18 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 9(D) | -469 | -1542 | 1605 | 42 | -1969 | -1375 | -320 | -1627 | -36 | -1747 | -919 | -219 | 1080 | 65 | -522 | 1153 | -479 | 670 | -2048 | -1444 | 19 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 10(S) | -586 | -1385 | -736 | -829 | -2829 | -1309 | -1317 | -2735 | -1241 | -2859 | -2047 | 1835 | -1910 | -1051 | -1602 | 2833 | -881 | -1997 | -2969 | -2410 | 20 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 11(P) | -526 | -1890 | -212 | 1174 | -2213 | -1420 | -120 | -1928 | 1548 | -1905 | -1024 | -80 | 1551 | 317 | -111 | -415 | 763 | -1521 | -2093 | -1450 | 21 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 12(D) | 1339 | -2192 | 1728 | 1307 | -2485 | -1404 | -248 | -2248 | 996 | -2199 | -1317 | -28 | -1622 | 180 | -495 | -529 | -648 | -1804 | -2382 | -1658 | 22 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 13(Y) | 984 | -983 | -1421 | -1092 | -837 | -1586 | -819 | -1015 | -973 | -1266 | -608 | -1029 | 1341 | -855 | -1218 | -770 | -660 | -790 | -1317 | 3268 | 23 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 14(L) | -877 | -775 | -2589 | -1991 | 1160 | -2382 | -1170 | 1029 | 960 | 1849 | 533 | -1790 | -2366 | -1386 | -1652 | -1454 | -810 | 77 | -1124 | -783 | 24 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 15(N) | -730 | -2232 | 123 | 1772 | -2530 | -1420 | -275 | -2293 | 34 | -2239 | -1364 | 1865 | 1127 | 1325 | -496 | -569 | -693 | -1850 | -2418 | -1697 | 25 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 16(S) | -406 | -1619 | -309 | 191 | -1903 | 406 | -102 | -1593 | 986 | -317 | -789 | 1064 | -1504 | 317 | -181 | 1301 | -358 | -1237 | -1903 | -1286 | 26 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7025 | -8067 | -894 | -1115 | -701 | -1378 | * | * | | | | | | | | | | | | |
| 17(M) | -675 | -566 | -2528 | -1928 | -364 | -2184 | 2126 | 218 | -1592 | 743 | 2772 | -1654 | -2210 | -1313 | -1560 | -1256 | -614 | 1711 | -990 | -635 | 27 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 18(D) | -749 | -1575 | 2786 | -299 | -2062 | -1566 | -768 | -1153 | -635 | -1769 | -1097 | -535 | -1902 | -450 | -1112 | -799 | 731 | 1070 | -2328 | -1751 | 28 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 19(K) | 1232 | -1674 | -736 | -295 | -2360 | -1534 | -473 | -2014 | 2326 | -2058 | -1228 | -486 | 1165 | -74 | -221 | -634 | -677 | -1596 | -2264 | -1735 | 29 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 20(Y) | -2075 | -2643 | 1686 | -985 | -266 | -2358 | -869 | -2644 | -1801 | -2467 | -2120 | -1177 | -2732 | -1384 | -2229 | -1931 | -2114 | -2488 | -905 | 4141 | 30 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 21(W) | -2473 | -2122 | -3795 | -3534 | 136 | -3469 | -1296 | -944 | -2887 | 1176 | -449 | -2889 | -3469 | -2568 | -2708 | -2895 | -2429 | -1317 | 5419 | 316 | 31 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 22(R) | -1335 | -1772 | -2246 | -1513 | -2127 | -2222 | -955 | -1242 | 35 | -1675 | -1197 | -1424 | -2426 | -659 | 3303 | -1507 | -1331 | 1211 | -2220 | -1868 | 32 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 23(A) | 1948 | -1167 | -891 | 1114 | -1539 | -1605 | -710 | -688 | -551 | -1278 | -608 | -703 | -1861 | -451 | -928 | -724 | -609 | 1295 | -1870 | -1386 | 33 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 24(A) | 2275 | -1339 | -993 | -558 | -2142 | -1451 | -682 | -1733 | 1352 | -1909 | -1113 | -663 | -1785 | -334 | -564 | -587 | 928 | -1336 | -2220 | -1732 | 34 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 25(N) | -1216 | -1775 | -1072 | -1034 | -1473 | -1967 | -1153 | -1429 | -1009 | 767 | -1165 | 3461 | -2339 | -1043 | -1259 | -1335 | -1316 | -1331 | -1982 | -1273 | 35 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 26(Y) | -2131 | -1808 | -3471 | -3249 | 538 | -3299 | -814 | 1516 | -2817 | -864 | -742 | -2495 | -3305 | -2356 | -2649 | -2520 | -2091 | -784 | -205 | 4093 | 36 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 27(V) | -2321 | -1872 | -4652 | -4075 | -539 | -4266 | -3092 | 2178 | -3803 | 2345 | 2067 | -3915 | -3747 | -2978 | -3487 | -3494 | -2215 | -175 | -2130 | -2157 | 37 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 28(S) | -482 | -1136 | -1858 | -1915 | -3072 | -1315 | -1996 | -2905 | -2045 | -3106 | -2272 | -1475 | 1651 | -1840 | -2205 | 3016 | -873 | -2011 | -3242 | -2908 | 38 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 29(V) | 845 | -1090 | -3817 | -3373 | -1522 | -3377 | -2794 | 2147 | -3161 | -649 | -421 | -3056 | -3362 | -2955 | -3177 | -2598 | -1419 | 2690 | -2606 | -2197 | 39 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 30(G) | -1283 | -2067 | -837 | -965 | -3177 | 3042 | -1462 | -3119 | -1171 | -3141 | -2429 | -1111 | -2331 | 2005 | -1448 | -1320 | -1499 | -2538 | -3099 | -2665 | 40 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 31(O) | -974 | -2142 | -780 | -270 | -2589 | -1791 | -328 | -2217 | 1581 | -2142 | -1329 | -487 | -1903 | 3083 | 262 | -876 | 671 | -1860 | -2250 | -1764 | 41 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 32(L) | -1375 | -1127 | -3503 | -2949 | -697 | -3071 | -2054 | 1887 | -2629 | 2035 | 342 | -2656 | -2990 | -2251 | -2534 | -2214 | 1157 | 428 | -1759 | -1511 | 42 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 33(Y) | -1937 | -2273 | -1926 | -1563 | 232 | -2608 | -650 | -2164 | 1538 | -2035 | -1599 | -1501 | -2740 | -960 | -541 | -1929 | -1851 | -2048 | -794 | 4044 | 43 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 34(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 44 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 35(K) | -565 | -1769 | -542 | 1150 | -2042 | -1544 | -133 | -1707 | 1529 | -200 | 1362 | -220 | -1622 | 291 | 1492 | -490 | -487 | -1367 | -1948 | -1377 | 45 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 36(D) | -733 | -2199 | 2095 | 230 | -2550 | 256 | -327 | -2314 | 1307 | -2269 | -1390 | -100 | -1681 | 97 | -574 | 1114 | -708 | -1861 | -2454 | -1735 | 46 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 37(N) | -1190 | -2662 | 1381 | 127 | -3153 | -1520 | -768 | -2990 | -757 | -2945 | -2156 | 3138 | -1961 | -405 | -1416 | 1061 | -1253 | -2479 | -3137 | -2313 | 47 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 38(P) | -1777 | -2801 | 1868 | -561 | -3633 | -1918 | -1524 | -3634 | -1721 | -3620 | -2978 | -881 | 3543 | -1257 | -2350 | -1648 | -1944 | -3091 | -3510 | -2972 | 48 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 39(C) | -1617 | 2940 | -3806 | -3389 | -788 | -2963 | -2369 | -4 | -2967 | 2637 | 197 | -2927 | -3094 | -2569 | -2799 | -2284 | -1672 | -278 | -1950 | -1680 | 49 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 40(M) | -1138 | -1232 | 1092 | -1546 | -625 | -2468 | -1290 | -56 | -1453 | 1974 | 2682 | -1610 | -2481 | -1228 | -1655 | -1558 | -1079 | -283 | -1540 | -1223 | 50 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 41(H) | -30 | 439 | 11 | 363 | -394 | -739 | 699 | -414 | 463 | -757 | 501 | 286 | -577 | 639 | 165 | -23 | -111 | -312 | 697 | -25 | 51 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 42(K) | 784 | -2190 | -977 | -302 | -2645 | -1847 | -256 | -2259 | 2452 | -2136 | -1309 | -504 | -1900 | 1339 | 1312 | -874 | -863 | -1897 | -2202 | -1742 | 52 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 43(E) | -648 | -1915 | -516 | 1778 | -2222 | -1578 | -162 | -1899 | 439 | 163 | -1023 | -238 | -1667 | 1297 | 1557 | -552 | -568 | -1536 | -2057 | -1482 | 53 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 44(P) | -1091 | -2157 | -710 | -354 | -2472 | -1828 | 2409 | -2236 | 1296 | -2195 | -1418 | -568 | 2737 | -72 | 88 | -1007 | -1021 | -1903 | -2268 | -1751 | 54 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 45(L) | -1149 | -1110 | -2516 | -1945 | 1939 | -2543 | -1114 | -128 | 1051 | 1953 | 309 | -1805 | -2527 | -1346 | -1480 | -1629 | -1078 | -306 | -1080 | -509 | 55 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 46(T) | -695 | -1464 | -884 | -358 | -1467 | -1703 | -361 | -1272 | 1547 | -1430 | -690 | -543 | -1822 | -57 | -149 | -739 | 2166 | -1045 | -1654 | 1676 | 56 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 47(R) | 1626 | -2138 | -1332 | -620 | -2693 | -1985 | -403 | -2249 | 1356 | -2167 | -1392 | -747 | -2067 | 11 | 2526 | -1100 | -1051 | -1929 | -2243 | -1870 | 57 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 48(E) | 378 | -1941 | 703 | 1824 | -2252 | -1386 | -100 | -2000 | 289 | -1956 | -1046 | -24 | -1516 | 349 | 1172 | 476 | -427 | -1561 | -2134 | -1447 | 58 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 49(D) | 923 | -2559 | 2894 | 160 | -2929 | -1519 | -635 | -2712 | -524 | -2688 | -1882 | -189 | -1895 | 1449 | -1131 | -904 | -1111 | -2258 | -2898 | -2120 | 59 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 50(V) | 1091 | -1040 | -3230 | -3029 | -1839 | -2191 | -2521 | 453 | -2807 | -1107 | -816 | -2387 | -2674 | -2598 | -2801 | -1506 | -1141 | 3085 | -2726 | -2349 | 60 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 51(K) | 1016 | -1925 | -1252 | -838 | -2825 | -1834 | -758 | -2369 | 3094 | -2408 | -1667 | -917 | -2126 | -380 | -14 | -1094 | -1125 | -1973 | -2524 | -2145 | 61 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 52(H) | -477 | -400 | -2258 | -1664 | 1050 | -1948 | 2313 | 1043 | -1367 | -239 | 404 | -1388 | 365 | -1083 | -1355 | -1008 | -417 | 915 | -715 | 1745 | 62 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 53(H) | -1023 | -1918 | -1234 | -509 | -2208 | -1943 | 3152 | 947 | 1315 | -1817 | -1055 | -662 | -1981 | 64 | 1825 | -993 | -895 | -1542 | -1997 | -1584 | 63 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 54(P) | 1113 | -913 | -1858 | -1496 | -1358 | -1604 | -1238 | -756 | -1296 | 958 | -503 | -1306 | 2592 | -1174 | -1479 | -817 | -686 | -602 | -1858 | -1474 | 64 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 55(I) | 846 | -1093 | -3818 | -3374 | -1512 | -3374 | -2792 | 2798 | -3161 | -633 | -411 | -3056 | -3360 | -2951 | -3174 | -2596 | -1422 | 2077 | -2600 | -2195 | 65 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 56(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 66 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 57(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 67 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 58(W) | -4114 | -3274 | -4214 | -4453 | -1722 | -3496 | -2681 | -4109 | -4149 | -3619 | -3615 | -4044 | -3885 | -4032 | -3816 | -4355 | -4248 | -4133 | 6191 | -1329 | 68 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 59(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 69 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 60(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 70 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 61(C) | -859 | 2735 | -3125 | -2633 | -1043 | -2353 | -1765 | 2619 | -2314 | -561 | -137 | -2173 | -2560 | -2046 | -2258 | -1540 | 1442 | 680 | -1746 | -1384 | 71 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 62(P) | 1490 | -891 | -2212 | -1956 | -2077 | -1371 | -1689 | -1274 | -1796 | -1861 | -1203 | -1479 | 2954 | -1611 | -1936 | -653 | -684 | 816 | -2478 | -2131 | 72 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 63(G) | -382 | -1055 | -1768 | -1819 | -3131 | 2891 | -1951 | -2904 | -2042 | -3099 | -2224 | -1384 | 1043 | -1771 | -2236 | 1022 | -775 | -1958 | -3301 | -2980 | 73 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 64(O) | -1532 | -1831 | -1845 | -1487 | -1032 | -2520 | -1248 | -707 | -794 | 1863 | -184 | -1573 | -2625 | 2991 | -924 | -1768 | -1488 | -990 | -1859 | -1397 | 74 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 65(N) | -1040 | -1491 | -1193 | -1126 | -1577 | -1932 | -1248 | 1438 | -1138 | -1433 | -1011 | 3384 | -2307 | -1120 | -1396 | -1256 | -1150 | -579 | -2101 | -1473 | 75 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 66(F) | -2629 | -2152 | -4261 | -4009 | 3717 | -3972 | -1470 | -438 | -3655 | 1364 | 94 | -3253 | -3712 | -2829 | -3311 | -3250 | -2543 | -971 | -709 | 261 | 76 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 67(I) | -1794 | -1354 | -4306 | -3856 | -1267 | -3968 | -3273 | 2808 | -3666 | 1262 | -89 | -3607 | -3721 | -3300 | -3605 | -3222 | -1758 | 1880 | -2695 | -2428 | 77 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 68(Y) | -1692 | -1412 | -3458 | -3020 | 258 | -3136 | -1081 | 1186 | -2630 | 646 | -31 | -2459 | -3064 | -2167 | -2476 | -2272 | -1624 | -329 | -544 | 3829 | 78 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 69(A) | 2378 | -934 | -2147 | -1885 | -2779 | 826 | -1775 | -2485 | -1781 | -2703 | -1842 | -1381 | -1860 | -1577 | -1989 | 1353 | 1040 | -1689 | -2983 | -2654 | 79 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 70(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 80 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 71(L) | -2379 | -1915 | -4669 | -4151 | -621 | -4360 | -3248 | 1934 | -3862 | 2632 | 553 | -4017 | -3845 | -3099 | -3585 | -3641 | -2289 | -24 | -2250 | -2225 | 81 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 72(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 82 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 73(R) | -1929 | -2343 | -2336 | -1600 | -825 | -2607 | -677 | -2317 | 45 | -2153 | -1653 | -1506 | -2681 | -679 | 3382 | -1922 | -1792 | -2176 | -1232 | 2267 | 83 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 74(V) | 503 | -701 | -3099 | -2506 | 1199 | -2516 | -1425 | 486 | -2168 | 1370 | 379 | -2113 | -2515 | -1800 | -2039 | -1621 | -848 | 2021 | -1247 | -916 | 84 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 75(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 85 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 76(K) | 1051 | -1939 | -439 | -69 | -2445 | -1557 | -349 | -2132 | 2202 | -2116 | -1268 | 1786 | -1753 | 70 | -141 | -646 | -704 | -1719 | -2284 | -1701 | 86 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 77(K) | -1384 | -2800 | 1892 | -69 | -3174 | -1733 | -742 | -2966 | 2973 | -2873 | -2105 | -400 | -2087 | -365 | -775 | -1179 | -1372 | -2535 | -2949 | -2288 | 87 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 78(Y) | -2118 | -2084 | -2592 | -2218 | 1983 | -3049 | 2937 | -1851 | -1966 | -1662 | -1339 | -1862 | -3049 | 1795 | -2085 | -2125 | -2036 | -1809 | 122 | 3287 | 88 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 79(N) | -1107 | -2701 | 1326 | 223 | -2992 | 1724 | -586 | -2799 | -472 | -2733 | -1910 | 2292 | -1876 | 1179 | -1098 | -894 | -1109 | -2331 | -2923 | -2116 | 89 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 80(L) | -1690 | -1806 | -2247 | -1903 | -837 | -2782 | -1536 | -464 | -1204 | 2489 | 81 | -1939 | -2835 | 1986 | -1289 | -2052 | -1642 | -850 | -1841 | -1451 | 90 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 81(D) | -1292 | -2956 | 2598 | 202 | -3213 | -1558 | -693 | -3045 | 851 | -2958 | -2170 | 2502 | -1967 | -318 | -1262 | -1043 | -1304 | -2569 | -3134 | -2291 | 91 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 82(M) | -866 | -1094 | -2548 | -2220 | -1176 | -1993 | -1696 | -374 | -1810 | -470 | 4232 | -1867 | -2385 | -1729 | -1855 | -1260 | 1587 | -400 | -1960 | -1681 | 92 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 83(F) | -1725 | -1400 | -3934 | -3394 | 2962 | -3436 | -2055 | 375 | -3076 | 1369 | 437 | -3005 | -3243 | -2505 | -2863 | -2595 | -1653 | 1644 | -1488 | -995 | 93 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 84(Y) | -2852 | -2251 | -3961 | -3935 | 2281 | -3735 | -476 | 168 | -3585 | -1379 | -1299 | -2630 | -3641 | -2627 | -3134 | -2925 | -2756 | -1840 | 233 | 4154 | 94 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 85(I) | -1759 | -1305 | -4328 | -3965 | -1743 | -4047 | -3735 | 3086 | -3833 | -588 | -522 | -3726 | -3872 | -3681 | -3903 | -3364 | -1752 | 2354 | -3250 | -2813 | 95 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 86(M) | -700 | -1108 | -1144 | 2046 | -1106 | -1894 | -710 | -177 | -572 | -648 | 2421 | -857 | -1997 | -497 | -908 | -934 | -657 | 1171 | -1602 | -1155 | 96 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 87(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 97 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 88(P) | -526 | -1169 | -1848 | -1957 | -3095 | -1343 | -2052 | -2946 | -2123 | -3152 | -2333 | -1513 | 3407 | -1917 | -2261 | 1632 | -922 | -2053 | -3267 | -2938 | 98 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 89(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 99 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 90(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 100 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 91(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 101 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 92(H) | -30 | 439 | 11 | 363 | -394 | -739 | 699 | -414 | 463 | -757 | 501 | 286 | -577 | 639 | 165 | -23 | 111 | -312 | 697 | -25 | 102 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 93(G) | 1432 | -1081 | -2340 | -2519 | -3309 | 3113 | -2408 | -3041 | -2687 | -3327 | -2482 | -1740 | -2062 | -2353 | -2689 | -702 | -903 | -2058 | -3476 | -3301 | 103 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 94(O) | -1326 | -2187 | -825 | -789 | -2878 | -1884 | -1131 | -2784 | -631 | -2752 | -2063 | -977 | 2646 | 3194 | -881 | -1313 | -1428 | -2357 | -2787 | -2310 | 104 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 95(V) | 1470 | -815 | -2475 | -2334 | -1874 | 1135 | -1780 | -892 | -2064 | -1657 | -1016 | -1624 | -2020 | -1814 | -2121 | -717 | -687 | 2477 | -2329 | -1999 | 105 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 96(M) | -883 | -899 | -2454 | -1951 | -595 | 991 | -1285 | -31 | -1626 | 1077 | 3599 | -1754 | -2362 | -1420 | -1669 | -1376 | -878 | -131 | -1359 | -1024 | 106 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 97(V) | -1205 | -914 | -3493 | -2955 | -1023 | -3025 | -2085 | 1649 | -2672 | 917 | -32 | -2617 | -2982 | -2375 | -2606 | -2169 | 1373 | 2267 | -1903 | -1552 | 107 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 98(S) | 1719 | -1145 | -1296 | -1130 | -2738 | -1260 | -1357 | -2461 | -1234 | -2624 | -1769 | 1171 | -1844 | -1070 | -1576 | 2383 | -686 | -1744 | -2874 | -2423 | 108 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 99(N) | -809 | -2086 | -98 | 33 | -2593 | -1494 | -488 | -2361 | -147 | -2346 | -1503 | 2681 | -1787 | 1970 | -607 | 984 | -825 | -1908 | -2521 | -1851 | 109 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 100(S) | 878 | -890 | -1818 | -1458 | -1679 | -1418 | -1269 | -1166 | -1293 | 665 | -837 | -1224 | -1904 | -1156 | -1509 | 2469 | -610 | -869 | -2068 | -1669 | 110 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 101(Y) | -3588 | -2709 | -4120 | -4323 | 1034 | -3994 | -419 | -2613 | -3834 | -2031 | -2055 | -2741 | -3905 | -2826 | -3349 | -3280 | -3472 | -2736 | 3673 | 4312 | 111 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 102(L) | -2496 | -2027 | -4721 | -4202 | -560 | -4432 | -3262 | -1210 | -3887 | 2852 | 611 | -4095 | -3876 | -3086 | -3587 | -3729 | -2397 | -232 | -2211 | -2201 | 112 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 103(D) | -1791 | -3663 | 3414 | 1659 | -3853 | -1647 | -1043 | -3807 | -1343 | -3679 | -3054 | -251 | -2201 | -725 | -2227 | -1438 | -1872 | -3282 | -3836 | -2831 | 113 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 104(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 114 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 105(S) | -342 | -976 | -2177 | -2128 | -2921 | -1229 | -2008 | -2606 | -2073 | -2888 | -2058 | -1512 | -1936 | -1871 | -2189 | 2669 | 2327 | -1779 | -3151 | -2842 | 115 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 106(Y) | -2652 | -2206 | -3673 | -3556 | 726 | -3580 | -692 | -1359 | -3066 | 982 | -936 | -2620 | -3538 | -2500 | -2832 | -2837 | -2587 | -1595 | -24 | 4185 | 116 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 107(T) | -502 | -1110 | -2201 | -2282 | -3095 | 1340 | -2204 | -2779 | -2341 | -3075 | -2268 | -1660 | -2066 | -2111 | -2412 | -729 | 3346 | -1945 | -3276 | -3043 | 117 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 108(E) | -1163 | -2811 | 1893 | 2460 | -3072 | -1535 | -594 | -2884 | 1337 | -2797 | -1978 | -140 | -1898 | -203 | -1072 | -933 | -1159 | -2412 | -2972 | -2157 | 118 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 109(I) | 561 | -338 | -2506 | -1896 | 1485 | -1980 | -829 | 1917 | -1557 | -155 | 470 | -1524 | -2033 | -1236 | -1465 | -1055 | 777 | 309 | -776 | 1058 | 119 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 110(Y) | -3611 | -2705 | -4166 | -4409 | 2531 | -4042 | -397 | -2533 | -3989 | -1938 | -1983 | -2747 | -3929 | -2851 | -3444 | -3294 | -3491 | -2684 | 345 | 4289 | 120 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 111(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 121 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 112(E) | -785 | -2281 | -2 | 1960 | -2596 | -1496 | -297 | -2348 | 660 | -2275 | -1399 | 1934 | -1705 | 1721 | -381 | -626 | -738 | -1906 | -2432 | -1737 | 122 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 113(I) | -1722 | -1438 | -3424 | -3080 | 131 | -3150 | -1169 | 2917 | -2681 | -503 | -344 | -2513 | -3144 | -2305 | -2554 | -2347 | -1683 | -39 | -645 | 2880 | 123 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 114(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 124 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 115(O) | -1609 | -2594 | -1354 | -790 | -3182 | -2213 | -519 | -2737 | 2527 | -2514 | -1787 | -903 | -2297 | 3031 | 525 | -1483 | -1437 | -2432 | -2460 | -2150 | 125 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 116(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 126 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 117(E) | -495 | -1766 | -320 | 2020 | -2044 | -1449 | -133 | -1708 | 1298 | -1759 | -898 | -124 | -1562 | 295 | -155 | -410 | 632 | 108 | -1998 | -1374 | 127 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 118(E) | 1485 | -2051 | -202 | 1709 | -2406 | -1511 | -270 | -2112 | 1557 | -2089 | -1228 | -183 | -1688 | 156 | -234 | -586 | -657 | -1706 | -2272 | -1633 | 128 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 119(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 129 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 120(M) | -2568 | -2113 | -4714 | -4154 | -462 | -4418 | -3155 | 99 | -3799 | 2469 | 3538 | -4062 | -3833 | -2972 | -3479 | -3691 | -2450 | -587 | -2108 | -2139 | 130 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 121(O) | 447 | -1907 | -448 | -115 | -2176 | -1605 | 2296 | -1980 | 143 | -2000 | -1194 | -367 | -1799 | 3046 | -194 | -715 | -752 | -1626 | -2150 | -1543 | 131 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 122(K) | -1448 | -2495 | -1440 | -709 | -3095 | -2161 | -406 | -2616 | 2874 | -2399 | -1636 | 1544 | -2197 | 22 | 1483 | -1326 | -1270 | -2295 | -2364 | -2043 | 132 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 123(L) | -2430 | -1987 | -4659 | -4071 | 2109 | -4260 | -2828 | 67 | -3779 | 2463 | 2382 | -3869 | -3717 | -2880 | -3418 | -3473 | -2306 | -623 | -1874 | -1724 | 133 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 124(F) | -2144 | -1762 | -4034 | -3706 | 3638 | -3656 | -1587 | 1655 | -3381 | 102 | 23 | -3073 | -3507 | -2734 | -3134 | -2896 | -2093 | -241 | -906 | 16 | 134 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 125(K) | -1297 | -2351 | -1405 | -643 | -2938 | -2076 | -377 | -2482 | 2603 | -2306 | -1527 | -768 | -2120 | 51 | 1973 | 899 | -1147 | -2149 | -2307 | -1957 | 135 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 126(O) | -753 | -1991 | -692 | -91 | -2345 | -1670 | 1700 | -2009 | 519 | -1957 | -1111 | -334 | -1745 | 2315 | 1728 | -656 | 1061 | -1645 | -2095 | -1558 | 136 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 127(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 137 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 128(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 138 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 129(F) | -1908 | -1643 | -3261 | -2963 | 3263 | -3050 | -509 | -1219 | -2636 | -1197 | -851 | -2199 | -3071 | -2085 | -2476 | -2189 | 1297 | -1211 | 77 | 2811 | 139 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 130(P) | -540 | -1180 | -1850 | -1974 | -3103 | -1352 | -2072 | -2962 | -2149 | -3170 | -2355 | -1527 | 3509 | -1943 | -2279 | 1382 | -938 | -2068 | -3276 | -2949 | 140 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 131(G) | 1432 | -1081 | -2340 | -2519 | -3309 | 3113 | -2408 | -3041 | -2687 | -3327 | -2482 | -1740 | -2062 | -2353 | -2689 | -702 | -903 | -2058 | -3476 | -3301 | 141 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 132(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 142 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 133(V) | -1322 | -992 | -3697 | -3181 | -1158 | -3230 | -2353 | 2069 | -2914 | 914 | -126 | -2840 | -3160 | -2624 | -2849 | -2396 | 641 | 2352 | -2122 | -1765 | 143 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 134(P) | 2498 | -1088 | -2250 | -2290 | -3023 | -1338 | -2177 | -2668 | -2306 | -2970 | -2190 | -1656 | 2760 | -2080 | -2382 | -710 | -882 | -1878 | -3231 | -2984 | 144 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 135(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 145 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 136(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 146 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 137(A) | 1947 | -745 | -2823 | -2285 | 1846 | -2348 | -1328 | 1572 | -1988 | -154 | 207 | -1942 | -2439 | -1677 | -1944 | -1473 | -836 | 359 | -1231 | -781 | 147 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 138(A) | 2029 | -2389 | 1954 | 92 | -2936 | -1492 | -703 | -2716 | -623 | -2715 | -1906 | 1712 | -1898 | -331 | -1237 | -881 | -1089 | -2229 | -2931 | -2168 | 148 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 139(P) | 1935 | -1116 | -2232 | -2301 | -3058 | -1358 | -2206 | -2705 | -2336 | -3009 | -2238 | -1674 | 3272 | -2114 | -2406 | -739 | -914 | -1913 | -3260 | -3019 | 149 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 140(E) | -1349 | -2706 | -162 | 2827 | -3109 | -1785 | -624 | -2820 | 1799 | -2704 | -1931 | -437 | -2073 | -230 | -334 | -1160 | -1298 | -2421 | -2774 | -2189 | 150 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 141(T) | -645 | -1000 | -2671 | -2474 | -1925 | -1699 | -2057 | -385 | -2200 | -1416 | -1020 | -1885 | -2274 | -2057 | -2247 | -1011 | 3256 | 1160 | -2570 | -2205 | 151 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 142(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 152 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 143(H) | -30 | 439 | 11 | 363 | -394 | -739 | 699 | -414 | 463 | -757 | 501 | 286 | -577 | 639 | 165 | -23 | 111 | -312 | 697 | -25 | 153 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 144(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 154 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 145(S) | 1426 | -949 | -2380 | -2419 | -3107 | -1201 | -2226 | -2819 | -2411 | -3105 | -2246 | -1618 | -1944 | -2131 | -2456 | 3026 | -742 | -1874 | -3336 | -3080 | 155 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 146(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 156 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 147(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 157 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 148(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 158 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 149(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 159 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 150(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 160 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 151(E) | 669 | -2323 | -22 | 3133 | -3044 | -1600 | -954 | -2706 | -853 | -2824 | -2095 | -473 | -2059 | -614 | -1376 | -1068 | -1279 | -2254 | -3056 | -2376 | 161 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 152(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 162 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 153(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 163 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 154(Y) | -3482 | -2868 | -3701 | -3919 | 238 | -3552 | -1112 | -3000 | -3638 | -2516 | -2526 | -3027 | -3772 | -3101 | -3341 | -3418 | -3527 | -3071 | -441 | 4711 | 164 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 155(S) | 2313 | -937 | -2414 | -2419 | -3070 | -1197 | -2205 | -2274 | -2385 | -3059 | -2200 | -1614 | -1936 | -2106 | -2436 | 2518 | -728 | -1846 | -3302 | -3046 | 165 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 156(L) | -2364 | -1901 | -4460 | -4144 | -630 | -4349 | -3246 | 2015 | -3856 | 2597 | 544 | -4006 | -3841 | -3101 | -3583 | -3629 | -2275 | 2 | -2255 | -2227 | 166 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 157(S) | -643 | -1153 | -1942 | -1769 | -1726 | -1574 | -1553 | -1424 | -1560 | 381 | -1167 | -1475 | -2124 | -1504 | -1711 | 2968 | -911 | -1168 | -2234 | -1683 | 167 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 158(H) | -1208 | -1519 | -1818 | -1600 | -796 | -2137 | 4436 | -1042 | -1134 | -1422 | -996 | -1514 | -2459 | -1277 | -1260 | -1442 | -1296 | 1290 | -1367 | -527 | 168 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 159(G) | 1625 | -934 | -2312 | -2287 | -3120 | 2515 | -2142 | -2866 | -2304 | -3096 | -2206 | -1553 | -1910 | -2010 | -2401 | 1405 | -705 | -1884 | -3324 | -3069 | 169 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 160(Y) | 553 | -516 | -2670 | -2093 | 1648 | -2153 | -831 | 125 | -1753 | -275 | 301 | -1673 | -2204 | -1407 | -1649 | -1238 | -604 | 1878 | -648 | 2121 | 170 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 161(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 171 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 162(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 172 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 163(I) | -1759 | -1304 | -4329 | -3967 | -1748 | -4050 | -3739 | 3054 | -3836 | -593 | -525 | -3728 | -3874 | -3686 | -3907 | -3367 | -1751 | 2401 | -3255 | -2817 | 173 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 164(M) | -2389 | -1957 | -4609 | -4018 | 1345 | -4211 | -2821 | 78 | -3724 | 2123 | 3673 | -3822 | -3688 | -2852 | -3378 | -3418 | -2267 | -598 | -1888 | -1767 | 174 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 165(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 175 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 166(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 176 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 167(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 177 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 168(D) | -1220 | -2896 | 2608 | 1191 | -3149 | -1530 | -651 | -2978 | -602 | -2895 | -2089 | 1257 | -1925 | -269 | -1273 | 1237 | -1229 | -2498 | -3083 | -2233 | 178 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 169(L) | -1037 | -975 | -2376 | 275 | -735 | -2518 | -1412 | 367 | -1669 | 2017 | 219 | -1835 | -2540 | -1484 | -1766 | -1625 | -988 | 1640 | -1541 | -1207 | 179 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 170(I) | -1918 | -1539 | -4076 | -3666 | 2083 | -3676 | -2142 | 3117 | -3379 | 145 | 94 | -3221 | -3504 | -2843 | -3198 | -2911 | -1872 | 334 | -1508 | -773 | 180 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 171(V) | 2267 | -970 | -2988 | -2782 | -1867 | -1873 | -2265 | 74 | -2556 | -1277 | -903 | -2107 | -2419 | -2332 | -2560 | -1182 | -982 | 2421 | -2604 | -2249 | 181 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 172(A) | 2401 | -935 | -2092 | -1865 | -2596 | -1235 | -1739 | -2211 | -1758 | -2497 | -1687 | -1386 | 1817 | -1571 | -1946 | -528 | 1549 | -1545 | -2846 | -2512 | 182 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 173(C) | 152 | 3737 | -3346 | -3008 | -1521 | -2075 | -2187 | 405 | -2700 | -983 | -575 | -2269 | -2516 | -2413 | -2614 | -1349 | -959 | 2580 | -2260 | -1908 | 183 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 174(V) | -1189 | -1030 | -2667 | 1142 | -1294 | -2870 | -1904 | 1998 | -2055 | -599 | -276 | -2175 | -2880 | -1914 | -2228 | -1998 | -1157 | 2462 | -2134 | -1721 | 184 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 175(V) | -1753 | -1297 | -4327 | -3965 | -1769 | -4049 | -3747 | 2530 | -3837 | -621 | -545 | -3725 | -3875 | -3695 | -3913 | -3366 | -1745 | 2911 | -3274 | -2827 | 185 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 176(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 186 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 177(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 187 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 178(G) | -2954 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 188 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 179(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 189 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 180(A) | 3124 | -934 | -2490 | -2562 | -3082 | -1203 | -2297 | -2766 | -2535 | -3081 | -2234 | -1670 | -1954 | -2236 | -2534 | 920 | -746 | -1844 | -3332 | -3091 | 190 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 181(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 191 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 182(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 192 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 183(G) | 1080 | -1108 | -2311 | -2509 | -3336 | 3223 | -2424 | -3074 | -2706 | -3361 | -2521 | -1751 | -2082 | -2372 | -2708 | -729 | -932 | -2089 | -3493 | -3324 | 193 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 184(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 194 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 185(L) | -1369 | -1384 | -3092 | -2737 | -825 | -2649 | -2073 | -44 | -2334 | 2571 | 187 | -2437 | -2847 | -2125 | -2306 | -1915 | 1278 | -290 | -1941 | -1678 | 195 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 186(A) | 2912 | -1000 | -2422 | -2157 | -1636 | -1634 | -1753 | -816 | -1876 | -1128 | 1988 | -1694 | -2169 | -1741 | -1956 | -923 | -861 | -675 | -2256 | -1899 | 196 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 187(T) | 973 | -953 | -2483 | -2484 | -2838 | -1268 | -2195 | -2209 | -2352 | -2704 | -1971 | -1675 | -1991 | -2131 | -2373 | -617 | 3427 | -1554 | -3148 | -2888 | 197 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 188(S) | -437 | -1083 | -2006 | -2144 | -3262 | 1583 | -2197 | -3097 | -2380 | -3307 | -2434 | -1562 | -2008 | -2077 | -2485 | 2965 | -857 | -2074 | -3426 | -3160 | 198 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 189(W) | -4114 | -3274 | -4214 | -4453 | -1722 | -3496 | -2681 | -4109 | -4149 | -3619 | -3615 | -4044 | -3885 | -4032 | -3816 | -4355 | -4248 | -4133 | 6191 | -1329 | 199 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 190(H) | -1323 | -1832 | -1402 | -994 | 2149 | -2268 | 3183 | -1595 | -684 | -1541 | -1023 | -1062 | -2358 | 2478 | -951 | -1335 | -1257 | -1461 | -476 | 569 | 200 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 191(S) | 1326 | -873 | -2274 | -2002 | -2263 | -1287 | -1735 | -1644 | -1844 | -2124 | -1388 | -1463 | -1915 | -1637 | -1990 | 2623 | -646 | 880 | -2605 | -2269 | 201 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 192(N) | -573 | -1630 | 864 | 62 | -1860 | -1478 | -310 | 843 | -39 | -1634 | -837 | 2440 | -1658 | 65 | -526 | -537 | 638 | -1154 | -1980 | -1380 | 202 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 193(K) | -1324 | -1987 | -1657 | -1059 | -2437 | -2134 | -750 | -1568 | 3217 | -1940 | -1374 | -1107 | -2304 | -391 | 150 | -1379 | -1277 | 548 | -2320 | -1952 | 203 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 194(H) | -30 | 439 | 11 | 363 | -394 | -739 | 699 | -414 | 463 | -757 | 501 | 286 | -577 | 639 | 165 | -23 | 111 | -312 | 697 | -25 | 204 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 195(F) | -2721 | -2160 | -3990 | -3906 | 3360 | -3716 | -572 | -1433 | -3510 | 1177 | -922 | -2674 | -3597 | -2614 | -3108 | -2899 | -2622 | -1671 | 137 | 2722 | 205 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 196(I) | -1769 | -1321 | -4308 | -3881 | -1430 | -3998 | -3403 | 2941 | -3713 | 744 | -240 | -3637 | -3769 | -3419 | -3696 | -3267 | -1740 | 2073 | -2864 | -2543 | 206 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 197(N) | -1660 | -3287 | 1909 | 69 | -3610 | -1646 | -1046 | -3616 | -1275 | -3528 | -2867 | 3539 | -2186 | -731 | -2069 | -1373 | -1757 | -3086 | -3624 | -2697 | 207 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 198(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 208 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 199(R) | 780 | -954 | -1042 | -463 | -1021 | -1681 | -388 | 1232 | 838 | -838 | -132 | -612 | -1756 | -173 | 1322 | -665 | -418 | 574 | -1339 | -893 | 209 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 200(N) | -622 | -2053 | -110 | 1285 | -2366 | -1450 | -199 | -2102 | 1009 | -2062 | -1176 | 2124 | -1614 | 238 | -276 | -491 | 1247 | -1677 | -2241 | -1566 | 210 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 201(D) | -1369 | -2674 | 3374 | -58 | -3453 | -1571 | -1095 | -3380 | -1289 | -3368 | -2659 | -394 | -2124 | -784 | -2016 | 1149 | -1529 | -2785 | -3505 | -2662 | 211 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 202(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 212 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 203(A) | 2246 | -790 | -2416 | -1988 | -1270 | -1821 | -1490 | 1726 | -1755 | -905 | -386 | -1651 | -2194 | -1557 | -1854 | -1027 | 949 | 146 | -1839 | -1474 | 213 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 204(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 214 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 205(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 215 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 206(P) | -2931 | -2878 | -3420 | -3706 | -4181 | -2925 | -3468 | -4621 | -3859 | -4490 | -4165 | -3491 | 4225 | -3781 | -3695 | -3182 | -3279 | 4087 | -3594 | -4064 | 216 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 207(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 217 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 208(L) | -2475 | -2006 | -4716 | -4195 | -570 | -4423 | -3262 | 1353 | -3887 | 2819 | 603 | -4084 | -3871 | -3089 | -3590 | -3715 | -2377 | -194 | -2218 | -2208 | 218 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 209(H) | -1047 | -2367 | -130 | -12 | -2443 | -1653 | 3422 | -2425 | 11 | -2366 | -1567 | 2352 | -1902 | 1348 | -351 | -897 | -1003 | -2040 | -2389 | -1693 | 219 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 210(L) | -1968 | -1597 | -4244 | -3772 | -812 | -3841 | -2955 | 582 | -3473 | 2391 | -322 | -3529 | -3600 | -2960 | -3315 | -3097 | -1926 | 2070 | -2269 | -2100 | 220 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 211(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 221 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 212(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 222 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 213(F) | -3581 | -2688 | -4165 | -4401 | 3865 | -4034 | -401 | -2491 | -3981 | -1903 | -1944 | -2746 | -3921 | -2847 | -3438 | -3284 | -3462 | -2647 | 341 | 3054 | 223 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 214(K) | -2620 | -2961 | -2461 | -2046 | -3743 | -2791 | -1570 | -3603 | 3784 | -3387 | -2839 | -2048 | -3039 | -1260 | -465 | -2604 | -2356 | -3331 | -3001 | -2988 | 224 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 215(I) | -2091 | -1746 | -3971 | -3840 | -1676 | -3532 | -3287 | 3684 | -3581 | -659 | -693 | -3562 | -3674 | -3445 | -3521 | -3194 | -2146 | 449 | -2877 | -2493 | 225 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 216(A) | 2478 | -935 | -2423 | -2429 | -3066 | -1197 | -2208 | -2769 | -2392 | -3055 | -2196 | -1617 | -1936 | -2112 | -2440 | 2351 | -728 | -1843 | -3300 | -3045 | 226 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 217(N) | -1558 | -3098 | 310 | 1592 | -3431 | -1657 | -945 | -3340 | -959 | -3271 | -2572 | 3495 | -2146 | -611 | -1578 | -1301 | -1621 | -2860 | -3383 | -2547 | 227 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 218(P) | -1664 | -2231 | -2030 | -1695 | -3192 | -2240 | -1444 | -3029 | -556 | -2975 | -2319 | -1668 | 3549 | -1149 | 1833 | -1745 | -1774 | -2648 | -2848 | -2650 | 228 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 219(T) | -1213 | -1674 | -2755 | -2906 | -3161 | -1922 | -2659 | -2698 | -2788 | -3105 | -2612 | -2311 | -2600 | -2708 | -2753 | -1463 | 3819 | -2197 | -3286 | -3156 | 229 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 220(I) | -1764 | -1326 | -4294 | -3932 | -1658 | -3987 | -3644 | 3354 | -3776 | -498 | -454 | -3684 | -3833 | -3599 | -3826 | -3303 | -1760 | 1799 | -3153 | -2738 | 230 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 221(F) | -2604 | -2127 | -4552 | -4135 | 2542 | -4236 | -2203 | -115 | -3820 | 2542 | 500 | -3692 | -3785 | -2927 | -3457 | -3508 | -2493 | -769 | -1337 | -643 | 231 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 222(S) | 846 | -947 | -2243 | -2217 | -3137 | 1905 | -2112 | -2888 | -2254 | -3112 | -2218 | -1528 | -1909 | -1968 | -2369 | 2545 | -708 | -1899 | -3331 | -3067 | 232 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 223(R) | -1454 | 3144 | -2763 | -2070 | -2728 | -2193 | -1414 | -2383 | -460 | -2518 | -1907 | -1827 | -2567 | -1160 | 3510 | -1626 | -1582 | -2068 | -2596 | -2366 | 233 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 224(M) | -434 | -912 | -967 | 653 | -960 | -1640 | -368 | 1179 | 682 | -787 | 2592 | -569 | -1718 | -161 | -575 | -617 | 633 | -341 | -1294 | -841 | 234 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 225(S) | -1102 | -2199 | 1764 | -235 | -3206 | -1518 | -1117 | -3089 | -1203 | -3129 | -2368 | -513 | -2060 | -804 | -1816 | 2841 | -1292 | -2470 | -3271 | -2541 | 235 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 226(D) | -1724 | -3448 | 3411 | 103 | -3726 | -1642 | -1058 | -3734 | -1342 | -3628 | -2991 | 1884 | -2196 | -745 | -2191 | -1408 | -1822 | -3197 | -3743 | -2768 | 236 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 227(E) | 391 | -2060 | -303 | 2460 | -2453 | -1565 | -312 | -2145 | 213 | -2119 | -1272 | -258 | -1745 | 110 | 1394 | -657 | -720 | -1747 | -2290 | -1683 | 237 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 228(E) | -843 | -2213 | -113 | 2617 | -2562 | -1553 | -357 | -2268 | 1012 | -2237 | -1392 | -212 | -1769 | 60 | -324 | -706 | 776 | -1863 | -2412 | -1764 | 238 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 229(L) | -2324 | -1864 | -4634 | -4121 | -657 | -4319 | -3239 | 2224 | -3838 | 2493 | 517 | -3975 | -3830 | -3106 | -3578 | -3596 | -2239 | 73 | -2272 | -2231 | 239 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 230(H) | -505 | -1236 | -775 | -228 | -1373 | -1593 | 2318 | -963 | 872 | -1178 | -425 | -432 | -1693 | 14 | -290 | -578 | 1743 | 825 | -1578 | -1083 | 240 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 231(C) | -561 | 2259 | 1449 | 1476 | -2294 | -1417 | -164 | -2034 | 1472 | -2003 | -1111 | -57 | -1572 | 275 | -300 | -433 | -510 | -1609 | -2194 | -1510 | 241 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 232(Y) | -2882 | -2267 | -4018 | -3995 | 2580 | -3778 | -511 | -1658 | -3593 | 923 | -1152 | -2675 | -3663 | -2654 | -3169 | -2969 | -2779 | -1865 | 205 | 3751 | 242 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 233(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 243 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 234(H) | -559 | -1906 | -4319 | 1741 | -2211 | -1478 | 2491 | -1923 | 355 | -1899 | -1021 | -132 | -1591 | 303 | 791 | -452 | 1019 | -1527 | -2083 | -1454 | 244 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 235(G) | -456 | -1098 | -1993 | -2173 | -3296 | 2968 | -2244 | -3141 | -2461 | -3355 | -2485 | -1583 | -2025 | -2139 | -2549 | 1723 | -881 | -2104 | -3461 | -3203 | 245 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 236(M) | -1532 | -1301 | -3405 | -2864 | -57 | -3050 | -1438 | -56 | -2477 | 1096 | 3967 | -2484 | -2939 | -2042 | -2342 | -2169 | -1455 | -370 | -989 | 2079 | 246 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 237(G) | -1038 | -1765 | -926 | -1191 | -3372 | 3233 | -1826 | -3379 | -1926 | -3481 | -2725 | 1285 | -2271 | -1628 | -2264 | -1145 | -1377 | -2554 | -3401 | -2980 | 247 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 238(W) | -3553 | -2695 | -4100 | -4288 | 1022 | -3972 | -428 | -2592 | -3792 | -2021 | -2038 | -2737 | -3890 | -2815 | -3323 | -3265 | -3440 | -2712 | 4944 | 3677 | 248 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 239(H) | -693 | -2112 | -279 | 1837 | -2456 | -1534 | 2434 | -2176 | 1108 | -2098 | -1217 | -167 | -1666 | 1691 | -39 | -560 | -624 | -1753 | -2235 | -1604 | 249 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 240(P) | -853 | -1252 | -2460 | -2393 | -2139 | -1784 | -2109 | -974 | -2210 | -1748 | -1364 | -1924 | 3453 | -2108 | -2271 | -1167 | -1152 | 1448 | -2678 | -2307 | 250 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 241(Y) | -906 | -1365 | -1255 | -688 | -4 | -1806 | -48 | -1150 | 314 | -1157 | -604 | -702 | -1987 | -107 | 2106 | -965 | -822 | -1011 | -491 | 2916 | 251 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 242(Y) | -476 | -775 | -1198 | 1077 | -755 | -1738 | -505 | 1586 | -528 | -626 | 43 | -777 | -1822 | -410 | -817 | -751 | 649 | -143 | -1165 | 1945 | 252 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 243(F) | -1857 | -1592 | -3755 | -3460 | 3638 | -3255 | -1454 | -16 | -3144 | -214 | -206 | -2800 | -3287 | -2604 | -2951 | -2505 | -1863 | 1480 | -853 | 99 | 253 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 244(V) | -1203 | -1434 | -1278 | 1166 | -1756 | -2236 | -1499 | 75 | -1412 | -1192 | -819 | -1390 | -2525 | -1332 | -1696 | -1574 | -1248 | 2962 | -2384 | -1907 | 254 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 245(H) | -30 | 439 | 11 | 363 | -394 | -739 | 699 | -414 | 463 | -757 | 501 | 286 | -577 | 639 | 165 | -23 | 111 | -312 | 692 | -25 | 255 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 246(E) | 1028 | -2230 | 1464 | 1545 | -2560 | -1444 | -343 | -2324 | -77 | -2285 | -1411 | -93 | -1690 | 78 | -635 | 1220 | -730 | -1876 | -2478 | -1750 | 256 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 247(G) | 802 | -892 | -1664 | -1291 | -1774 | 2148 | -1181 | -1363 | -1177 | 617 | -906 | -1109 | -1839 | -1027 | -1436 | 836 | -560 | -1000 | -2098 | -1700 | 257 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 248(F) | -737 | -1710 | 1482 | 1223 | 2205 | -1628 | -301 | -1513 | -202 | -1603 | -865 | -339 | -1790 | -72 | -681 | -695 | -688 | -1259 | -1410 | 1271 | 258 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 249(D) | -1662 | -3241 | 3494 | 12 | -3550 | -1708 | -991 | -3449 | 907 | -3360 | -2675 | -360 | -2197 | -658 | -1631 | -1384 | -1715 | -2975 | -3451 | -2636 | 259 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 250(K) | 374 | -1824 | 783 | 927 | -2121 | -1368 | -40 | 525 | 1057 | -1830 | -920 | 824 | 249 | 411 | -141 | -290 | -342 | -1433 | -2020 | -1349 | 260 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 251(E) | 424 | -2247 | 1450 | 1906 | -2557 | 209 | -314 | -2325 | -37 | -2276 | -1395 | -75 | 659 | 111 | -595 | -584 | -710 | -1874 | -2461 | -1729 | 261 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -570 | -7108 | -1648 | -894 | -1115 | -701 | -1378 | * | * | | | | | | | | | | | | |
| 252(D) | -1129 | -2752 | 2889 | 513 | -3030 | -1216 | -532 | -2959 | -669 | -2896 | -2188 | 2229 | -1714 | -198 | -1413 | -860 | -1196 | -2465 | -3041 | -2140 | 262 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -754 | -2619 | -2035 | -2949 | -200 | -992 | -1008 | * | * | | | | | | | | | | | | |
| 253(H) | -696 | -961 | -1261 | -873 | -178 | -1785 | 3652 | 1381 | -427 | -516 | -92 | -889 | -1934 | -521 | -602 | -945 | -673 | -203 | -756 | 22 | 273 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -25 | -6457 | -7499 | -894 | -1115 | -1666 | -546 | * | * | | | | | | | | | | | | |
| 254(M) | -1561 | -1309 | -3310 | -2786 | -99 | -3163 | -1984 | 569 | -2364 | 1604 | 3948 | -2656 | -2936 | -1983 | -2284 | -2361 | -1493 | 116 | -1472 | -1272 | 274 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -25 | -6457 | -7499 | -894 | -1115 | -777 | -1263 | * | * | | | | | | | | | | | | |
| 255(K) | -475 | -1891 | -137 | 1054 | -2221 | -1359 | -30 | -1946 | 1632 | -1890 | -999 | 2 | -1483 | 1488 | 30 | 1135 | -411 | -1523 | -2049 | -1403 | 275 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 256(V) | -1531 | -1105 | -4020 | -3576 | -1227 | -3695 | -3034 | 2323 | -3387 | 793 | -62 | -3320 | -3500 | -3101 | -3368 | -2941 | -1501 | 2608 | -2576 | -2243 | 276 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 257(H) | -1244 | -2186 | -246 | -319 | -1501 | -1694 | 4400 | -2492 | -417 | -2436 | -1795 | 1396 | -2075 | -501 | -711 | -1152 | -1294 | -2140 | -1842 | -960 | 277 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 258(R) | -675 | -1969 | -242 | 1673 | -2340 | -1479 | -164 | -2032 | 420 | -1985 | -1141 | -153 | 1471 | 261 | 1760 | -560 | -613 | -1643 | -2136 | -1550 | 278 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -453 | -1893 | * | * | | | | | | | | | | | | |
| 259(E) | 377 | -1835 | 1113 | 1421 | -2128 | -1382 | -69 | -1857 | 329 | -1840 | -939 | -29 | -1493 | 377 | 1329 | -322 | -374 | 19 | -2039 | -1371 | 279 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 260(M) | -2315 | -1899 | -4526 | -3941 | 2102 | -4105 | -2681 | 70 | -3638 | 1954 | 3509 | -3704 | -3629 | -2798 | -3304 | -3301 | -2198 | -582 | -1802 | -1604 | 280 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 261(A) | 2818 | -1372 | -1321 | -1214 | -2015 | -1557 | 2623 | -2096 | -1108 | -2284 | -1581 | -1154 | -2074 | -1121 | -1340 | -881 | -964 | -1649 | -2321 | -1711 | 281 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 262(K) | -793 | -2177 | -220 | 1469 | -2548 | -1561 | -289 | -2263 | 2325 | -2196 | -1334 | -214 | -1738 | 141 | -150 | 898 | -737 | -1844 | -2341 | -1711 | 282 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 263(A) | 1931 | -776 | -2058 | -1612 | -1165 | -1647 | -1206 | -433 | -1382 | 945 | -310 | -1370 | -2014 | -1216 | -1530 | -832 | 1640 | -293 | -1672 | -1305 | 283 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 264(M) | -1519 | -1247 | -3637 | -3077 | 1725 | -3081 | -1493 | -37 | -2718 | 1089 | 3901 | -2600 | -2950 | -2153 | -2487 | -2201 | -1437 | -379 | 1806 | -356 | 284 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 265(D) | -1378 | -3094 | 2801 | 1763 | -3349 | -1556 | -771 | -3202 | -821 | -3114 | -2349 | -164 | -2006 | -409 | -1544 | 1050 | -1411 | -2709 | -3307 | -2411 | 285 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 266(W) | -426 | -1591 | -384 | 832 | -1812 | -1435 | -111 | -1488 | 966 | -1565 | -720 | -131 | -1532 | 300 | -184 | 757 | 1423 | -1162 | 2539 | -1242 | 286 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 267(V) | 1401 | -623 | -2516 | -1981 | -808 | -2086 | -1255 | -1461 | -1718 | -518 | 36 | -1694 | -2253 | -1472 | -1752 | 293 | -658 | 1939 | -1375 | -1008 | 287 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 268(W) | -857 | -644 | -3104 | -2515 | 1895 | -2435 | -1142 | 1168 | -2142 | -39 | 357 | -2021 | -2440 | -1737 | -1961 | -1534 | -797 | 2161 | 2512 | -335 | 288 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 269(E) | -1213 | -2845 | 1928 | 2618 | -3115 | -1534 | -660 | -2926 | -607 | -2864 | -2064 | -150 | -1929 | -281 | -1267 | -980 | 833 | -2457 | -3061 | -2225 | 289 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 270(E) | -1357 | -2719 | -146 | 2868 | -3119 | -1782 | -634 | -2833 | 1719 | -2718 | -1948 | -434 | -2077 | -242 | -361 | -1166 | -1309 | -2433 | -2790 | -2201 | 290 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 271(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 291 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 272(C) | -1095 | 2832 | -1254 | -506 | -2502 | -1969 | 1775 | -2085 | 2238 | -2024 | -1241 | -660 | -2004 | 96 | 1706 | -1025 | -959 | -1790 | -2126 | -1723 | 292 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 273(D) | 1682 | -2499 | 2383 | 115 | -3011 | -1503 | -717 | -2803 | -660 | -2789 | -1985 | 1727 | -1918 | -347 | -1292 | -922 | -1145 | -2313 | -2999 | -2214 | 293 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 274(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 294 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 275(O) | -1627 | -2584 | -1823 | -913 | -3248 | -2312 | -430 | -2707 | 1993 | -2449 | -1710 | -969 | -2306 | 3139 | 1660 | -1504 | -1407 | -2413 | -2377 | -2126 | 295 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 276(K) | 949 | -2020 | -181 | 1024 | -2347 | -1460 | -176 | -2077 | 2067 | -2031 | -1143 | 996 | -1606 | 264 | -187 | -477 | -547 | -1653 | -2203 | -1543 | 296 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 277(H) | 1280 | -1815 | -274 | 261 | -2114 | -1392 | 1493 | -1840 | 1076 | -1818 | -916 | 946 | -1489 | 1230 | -102 | -316 | 245 | -1427 | -2010 | -1354 | 297 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 278(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 298 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 279(R) | -836 | -1922 | -846 | -238 | -2255 | -1752 | -261 | -1878 | 494 | -1879 | -1072 | 484 | -1828 | 1594 | 2601 | -770 | -741 | 369 | -2053 | -1564 | 299 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 280(E) | -531 | -1917 | -152 | 1776 | -2240 | -1412 | -166 | -1971 | 212 | -1955 | -1067 | -76 | -1565 | 1351 | -287 | 854 | 1223 | -1553 | -2155 | -1485 | 300 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 281(N) | -756 | -2277 | 1639 | 264 | -2584 | 735 | -320 | -2357 | -45 | -2301 | -1420 | 1764 | -1681 | 1399 | -604 | 499 | -725 | -1902 | -2482 | -1746 | 301 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1243 | -7108 | -811 | -894 | -1115 | -701 | -1378 | * | * | | | | | | | | | | | | |
| 282(T) | 391 | -254 | -749 | -541 | -1519 | -523 | -582 | -1080 | -464 | -1400 | -646 | -345 | -1090 | -368 | -718 | 1584 | 1914 | -580 | -1775 | -1351 | 302 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -36 | -5902 | -6944 | -894 | -1115 | -2014 | -410 | * | * | | | | | | | | | | | | |
| 283(N) | 1491 | -678 | -16 | 71 | -1606 | -696 | -281 | -1227 | -86 | -1488 | -735 | 2022 | -1167 | 9 | -450 | 17 | -79 | -791 | -1790 | -1251 | 303 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -36 | -5902 | -6944 | -894 | -1115 | -655 | -1455 | * | * | | | | | | | | | | | | |
| 284(N) | -690 | -2252 | 1313 | 1338 | -2538 | -1300 | -208 | -2319 | 1491 | -2250 | -1381 | 1988 | -1564 | 211 | -512 | -509 | -660 | -1861 | -2424 | -1672 | 304 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -20 | -6788 | -7830 | -894 | -1115 | -421 | -1984 | * | * | | | | | | | | | | | | |
| 285(D) | -1304 | -3019 | 2680 | 1285 | -3255 | -1544 | -705 | -3097 | -703 | -3006 | -2219 | 1388 | 1348 | -331 | -1319 | -1044 | -1321 | -2611 | -3195 | -2320 | 305 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 286(H) | -30 | 439 | 11 | 363 | -394 | -739 | 699 | -414 | 463 | -757 | 501 | 286 | -577 | 639 | 165 | -23 | 111 | -312 | 697 | -25 | 306 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 287(M) | 1003 | -593 | 321 | -1362 | -615 | -2007 | -849 | 1868 | -1149 | -373 | 2071 | -1286 | -2064 | -949 | -1296 | -1049 | -514 | 769 | -1128 | -747 | 307 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 288(M) | -426 | -945 | -995 | -468 | -1082 | -1580 | 1667 | -681 | -299 | -938 | 2081 | -605 | -1724 | -229 | -641 | 445 | 2054 | -498 | -1403 | -940 | 308 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 289(R) | -1619 | -2365 | -2075 | -1064 | -2835 | -2363 | -469 | -2305 | 1823 | 763 | -1488 | -1073 | -2345 | -67 | 2817 | -1563 | -1402 | -2096 | -2243 | -1997 | 309 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 290(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 310 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 291(O) | -802 | -740 | -2393 | -1814 | 1799 | -2272 | -1035 | 123 | -1529 | 790 | 401 | -1638 | -2287 | 2034 | -1573 | -1335 | -740 | 1456 | -1046 | -619 | 311 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 292(W) | -3500 | -2678 | -4063 | -4226 | 955 | -3934 | -449 | -2563 | -3717 | -2009 | -2016 | -2732 | -3866 | -2798 | -3276 | -3242 | -3394 | -2681 | 5405 | 3043 | 312 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 293(P) | -2931 | -2878 | -3420 | -3706 | -4181 | -2925 | -3468 | -4621 | -3589 | -4490 | -4165 | -3491 | 4225 | -3781 | -3695 | -3182 | -3279 | -4087 | -3594 | -4064 | 313 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 294(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 314 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 295(I) | -2034 | -1595 | -4395 | -3950 | -974 | -4099 | -3249 | 3261 | -3681 | 1202 | 174 | -3748 | -3784 | -3212 | -3556 | -3388 | -1988 | 627 | -2497 | -2285 | 315 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 296(I) | -1757 | -1299 | -4333 | -3971 | -1776 | -4057 | -3755 | 2831 | -3844 | -614 | -541 | -3733 | -3880 | -3700 | -3920 | -3375 | -1749 | 2665 | -3275 | -2830 | 316 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 297(F) | -2590 | -2117 | -4458 | -4084 | 3096 | -4144 | -1957 | -191 | -3757 | 2203 | 405 | -3544 | -3752 | -2887 | -3401 | -3410 | -2485 | -812 | -1135 | -337 | 317 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 298(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 318 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 299(T) | 2050 | -905 | -2305 | -2099 | -2720 | -1206 | -1895 | -2371 | -1974 | -2648 | -1815 | -1479 | -1888 | -1753 | -2118 | 1016 | 2546 | -1624 | -2968 | -2665 | 319 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 300(P) | -2931 | -2878 | -3420 | -3706 | -4181 | -2925 | -3468 | -4621 | -2859 | -4490 | -4165 | -3491 | 4225 | -3781 | -3695 | -3182 | -3279 | -4087 | -3594 | -4064 | 320 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 301(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 321 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 302(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 322 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 303(W) | -4114 | -3274 | -4214 | -4453 | -1722 | -3496 | -2681 | -4109 | -4149 | -3619 | -3615 | -4044 | -3885 | -4032 | -3816 | -4355 | -4248 | -4133 | 6191 | -1329 | 323 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 304(T) | -353 | -974 | -2215 | -2202 | -2896 | -1238 | -2053 | -2560 | -2141 | -2867 | -2052 | -1547 | -1951 | -1940 | -2229 | 1380 | 3291 | -1759 | -3143 | -2840 | 324 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 305(C) | -845 | 3595 | -3279 | -3420 | -3342 | 3140 | -2815 | -3103 | -3232 | -3426 | -2671 | -2300 | -2379 | -2934 | -3057 | -1107 | -1278 | -2270 | -3401 | -3393 | 325 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 306(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 326 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 307(K) | -2620 | -2961 | -3461 | -2046 | -3743 | -2791 | -1570 | -3603 | 3784 | -3387 | -2839 | -2048 | -3039 | -1260 | -465 | -2604 | -2536 | -3331 | -3001 | -2988 | 327 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 308(M) | -402 | -813 | -1034 | 898 | 582 | -1639 | -381 | -420 | -330 | -698 | 1526 | -11 | -1715 | -218 | -668 | 337 | 1310 | -272 | -1195 | 1104 | 328 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -176 | -3166 | -8150 | -310 | -2369 | -701 | -1378 | * | * | | | | | | | | | | | | |
| 309(W) | -1600 | -1315 | -3759 | -3181 | -295 | -3243 | -1874 | 1788 | -2803 | 1756 | 538 | -2802 | -3074 | -2285 | -2600 | -2379 | -1521 | -139 | 4106 | -936 | 330 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 310(D) | -1718 | -3250 | 3403 | -27 | -3066 | -1736 | 2667 | -3486 | -1211 | -3381 | -2732 | -400 | -2240 | -752 | -1917 | -1439 | -1784 | -3023 | -3204 | -2299 | 331 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 311(G) | -1708 | -2667 | 1499 | -644 | -3784 | 3218 | -1636 | -3799 | -1910 | -3782 | -3127 | -941 | -2466 | -1384 | -2554 | -1618 | -1929 | -3151 | -3633 | -3136 | 332 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 312(K) | -708 | -2195 | 956 | 221 | -2514 | -1474 | -242 | -2264 | 2240 | -2194 | -1308 | 1084 | -1658 | 1697 | -314 | -557 | -656 | -1821 | -2352 | -1662 | 333 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 313(P) | -762 | -1504 | -940 | -454 | 1424 | -1749 | -441 | -1317 | 1946 | -1439 | -747 | -629 | 1988 | -176 | -300 | -813 | -723 | -1105 | -1603 | -967 | 334 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 314(I) | -1232 | -1121 | -3291 | -2953 | -1431 | -2753 | -2412 | 3122 | -2652 | -599 | -404 | -2590 | -2982 | -2506 | -2674 | -2020 | 1485 | 773 | -2421 | -2034 | 335 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 315(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 336 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 316(G) | -1046 | -1820 | -755 | -1003 | -3341 | 2933 | -1683 | -3325 | -1756 | -3410 | -2651 | 2259 | -2235 | -1456 | -2142 | -1125 | -1359 | -2537 | -3369 | -2897 | 337 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 317(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 338 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 318(W) | -3425 | -2618 | -4155 | -4330 | 3859 | -3949 | -484 | -2303 | -3894 | -1728 | -1759 | -2779 | -3865 | -2847 | -3389 | -3247 | -3323 | -2490 | 3919 | 1426 | 339 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 319(R) | -1940 | -2623 | -2163 | -1317 | -2718 | -2498 | 2633 | -2821 | 557 | -2576 | -1920 | -1294 | -2549 | -305 | 3406 | -1859 | -1734 | -2575 | -2279 | -1885 | 340 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 320(A) | 2865 | -932 | -2456 | -2481 | -3066 | -1198 | -2239 | -2763 | -2443 | -3058 | -2203 | -1637 | -1941 | -2156 | -2474 | 1737 | -732 | -1840 | -3307 | -3058 | 341 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 321(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 342 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 322(O) | -2562 | -2904 | -1886 | -1971 | -3251 | -2661 | -2079 | -3690 | -1565 | -3469 | -3081 | -2107 | -3091 | 4371 | -1665 | -2585 | -2674 | -3411 | -3077 | -2821 | 343 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 323(I) | -1757 | -1300 | -4333 | -3971 | -1764 | -4057 | -3754 | 2871 | -3843 | -611 | -539 | -3733 | -3880 | -3699 | -3919 | -3375 | -1749 | 2625 | -3273 | -2829 | 344 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 324(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 345 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 325(I) | -1899 | -1466 | -4358 | -3871 | -1002 | -3993 | -3149 | 2479 | -3652 | 1948 | 170 | -3634 | -3690 | -3153 | -3516 | -3233 | -1847 | 1460 | -2466 | -2295 | 346 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 326(P) | 1615 | -1136 | -2222 | -2310 | -3082 | -1373 | -2227 | -2731 | -2358 | -3036 | -2272 | -1689 | 3445 | -2139 | -2424 | -761 | -938 | -1937 | -3279 | -3042 | 347 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 327(V) | 776 | -978 | -1248 | -821 | -1609 | -1418 | -840 | -1138 | -733 | -1453 | -710 | 1478 | -1781 | -614 | -1074 | 1249 | -508 | 1777 | -1905 | -1460 | 348 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 328(D) | 1973 | -1793 | 2321 | -222 | -2801 | -1401 | -864 | -2543 | -758 | -2614 | -1785 | -457 | -1858 | -510 | -1294 | 684 | -896 | -1978 | -2851 | -2198 | 349 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 329(O) | -1008 | -2231 | -986 | -310 | -3701 | -1861 | -258 | -2315 | 1642 | -2173 | -1344 | -511 | -1911 | 2494 | 1827 | 403 | -883 | -1946 | -2224 | -1767 | 350 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 330(D) | -1037 | -2659 | 2253 | 1117 | -2928 | -1504 | -509 | -2731 | 1324 | -2651 | -1807 | 1958 | -1830 | -106 | -940 | -826 | -1023 | -2261 | -2827 | -2032 | 351 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 331(H) | -935 | -2308 | 2421 | 146 | -2574 | -1508 | 2726 | -2388 | -331 | -2395 | -1577 | -187 | -1822 | -135 | -890 | -787 | 1407 | -1976 | -2588 | -1852 | 352 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 332(M) | -650 | -1996 | 1349 | 1466 | -2242 | -1448 | -264 | -1958 | 34 | -1982 | 2809 | -101 | 597 | 150 | -493 | -533 | -608 | -1580 | -2227 | -1552 | 353 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 333(E) | 1263 | -2196 | -74 | 2930 | -2933 | -1571 | -907 | -2588 | -788 | -2712 | -1962 | -469 | -2014 | -562 | -1290 | -991 | -1179 | -2137 | -2954 | -2290 | 354 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 334(H) | -1082 | -2079 | -440 | 1291 | -845 | -1821 | 3880 | -1961 | -281 | -1944 | -1264 | -509 | -2017 | -267 | -666 | -989 | -1031 | -1699 | -1298 | 1603 | 355 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 335(F) | 1005 | -431 | -2207 | -1610 | 1664 | -1966 | -799 | 1077 | 332 | 809 | 427 | -1386 | -2016 | -1061 | -1337 | -1023 | -432 | 229 | -879 | -519 | 356 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 336(H) | -30 | 439 | 11 | 363 | -394 | -739 | 699 | -414 | 463 | -757 | 501 | 286 | -577 | 639 | 165 | -23 | 111 | -312 | 697 | -25 | 357 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 337(D) | -996 | -2602 | 2334 | 1640 | -2872 | -1493 | -484 | -2671 | -308 | -2598 | -1748 | -104 | 783 | 1779 | -913 | -792 | -980 | -2205 | -2778 | -1990 | 358 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 338(A) | 1659 | -679 | -1813 | -1259 | -745 | -1962 | -855 | 1055 | -1039 | -483 | 101 | -1222 | -2054 | 1021 | -1227 | -1014 | -543 | 1478 | -1248 | -857 | 359 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 339(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 360 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 340(V) | -891 | -1677 | -1034 | -464 | -1912 | -1849 | -400 | -1350 | 1652 | -1575 | -859 | -635 | -1938 | 1706 | 124 | -916 | -803 | 2029 | -1916 | -1472 | 361 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 341(D) | -869 | -2445 | 2202 | 1077 | -2729 | 120 | -389 | -2516 | 1310 | -2445 | -1574 | 1245 | -1739 | 29 | -730 | -684 | -841 | -2053 | -2620 | -1858 | 362 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 342(W) | -4114 | -3274 | -4214 | -4453 | -1722 | -3496 | -2681 | -4109 | -4149 | -3619 | -3615 | -4044 | -3885 | -4032 | -3816 | -4355 | -4248 | -4133 | 6191 | -1329 | 363 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 343(L) | -2642 | -2168 | -4788 | -4235 | -465 | -4513 | -3241 | 96 | -3878 | 2891 | 2122 | -4166 | -3888 | -3023 | -3544 | -3807 | -2521 | -607 | -2140 | -2183 | 364 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 344(E) | -588 | -2030 | -204 | 1763 | -2360 | -1459 | -147 | -2094 | 1522 | -2032 | -1135 | -95 | -1592 | 1372 | -129 | 847 | -526 | -1661 | -2190 | -1529 | 365 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 345(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 366 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 346(Y) | -3482 | -2868 | -3701 | -3919 | 238 | -3552 | -1112 | -3000 | -3638 | -2516 | -2526 | -3027 | -3772 | -3101 | -3341 | -3418 | -3527 | -3071 | -441 | 4711 | 367 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 347(K) | -1779 | -2672 | -1588 | -963 | -3316 | -2329 | -561 | -2833 | 3294 | -2578 | -1879 | -1030 | -2399 | 1424 | 589 | -1653 | -1579 | -2550 | -2489 | -2237 | 368 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 348(P) | -2931 | -2878 | -3420 | -3706 | -4181 | -2925 | -3468 | -4621 | -3859 | -4490 | -4165 | -3491 | 4225 | -3781 | 3695 | -3182 | -3279 | -4087 | -3595 | -4064 | 369 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 349(E) | -1283 | -2980 | 2293 | 2465 | -3222 | -1551 | -680 | -3054 | 846 | -2961 | -2167 | -151 | -1956 | -302 | -1278 | -1029 | -1292 | -2574 | -3140 | -2287 | 370 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 350(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 371 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 351(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 372 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 352(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 373 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 353(D) | -1170 | -2662 | 2768 | 152 | -3076 | -1523 | -716 | -2882 | -677 | -2851 | -2058 | 1883 | -1940 | -347 | -1326 | -973 | 1251 | -2402 | -3056 | -2245 | 374 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 354(E) | 1031 | -2152 | -91 | 2416 | -2507 | -1517 | -346 | -2220 | 982 | -2201 | -1350 | -188 | -1736 | 71 | -388 | -657 | -752 | -1810 | -2390 | -1731 | 375 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 355(N) | -1247 | -2802 | 2354 | 164 | -3217 | -1531 | -760 | -3060 | -767 | -2997 | -2213 | 2573 | -1971 | -395 | -1447 | 1055 | -1298 | -2553 | -3188 | -2339 | 376 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 356(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 377 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 357(H) | 969 | -1896 | 1173 | 279 | -2199 | -1387 | 1573 | -1938 | 276 | -1912 | -1011 | -34 | -1518 | 1339 | -236 | 939 | -421 | -1513 | -2105 | -1426 | 378 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 358(V) | -1097 | -861 | -3273 | -2702 | -715 | -2790 | -1749 | 1319 | -2390 | 1604 | 246 | -2365 | 510 | -2047 | -2299 | -1909 | -1047 | 2041 | -1564 | -1253 | 379 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 359(K) | -627 | -934 | -1396 | -826 | -1049 | -1906 | -680 | 1291 | 2041 | -745 | -142 | -930 | -1983 | -512 | -793 | -921 | 762 | 912 | -1475 | -1045 | 380 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 360(D) | 417 | -2242 | 2268 | 951 | -2534 | -1439 | -289 | -2301 | 2 | -2249 | -1365 | -64 | 475 | 1392 | -551 | -566 | -688 | -1853 | -2431 | -1702 | 381 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 361(D) | -756 | -2213 | 2042 | 1784 | -2484 | -1455 | -327 | -2233 | -59 | -287 | -1351 | -90 | -1688 | 90 | -612 | 609 | -722 | -1813 | -2423 | -1705 | 382 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 362(I) | -1758 | -1302 | -4331 | -3969 | -1754 | -4053 | -3745 | 3003 | -3839 | -600 | -530 | -3730 | -3876 | -3691 | -3912 | -3370 | -1751 | 2469 | -3262 | -2822 | 383 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 363(K) | -489 | -1736 | -399 | 869 | -1996 | -1468 | -108 | -1679 | 1463 | 680 | -849 | -140 | -1560 | 1326 | -65 | -410 | 492 | -1326 | -1942 | -1336 | 384 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 364(E) | 1607 | -1738 | -268 | 2001 | -2459 | -1405 | -567 | -2171 | -308 | -2231 | -1384 | -339 | -1737 | -179 | -802 | 1027 | -695 | -1699 | -2473 | -1839 | 385 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 365(I) | -521 | -410 | -2443 | -1845 | 1682 | -2040 | -909 | 1831 | -1536 | -217 | 389 | 581 | -2091 | -1245 | -1495 | -1112 | 673 | 1143 | -913 | -551 | 386 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 366(M) | -1028 | -781 | -3313 | -2728 | -655 | -2725 | -1667 | 2105 | -2396 | 791 | 2636 | -2332 | -2694 | -2027 | -2260 | -1840 | 662 | 1307 | -1459 | -1146 | 387 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 367(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 388 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 368(K) | -420 | -1711 | -319 | 889 | -1985 | -1406 | -81 | -1683 | 1799 | -1711 | -835 | -80 | -1506 | 351 | -148 | 802 | 593 | 66 | -1944 | -1311 | 389 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 369(G) | -1210 | -2695 | 1728 | 114 | -3097 | 2436 | -713 | -2899 | 1005 | -2848 | -2055 | 236 | -1965 | -340 | -1178 | -1009 | -1238 | -2429 | -3026 | -2250 | 390 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 370(D) | -1173 | -2847 | 2185 | 2156 | -3091 | -1523 | 1843 | -2917 | -527 | -2832 | -2014 | 1280 | -1899 | -221 | -1180 | -937 | -1174 | -2440 | -3014 | -2176 | 391 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 371(K) | -733 | -1639 | -900 | -275 | -1870 | -1727 | -272 | -1476 | 1449 | 1052 | -793 | -476 | -1798 | 105 | 1100 | 1022 | -645 | -1222 | -1849 | -1373 | 392 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 372(R) | -2124 | -2788 | -2710 | -1449 | -3624 | -2637 | -576 | -2974 | 1929 | -2640 | -1977 | -1344 | -2596 | -161 | 3417 | -2010 | -1819 | -2745 | -2479 | -2379 | 393 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 373(M) | -2186 | -1770 | -4484 | -3908 | -547 | -4083 | -2924 | 1892 | -3619 | 1562 | 3822 | -3715 | -3642 | -2876 | -3343 | -3290 | -2088 | -106 | -2072 | -2052 | 394 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 374(A) | 2525 | -1036 | -2401 | -2529 | -3239 | 2375 | -2366 | -2958 | -2629 | -3244 | -2393 | -1719 | -2028 | -2303 | -2639 | -657 | -852 | -1993 | -3425 | -3237 | 395 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 375(M) | 1980 | -959 | -1279 | -892 | -1385 | -1524 | -842 | -905 | -763 | -1211 | 2928 | 1065 | -1852 | -673 | -1053 | -675 | -559 | -683 | -1743 | -1304 | 396 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 376(N) | -1426 | -2353 | -948 | -735 | -2920 | -1991 | -796 | -2769 | 68 | -2666 | -1942 | 3441 | -2268 | -432 | 1742 | -1361 | -1415 | -2383 | -2592 | -2147 | 397 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 377(P) | -566 | -1202 | -1850 | -1997 | -3117 | -1371 | -2101 | -2989 | -2185 | -3198 | -2391 | -1549 | 3625 | -1982 | -2305 | 1013 | -967 | -2094 | -3288 | -2963 | 398 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -276 | -7108 | -2582 | -894 | -1115 | -701 | -1378 | * | * | | | | | | | | | | | | |
| 378(I) | -820 | -759 | -2281 | -1810 | -939 | -2345 | -1389 | 2404 | -1595 | -425 | -18 | 1689 | -2430 | -1447 | -1742 | -1465 | -804 | 1594 | -1641 | -1225 | 399 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -453 | -1893 | * | * | | | | | | | | | | | | |
| 379(T) | 1785 | -732 | -2107 | -1994 | -2428 | -1065 | -1767 | -1811 | -1860 | -2282 | -1548 | -1351 | -1750 | -1665 | -1956 | -390 | 2954 | -1225 | -2740 | -2439 | 400 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -453 | -1893 | * | * | | | | | | | | | | | | |
| 380(N) | -1559 | -3098 | 310 | 1592 | -3431 | -1657 | -945 | -3340 | -959 | -3271 | -2572 | 3495 | -2146 | -611 | -1578 | -1301 | -1621 | -2860 | -3383 | -2547 | 401 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 381(G) | 2030 | -1051 | -2376 | -2525 | -3268 | 2820 | -2382 | -2992 | -2652 | -3277 | -2428 | -1726 | -2039 | -2322 | -2659 | -672 | -869 | -2018 | -3447 | -3263 | 402 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 382(G) | -1587 | -1953 | -2017 | -2080 | -898 | 3122 | -1483 | -2565 | -2178 | -2576 | -2101 | -1908 | -2727 | -2015 | -2307 | -1743 | -1817 | -2251 | -1457 | 2463 | 403 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -195 | -7108 | -3069 | -894 | -1115 | -701 | -1378 | * | * | | | | | | | | | | | | |
| 383(K) | -585 | -1070 | -1140 | -510 | -1174 | -1742 | -358 | 751 | 1799 | -916 | -239 | -641 | -1802 | -103 | 873 | -754 | -507 | 1342 | -1431 | -1005 | 404 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -6931 | -7973 | -894 | -1115 | -505 | -1760 | * | * | | | | | | | | | | | | |
| 384(I) | -732 | -1273 | 1962 | -516 | -1501 | -1754 | -770 | 1970 | -673 | -1163 | -572 | -718 | -1976 | -522 | -1082 | -902 | 1162 | -263 | -1908 | -1404 | 405 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 385(H) | -542 | -1652 | -558 | -18 | -1880 | -1542 | 2080 | 339 | 360 | -1605 | -778 | -241 | 1147 | 1217 | 1461 | -492 | -468 | -1229 | -1864 | -1303 | 406 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 386(K) | -682 | -1971 | -580 | 740 | -2315 | -1607 | -158 | -1989 | 2284 | 162 | -1077 | 529 | -1686 | 280 | 734 | -578 | -595 | -1611 | -2087 | -1523 | 407 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 387(H) | -30 | 439 | 11 | 363 | -394 | -739 | 699 | -414 | 463 | -757 | 501 | 286 | -577 | 639 | 165 | -23 | 111 | -312 | 697 | -25 | 408 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 388(P) | 415 | -2181 | 1668 | 189 | -2543 | -1458 | -400 | -2293 | -146 | -2281 | -1425 | -138 | 2240 | 1274 | -694 | -643 | -469 | -1860 | -2492 | -1780 | 409 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 389(L) | -1646 | -1694 | -2904 | -2680 | -1050 | -2701 | -2138 | -547 | -2336 | 2673 | -123 | -2479 | 1513 | -2198 | -2336 | -2107 | -1735 | -860 | -2077 | -1777 | 410 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 390(D) | -430 | -1571 | 1536 | 153 | -1777 | -1435 | -129 | 307 | 1131 | -1533 | -700 | 889 | -1538 | 275 | -255 | -380 | -371 | 598 | -1838 | -1235 | 411 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 391(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 412 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 392(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 413 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 393(D) | -123 | -3021 | 2652 | 1083 | -3262 | -1545 | -715 | -3102 | -722 | -3016 | -2232 | 2288 | -1970 | -344 | -1422 | -1053 | -1333 | -2618 | -3208 | -2331 | 414 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 394(W) | -1183 | -940 | -3255 | -2753 | 1534 | -2632 | -772 | 1086 | -2365 | 1132 | 71 | -2086 | -2628 | -1856 | -2132 | -1737 | -1115 | -336 | 3856 | 1849 | 415 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 395(R) | -1025 | -2540 | 1775 | 1142 | -2847 | -1561 | -472 | -2610 | -136 | -2532 | -1695 | -183 | -1846 | -64 | 2638 | -837 | -993 | -2170 | -2686 | -1970 | 416 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 396(D) | -1284 | -2963 | 2433 | 216 | -3207 | -1549 | -693 | -3050 | -653 | -2963 | -2174 | 2058 | -1961 | 2341 | -1315 | -1034 | -1299 | -2571 | -3142 | -2286 | 417 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 397(Y) | -3621 | -2707 | -4176 | -4424 | 2970 | -4050 | -394 | -2539 | -4003 | -1942 | -1987 | -2749 | -3933 | -2855 | -3451 | -3299 | -3499 | -2690 | 349 | 4083 | 418 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 398(C) | 1443 | 2403 | -1117 | 1144 | -997 | -1629 | -520 | -480 | -452 | 234 | -131 | -706 | -1773 | -348 | -779 | -656 | -418 | -324 | -1362 | -922 | 419 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 399(V) | -1742 | -1294 | -4287 | -3868 | -1507 | -3983 | -3425 | 2151 | -3706 | 586 | -316 | -3621 | -3770 | -3449 | -3709 | -3254 | -1716 | 2871 | -2925 | -2571 | 420 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 400(D) | -730 | -2244 | 2028 | 1115 | -2543 | -1450 | -283 | -2307 | 1800 | -2248 | -1364 | -74 | -1665 | 147 | -498 | -571 | 502 | -1859 | -2424 | -1702 | 421 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 401(N) | -410 | -1793 | -248 | 958 | -2083 | -143 | -54 | -1808 | 1270 | -1797 | -898 | 1557 | -1482 | 391 | -146 | -306 | 586 | 53 | -2000 | -1340 | 422 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 402(O) | -430 | -1511 | -419 | 58 | -1825 | 563 | -219 | -1494 | 116 | -1597 | -764 | 1033 | -1570 | 1217 | -353 | 1025 | -404 | 892 | -1898 | -1308 | 423 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 403(K) | 42 | -2025 | 1238 | 279 | -2338 | -1408 | -138 | -2090 | 1948 | -2034 | -1127 | 1026 | -1554 | 1361 | -253 | -410 | -491 | -1645 | -2204 | -1512 | 424 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 404(E) | -625 | -2031 | -279 | 1765 | -2367 | -1499 | -161 | -2087 | 353 | -2026 | -1140 | -139 | 1309 | 1668 | 922 | -500 | -559 | -1667 | -2180 | -1544 | 425 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1300 | -7108 | -769 | -894 | -1115 | -701 | -1378 | * | * | | | | | | | | | | | | |
| 405(Y) | -1580 | -1211 | -2445 | -2254 | 2497 | -2497 | 449 | -742 | -1944 | -476 | -322 | -1430 | -2471 | -1343 | -1796 | -1668 | -1507 | -820 | 1088 | 3543 | 426 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -560 | -1636 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 406(G) | -1371 | -2394 | 1717 | -285 | -3391 | 3003 | -1248 | -3345 | -1454 | -3349 | -2666 | -589 | -2148 | -975 | -2092 | -1270 | -1563 | -2745 | -3295 | -2730 | 427 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 407(H) | 1177 | -1467 | -267 | 124 | -1912 | -1286 | 2549 | -1618 | 132 | -1695 | -852 | 1230 | -1499 | 193 | -333 | 681 | -372 | -1236 | -1957 | -1349 | 428 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 408(N) | -352 | -1085 | -738 | -561 | -1975 | 1933 | -822 | -1555 | -672 | -1841 | -1078 | 2120 | -1685 | -547 | -1041 | -473 | -532 | 758 | -2198 | -1695 | 429 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -725 | -6850 | -1371 | -894 | -1115 | -1215 | -813 | * | * | | | | | | | | | | | | |
| 409(W) | -643 | -1210 | -455 | 1427 | -532 | -1453 | -184 | -970 | -26 | -1073 | -478 | -390 | -1652 | -90 | -302 | -705 | -607 | -812 | 4240 | -180 | 430 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -348 | -6155 | -2320 | -894 | -1115 | -1881 | -457 | * | * | | | | | | | | | | | | |
| 410(G) | -461 | -838 | -976 | -1119 | -2120 | 3148 | -1219 | -2101 | -1326 | -2273 | -1700 | -986 | -1505 | -1212 | -1430 | -653 | -781 | -1558 | -1923 | -1928 | 431 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -560 | -1636 | * | * | | | | | | | | | | | | |
| 411(O) | -389 | -1056 | -645 | -768 | -1124 | -1508 | -222 | -612 | 34 | 219 | -187 | -343 | -1598 | 1815 | -346 | -489 | -329 | 1199 | -1410 | -918 | 432 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -453 | -1893 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 412(F) | 523 | -749 | -1182 | -612 | 1262 | -1690 | -436 | -327 | 1202 | 257 | 75 | -713 | -1761 | -315 | 572 | -681 | -361 | 558 | -1146 | -721 | 433 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 413(O) | -838 | -2270 | 27 | 1546 | -2609 | -1503 | -383 | -2361 | -43 | -2318 | -1463 | -158 | -1752 | 2803 | -531 | 937 | -810 | -1929 | -2497 | -1800 | 434 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 414(D) | 2081 | -2191 | 2846 | -271 | -3192 | -1547 | -1150 | -2913 | -1247 | -3052 | -2319 | -548 | -2085 | -840 | -1860 | -1066 | -1314 | -2364 | -3266 | -2572 | 435 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 415(M) | 746 | -729 | -1725 | -1241 | -1091 | -1556 | -930 | -594 | -1043 | -922 | 3667 | -1111 | 404 | -891 | -1250 | -698 | 914 | -410 | -1509 | -1123 | 436 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 416(I) | -556 | -796 | -1468 | -861 | -813 | -1848 | -559 | 1435 | 1067 | 271 | 42 | -912 | -1905 | -460 | 1342 | -865 | -488 | 747 | -1213 | -814 | 437 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 425(V) | -1646 | -1230 | -4148 | -3696 | -1391 | -3782 | -3103 | 2535 | -3497 | -323 | 1927 | -3416 | -3609 | -3214 | -3466 | -3018 | -1616 | 2552 | -2681 | -2340 | 446 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 418(W) | -1686 | -1388 | -3865 | -3280 | -313 | -3346 | -1998 | 1605 | -2910 | 2183 | 589 | -2918 | -3142 | -2351 | -2689 | -2486 | -1602 | -216 | 3506 | -1080 | 439 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 419(G) | -497 | -1132 | -1973 | -2195 | -3328 | 3237 | -2289 | -3194 | -2532 | -3410 | -2549 | -1611 | -2057 | -2201 | -2603 | 897 | -926 | -2151 | -3487 | -3237 | 440 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 420(K) | 632 | -1777 | 1362 | 250 | -2087 | -1381 | -86 | -1807 | 1431 | -1808 | -914 | -51 | -1497 | 355 | -193 | 817 | -369 | -425 | -2019 | -1362 | 441 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 421(Y) | -3621 | -2707 | -4176 | -4424 | 2953 | -4049 | -394 | -2539 | -4002 | -1942 | -1987 | -2749 | -3933 | -2854 | -3451 | -3299 | -3499 | -2690 | 349 | 4093 | 442 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 422(C) | -642 | 1771 | -2908 | -2287 | 1063 | -2214 | -1093 | 1477 | -1913 | 1497 | 494 | -1833 | -2239 | -1538 | -1745 | -1304 | 765 | 369 | -942 | -612 | 443 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 423(R) | -1005 | -2443 | 1553 | 92 | -2784 | -1584 | -463 | -2543 | -57 | -2471 | -1639 | 1177 | -1853 | -56 | 2770 | -836 | -972 | -2113 | -2612 | -1931 | 444 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 424(D) | -1148 | -2724 | 2898 | 174 | -3006 | -1564 | -566 | -2796 | 951 | -2711 | -1895 | -178 | -1903 | 1815 | -851 | -933 | -1132 | -2344 | -2872 | -2108 | 445 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 425(V) | -1646 | -1230 | -4148 | -3696 | -1391 | -3782 | -3103 | 2535 | -3497 | -323 | 1927 | -3416 | -3609 | -3214 | -3466 | -3018 | -1616 | 2552 | -2681 | -2340 | 446 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 426(I) | 401 | -900 | -3283 | -2756 | 1640 | -2752 | -1735 | 2834 | -2451 | -121 | 132 | -2375 | -2775 | -2110 | -2360 | -1897 | -1085 | 615 | -1519 | -1079 | 447 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 427(K) | -834 | -1941 | -615 | 845 | -2257 | -1704 | -312 | -1778 | 2586 | -1890 | -1101 | -402 | -1823 | 95 | 65 | -764 | -756 | 788 | -2124 | -1599 | 448 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 428(N) | -857 | -1859 | -733 | -254 | -2082 | -1745 | -340 | -1726 | 1897 | 679 | -1022 | 2134 | -1861 | 45 | 77 | -813 | -778 | -1455 | -2024 | -1510 | 449 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 429(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 450 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 430(P) | -1140 | -1553 | -2272 | -2156 | -1935 | -1979 | -1912 | -1526 | -1824 | -1503 | 1339 | -1897 | 3724 | -1871 | -1917 | -1397 | -1391 | -1428 | -2485 | -2072 | 451 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 431(H) | -464 | -1881 | 1234 | 255 | -2190 | -1407 | 2368 | -1921 | 1008 | -1884 | -981 | -50 | -1513 | 375 | 482 | -349 | 1263 | -1498 | -2063 | -1403 | 452 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 432(N) | -761 | -2121 | 1175 | 150 | -2581 | -1441 | -443 | -2337 | -205 | -2327 | -1467 | 2649 | -1731 | -36 | -757 | 420 | 1163 | -1879 | -2535 | -1825 | 453 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 433(F) | -1857 | -1592 | -3755 | -3460 | 3638 | -3255 | -1454 | -16 | -3144 | -214 | -206 | -2800 | -3287 | 2604 | -2951 | -2505 | -1863 | 1480 | -853 | 99 | 454 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 434(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 455 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 435(L) | -886 | -722 | -2913 | -2339 | -608 | 1022 | -1423 | 1356 | -2029 | 1682 | 294 | -2025 | -2497 | -1718 | -1972 | -1579 | -842 | 1130 | -1337 | -1008 | 456 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 436(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 457 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 437(G) | -468 | -1108 | -1987 | -2183 | -3307 | 3093 | -2261 | -3159 | -2489 | -3374 | -2507 | -1593 | -2035 | -2163 | -2570 | 1410 | -895 | -2119 | -3471 | -3217 | 458 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 438(H) | -30 | 439 | 11 | 363 | -394 | -739 | 699 | -414 | 463 | -757 | 501 | 286 | -577 | 639 | 165 | -23 | 111 | -312 | 697 | -25 | 459 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 439(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 460 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 440(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 461 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 441(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 462 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 442(T) | -439 | -840 | -1804 | -1403 | -1361 | -1523 | -1133 | -816 | -1185 | 681 | -536 | -1214 | -1931 | -1069 | -1378 | 642 | 2718 | -603 | -1788 | -1389 | 463 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 443(A) | 1657 | -1594 | -404 | 1150 | -1818 | -1465 | -154 | -1471 | 969 | -1566 | 1309 | -173 | -1572 | 248 | -202 | -422 | -412 | -1160 | -1861 | -1272 | 464 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 444(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 465 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 445(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 466 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 446(R) | -1905 | -2715 | -2334 | -1200 | -3487 | -2506 | -485 | -2858 | 1904 | -2546 | -1846 | -1167 | -2464 | 1439 | 3148 | -1780 | -1627 | -2602 | -2423 | -2263 | 467 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 447(L) | -2639 | -2158 | -4642 | -4194 | 1586 | -4340 | -2490 | -51 | -3890 | 2827 | 573 | -3860 | -3832 | -2979 | -3524 | -3629 | -2524 | -732 | -1565 | -1006 | 468 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 448(O) | -549 | -1725 | -324 | 98 | -1793 | -1481 | -198 | -1668 | 163 | -1723 | -892 | 839 | -1618 | 2328 | -290 | 843 | -499 | -1331 | -1882 | 1794 | 469 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 449(A) | 2109 | -2374 | 1307 | 1077 | -2738 | 326 | -514 | -2505 | -344 | -2485 | -1647 | -151 | -1804 | -118 | -934 | -766 | -932 | -2058 | -2698 | -1950 | 470 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 450(A) | 1280 | -376 | -2219 | -1624 | 1011 | -1905 | -779 | 1073 | -1336 | -235 | 411 | -1368 | -1975 | -1065 | -1339 | 339 | 580 | 955 | -851 | -492 | 471 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 451(F) | -2619 | -2089 | -3969 | -3846 | 3011 | -3673 | -612 | -1304 | -3453 | 1530 | -788 | -2671 | -3552 | -2584 | -3066 | -2851 | -2522 | -1556 | 92 | 2879 | 472 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 452(E) | 400 | -2342 | 1163 | 2306 | -2664 | -1461 | -401 | -2438 | -168 | -2392 | -1527 | -102 | -1735 | 14 | -743 | 947 | -818 | -1984 | -2583 | -1837 | 473 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 453(H) | -424 | -834 | -1231 | -741 | -1039 | 183 | 2171 | -588 | -582 | -902 | -199 | -797 | -1793 | -479 | -878 | -660 | 1442 | 1664 | -1404 | -972 | 474 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 454(T) | -825 | -1543 | -1050 | -931 | -2411 | -1607 | -1105 | -2069 | -661 | -2229 | -1555 | -978 | -2065 | 1333 | -881 | -930 | 3234 | -1676 | -2544 | -2072 | 475 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 455(N) | -948 | -2217 | -192 | -59 | -2753 | 871 | -516 | -2480 | 1579 | -2431 | -1604 | 2747 | -1874 | -115 | -403 | -831 | -947 | -2039 | -2574 | -1954 | 476 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 456(R) | -2118 | -2789 | -2710 | -1441 | -3626 | -2635 | -569 | -2972 | 2088 | -2636 | -1971 | -1337 | -2591 | -153 | 3343 | -2003 | -1811 | -2743 | -2476 | -2375 | 477 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -276 | -7108 | -2582 | -894 | -1115 | -701 | -1378 | * | * | | | | | | | | | | | | |
| 457(O) | -2077 | -2533 | -1425 | -1467 | -2808 | -2285 | -1598 | -3134 | -1059 | -2958 | -2537 | -1616 | -2694 | 4251 | -1184 | -2087 | -2168 | -2871 | -2703 | -2369 | 478 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 458(W) | -3599 | -2878 | -3805 | -3989 | -1220 | -3156 | -2211 | -3491 | -3618 | -3057 | -3027 | -3568 | -3532 | -3525 | -3338 | -3829 | -3720 | -3529 | 6135 | -830 | 479 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 459(M) | -718 | -1070 | 1476 | -726 | -732 | -1903 | -713 | -152 | -681 | 774 | 3189 | -882 | -1991 | -541 | -1003 | -968 | -669 | -221 | -1408 | -983 | 480 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 460(E) | 598 | -1592 | -123 | 1874 | -1828 | -1337 | -104 | -1490 | 228 | -43 | -755 | 967 | -1490 | 296 | -254 | -355 | -375 | -1164 | -1876 | -1258 | 481 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 461(P) | -556 | -1744 | 1230 | 129 | -2482 | 1292 | -454 | -2234 | -252 | -2255 | -1403 | -147 | 1758 | -66 | -790 | 781 | -633 | -1727 | -2476 | -1801 | 482 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1043 | -6850 | -983 | -894 | -1115 | -1215 | -813 | * | * | | | | | | | | | | | | |
| 462(Y) | -1345 | -1235 | -1689 | -1605 | 1266 | -1964 | 117 | -925 | -1303 | -775 | -592 | -1236 | -2169 | -1119 | -1309 | -1450 | -1367 | -939 | 590 | 3938 | 483 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -560 | -1636 | * | * | | | | | | | | | | | | |
| 463(I) | -1578 | -1151 | -4046 | -3597 | -1151 | -3733 | -3046 | 3001 | -3402 | 771 | 18 | -3355 | -3517 | -3085 | -3372 | -2981 | -1545 | 1808 | -2540 | -2237 | 484 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -453 | -1893 | * | * | | | | | | | | | | | | |
| 464(H) | -620 | -1972 | -273 | 140 | -2293 | -1493 | 2910 | -2020 | 1123 | -1988 | -1114 | 1414 | -1632 | 244 | -127 | 1037 | -563 | -1615 | -2160 | -1523 | 485 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 465(E) | 290 | -1861 | 861 | 1446 | 981 | -1390 | -101 | -1871 | 273 | -1861 | -968 | 953 | 303 | 339 | -239 | -355 | -411 | -1463 | -2069 | -1398 | 486 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 466(P) | -546 | -1977 | 862 | 1025 | -2262 | -1409 | -155 | -2002 | 204 | -546 | -1086 | -48 | 1748 | 1636 | -313 | -420 | -495 | -1582 | -2175 | -1489 | 487 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 467(W) | -477 | -661 | -1479 | -920 | -458 | -1795 | -520 | -227 | -729 | -529 | 143 | 1513 | -1868 | -571 | -958 | 304 | -420 | 1257 | 2766 | 1177 | 488 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 468(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 489 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 469(O) | -1336 | -2814 | 130 | 2632 | -3112 | -1670 | -702 | -2921 | -403 | -2830 | -2067 | -313 | -2037 | 2655 | -853 | -1120 | -1328 | -2494 | -2954 | -2238 | 490 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 470(W) | -1164 | -1540 | 661 | -1080 | 2483 | -2257 | 1994 | -1245 | -947 | -1304 | -742 | 745 | -2310 | -770 | -1263 | -1253 | -1097 | -1115 | 2555 | 1863 | 491 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 471(M) | -459 | -840 | -1110 | 504 | -907 | -1674 | -501 | -397 | -456 | -727 | 3234 | -715 | -1788 | -352 | -771 | 770 | -419 | 680 | -1288 | -853 | 492 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 472(H) | 1702 | -1846 | -317 | 119 | -2155 | -1480 | 1717 | -1860 | 1008 | -1870 | -1009 | 1392 | -1616 | 236 | -157 | -482 | -520 | -1482 | -2080 | -1459 | 493 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 473(P) | 1735 | -849 | -2213 | -1898 | -1800 | -1446 | -1575 | -902 | -1724 | -1568 | -933 | -1474 | 2335 | -1533 | -1863 | -706 | -666 | 1535 | -2237 | -1882 | 494 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 474(K) | 373 | -1864 | 703 | 990 | -2179 | -1360 | -29 | -1928 | 1276 | -1877 | -955 | 4 | -1460 | 1260 | -124 | 542 | 486 | -1483 | -2049 | -1367 | 495 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 475(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 496 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 476(R) | -1165 | -2238 | -1063 | -503 | -2794 | 820 | -418 | -2401 | 526 | -2281 | -1492 | -670 | -2047 | 2040 | 2681 | -1075 | -1064 | -2048 | -2238 | -1916 | 497 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 477(V) | -823 | -660 | -2789 | -2196 | -638 | -2422 | -1317 | 1842 | -1836 | -191 | 1866 | -1913 | -2436 | -1596 | 1039 | -1512 | -768 | 2028 | -1296 | -949 | 498 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 478(V) | -1748 | -1297 | -4301 | -3885 | -1515 | -3999 | -3451 | 2579 | -3726 | 585 | -321 | -3638 | -3782 | -3470 | -3730 | -3273 | -1722 | 2581 | -2943 | -2589 | 499 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 479(D) | -1067 | -2475 | 2632 | 1644 | -2683 | -1544 | -584 | 1013 | -469 | -2422 | -1654 | -180 | -1882 | -209 | -1071 | -894 | -1059 | -1933 | -2725 | -1977 | 500 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -340 | -7108 | -2304 | -894 | -1115 | -701 | -1378 | * | * | | | | | | | | | | | | |
| 480(S) | 717 | -1527 | -107 | 1500 | -2213 | -1229 | -377 | -1911 | -112 | -1988 | -1149 | -164 | -1554 | 7 | -597 | 1919 | -503 | -1461 | -2242 | -1620 | 501 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -20 | -6788 | -7830 | -894 | -1115 | -421 | -1984 | * | * | | | | | | | | | | | | |
| 481(O) | -790 | -1076 | -1563 | -1026 | -923 | -2037 | -834 | -178 | -669 | -369 | 1897 | -1109 | -2120 | 2919 | -906 | -1087 | -746 | 1186 | -1510 | -1104 | 502 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 482(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 503 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 483(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 504 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 484(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 505 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 485(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 506 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 486(O) | -1064 | -1426 | -1517 | -1022 | -242 | -2170 | -535 | -884 | -583 | 715 | -396 | -1085 | -2235 | 3051 | -804 | -1225 | -994 | -864 | -835 | 1693 | 507 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 487(C) | 1096 | 3020 | 1354 | -606 | -1109 | -1571 | -566 | -613 | -497 | -939 | 1724 | -707 | -1762 | -380 | -838 | -622 | -428 | -433 | -1460 | -1015 | 508 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 488(E) | -1401 | -2897 | 169 | 3007 | -3185 | -1677 | -753 | -3009 | -498 | -2916 | -2170 | -319 | -2069 | 1880 | -966 | -1173 | -1402 | -2580 | -3040 | -2307 | 509 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 489(H) | -30 | 439 | 11 | 363 | -394 | -739 | 699 | -414 | 463 | -757 | 501 | 286 | -577 | 639 | 165 | -23 | 111 | -312 | 697 | -25 | 510 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 490(G) | -2594 | -2690 | -3304 | -3623 | -4328 | 3747 | -3462 | -4671 | -3953 | -4671 | -4212 | -3320 | -3352 | -3748 | -3779 | -2839 | -2981 | -4004 | -3668 | -4222 | 511 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 491(W) | -2172 | -1773 | -3771 | -3493 | 3388 | -3396 | -717 | -939 | -3099 | -528 | 2179 | -2555 | -3307 | -2387 | -2796 | -2550 | -2089 | -1165 | 3733 | 1010 | 512 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 492(L) | -2620 | -2150 | -4778 | -4218 | -461 | -4493 | -3219 | 96 | -3870 | 2765 | 2758 | -4143 | -3872 | -3009 | -3534 | -3777 | -2498 | -607 | -2129 | -2177 | 513 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 493(E) | -1401 | -2897 | 169 | 3007 | -3185 | -1677 | -753 | -3009 | -498 | -2916 | -2170 | -319 | -2069 | 1880 | -966 | -1173 | -1402 | -2580 | -3040 | -2307 | 514 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 494(G) | 2172 | -1046 | -2384 | -2525 | -3259 | 2719 | -2377 | -2982 | -2644 | -3267 | -2417 | -1723 | -2035 | -2315 | -2652 | -666 | -864 | -2010 | -3440 | -3225 | 515 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 495(Y) | -3482 | -2868 | -3701 | -3919 | 238 | -3552 | -1112 | -3000 | -3638 | -2516 | -2526 | -3027 | -3772 | -3101 | -3341 | -3418 | -3527 | -3071 | -441 | 4711 | 516 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 496(T) | -971 | -915 | -2809 | -2296 | -857 | -2422 | -1626 | 433 | -1998 | 1151 | 92 | -2043 | -2569 | -1769 | -2033 | -1592 | 2524 | 1200 | -1666 | -1332 | 517 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 497(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 518 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 498(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 519 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 499(G) | -2594 | -2690 | -3304 | -3623 | -4328 | 3747 | -3462 | -4761 | -3953 | -4671 | -4212 | -3320 | -3352 | -3748 | -3779 | -2839 | -2981 | 4004 | -3668 | -4222 | 520 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 500(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 521 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 501(H) | -999 | -1647 | -1206 | -1105 | -1780 | -1755 | 4476 | -2154 | -805 | -2276 | -1630 | -1129 | -2202 | -979 | -999 | -1106 | 1428 | -1786 | -2106 | -1395 | 522 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 502(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 523 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 503(I) | -1567 | -1223 | 3950 | -3399 | 2055 | -3419 | -2370 | 2527 | -3104 | 944 | 309 | -3048 | -3245 | -2620 | -2927 | -2582 | -1507 | 1309 | -1899 | -1632 | 524 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 504(W) | -3425 | -2618 | -4155 | -4330 | 3859 | -3949 | -484 | -2303 | -3894 | -1728 | -1759 | -2779 | -3865 | -2847 | -3389 | -3247 | -3323 | -2490 | 3919 | 1426 | 525 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 505(A) | 2014 | -983 | -1788 | -1434 | -2527 | -1231 | -1430 | -2209 | -1330 | -2413 | -1572 | -1164 | 1491 | -1179 | -1621 | 1494 | 990 | -1548 | -2719 | -2324 | 526 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 506(S) | -352 | -985 | -2207 | -2221 | -3013 | -1228 | -2099 | -2715 | -2192 | -3001 | -2167 | -1553 | -1952 | -1978 | -2279 | 3131 | 1106 | -1840 | -3241 | -2944 | 527 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 507(Y) | -3482 | -2868 | -3701 | -3919 | 238 | -3552 | -1112 | -3000 | -3638 | -2516 | -2526 | -3027 | -3772 | -3101 | -3341 | -3418 | -3527 | -3071 | -441 | 4711 | 528 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 508(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 529 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 509(S) | 1981 | -864 | -2260 | -1969 | -2205 | -1291 | -1697 | -1605 | -1808 | -2070 | -1333 | -1448 | -1910 | -1601 | -1958 | 2200 | -636 | 877 | -2550 | -2211 | 530 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 510(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 531 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 511(V) | -929 | -722 | -3094 | -2519 | -671 | 72 | -1536 | 1450 | -2197 | 1669 | 235 | -2159 | -2584 | -1873 | -2107 | -1688 | -882 | 1742 | -1406 | -1072 | 532 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 512(R) | -1152 | -2148 | -1103 | -556 | -2568 | 841 | 2681 | -2297 | 448 | -2220 | -1446 | -714 | -2063 | -63 | 2686 | -1086 | -1067 | -1962 | -2250 | -1802 | 533 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 513(V) | -1261 | -1032 | -2990 | 401 | -1324 | -3032 | -2128 | 1904 | -2354 | -591 | -293 | -2430 | -3023 | -2199 | -2472 | -2185 | -1232 | 2780 | -2221 | -1813 | 534 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 514(V) | -1755 | -1298 | -4332 | -3970 | -1769 | -4057 | -3755 | 2730 | -3843 | -618 | -544 | -3732 | -3880 | -3701 | -3920 | -3374 | -1748 | 2759 | -3277 | -2831 | 535 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 515(D) | -1718 | -3250 | 3403 | -27 | -3066 | -1736 | 2667 | -3486 | -1211 | -3381 | -2732 | -400 | -2240 | -752 | -1917 | -1439 | -1784 | -3023 | -3204 | -2299 | 536 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 516(S) | -635 | -1657 | 1163 | -252 | -2614 | -1382 | -780 | -2338 | -601 | -2421 | -1582 | -466 | -1801 | -415 | -1101 | 2397 | 1307 | -1804 | -2665 | -2044 | 537 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 517(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 538 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 518(M) | -2437 | -1975 | -4738 | -4148 | -487 | -4369 | -3139 | 1386 | -3872 | 2524 | 2731 | -4019 | -3789 | -2984 | -3525 | -3603 | -2318 | -374 | -2113 | -2174 | 539 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 519(T) | -504 | -959 | -1413 | -1049 | -1473 | -1580 | -994 | -629 | -943 | -1256 | -601 | 1702 | -1931 | -837 | -1224 | -750 | 1993 | 1780 | -1865 | -1432 | 540 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 520(O) | -2562 | -2904 | -1886 | -1971 | -3251 | -2661 | -2079 | -3690 | -1565 | -3469 | -3081 | -2107 | -3091 | 4371 | -1665 | -2585 | -2674 | -3411 | -3077 | -2821 | 541 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 521(H) | -2992 | -2589 | -3064 | -3043 | 863 | -3512 | 4371 | -2521 | -2584 | -2051 | -1961 | -2327 | -3545 | -2255 | -2492 | -2815 | -2919 | -2563 | 158 | 3265 | 542 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 522(E) | 1777 | -758 | -2605 | -2069 | 2426 | -2201 | -1138 | 17 | -1776 | -51 | 1943 | -1762 | -2314 | -1474 | -1762 | -1320 | -786 | -23 | -1063 | -575 | 543 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 523(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 544 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 524(W) | -3358 | -2599 | -4116 | -4259 | 2422 | -3892 | -536 | -2247 | -3821 | -1683 | -1712 | -2792 | -3835 | -2843 | -3352 | -3227 | -3271 | -2441 | 5485 | 1363 | 545 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 525(L) | 841 | -1175 | -3469 | -2926 | -668 | -3037 | -2058 | 1328 | -2615 | 2287 | 379 | -2642 | -2978 | -2226 | -2526 | -2188 | -1355 | 301 | -1760 | -1526 | 546 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 526(R) | -837 | -2176 | -602 | 1392 | -2587 | -1688 | -216 | -2257 | 1534 | -2141 | -1281 | 1107 | -1779 | 227 | 2019 | -709 | -741 | -1854 | -2229 | -1683 | 547 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 527(M) | 888 | -1677 | -357 | 850 | -1922 | -1428 | 1639 | -1611 | 1435 | -1654 | 1807 | -103 | -1521 | 338 | -129 | -358 | -369 | -1259 | -1902 | -1285 | 548 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 528(A) | 2576 | -902 | -2349 | -2158 | -2756 | -1202 | -1937 | -2410 | -2031 | -2688 | -1852 | -1502 | -1892 | -1801 | -2162 | 1022 | 1811 | -1644 | -3004 | -2709 | 549 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 529(K) | -583 | -1746 | -490 | 34 | -1989 | -1543 | 1732 | -1666 | 1763 | -1714 | -880 | 1553 | -1641 | 238 | -31 | -516 | -513 | 875 | -1945 | -1367 | 550 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1300 | -7108 | -769 | -894 | -1115 | -701 | -1378 | * | * | | | | | | | | | | | | |
| 530(R) | -915 | -1387 | -1141 | -641 | -1786 | -1421 | -246 | -1638 | 712 | -1598 | -1052 | -657 | -1663 | 43 | 3215 | -962 | -890 | -1418 | -1542 | -1280 | 551 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -238 | -2716 | * | * | | | | | | | | | | | | |
| 531(E) | -1710 | -3547 | 2209 | 3007 | -3749 | -1634 | -990 | -3679 | -1227 | -3559 | -2898 | -238 | -2166 | -662 | -2065 | -1376 | -1779 | -3163 | -3720 | -2744 | 552 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 532(I) | -599 | -507 | -2385 | -1791 | -457 | -2112 | -696 | 1604 | -1499 | 1009 | 366 | -1553 | -2152 | 762 | -1506 | -1178 | 1103 | 1145 | -1019 | -677 | 553 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 533(P) | 787 | -1572 | 724 | 108 | -1851 | -1418 | -201 | -1534 | 126 | -1626 | -789 | -169 | 1640 | 198 | -358 | 575 | -413 | -1199 | -1916 | 922 | 554 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 534(W) | -4114 | -3274 | -4214 | -4453 | -1722 | -3496 | -2681 | -4109 | -4149 | -3619 | -3615 | -4044 | -3885 | -4032 | -3816 | -4355 | -4248 | -4133 | 6191 | -1329 | 555 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 535(R) | -1940 | -2623 | -2163 | -1317 | -2718 | -2498 | 2633 | -2821 | 557 | -2576 | -1920 | -1294 | -2549 | -305 | 3406 | -1859 | -1734 | -2575 | -2279 | -1885 | 556 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 536(H) | -1345 | -2440 | -1207 | -576 | -2915 | -2072 | 3063 | -2527 | 2588 | -2343 | -1569 | -727 | -2129 | 1381 | 532 | -1222 | -1187 | -2200 | -2324 | -1939 | 557 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 537(D) | -695 | -2182 | 1890 | 241 | -2491 | -1456 | -249 | -2246 | 1496 | -2187 | -1300 | -85 | 1264 | 1306 | -385 | -545 | -648 | -1804 | -2357 | -1656 | 558 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 538(Y) | -1138 | -876 | -3345 | -2810 | -645 | -2852 | -1674 | 1928 | -2488 | -317 | 10 | -2411 | -2835 | -2166 | -1293 | -1984 | -1094 | 2117 | -1423 | 2681 | 559 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 539(P) | 1031 | -974 | -2031 | -1918 | -2925 | -1207 | -1878 | -2641 | -1913 | -2865 | -2004 | -1407 | 2879 | -1695 | -2096 | 1838 | -694 | -1790 | -3123 | -2802 | 560 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 540(H) | -30 | 439 | 11 | 363 | -394 | -739 | 699 | -414 | 463 | -757 | 501 | 286 | -577 | 639 | 165 | -23 | 111 | -312 | 697 | -25 | 561 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 541(S) | 1737 | -944 | -2392 | -2415 | -3092 | -1199 | -2214 | -2801 | -2395 | -3086 | -2226 | -1614 | -1940 | -2116 | -2445 | 2898 | -735 | -1863 | -3322 | -3065 | 562 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 542(M) | -1968 | -1576 | -4331 | -3761 | -611 | -3859 | -2765 | 1741 | -3480 | 2227 | 2250 | -3502 | -3515 | -2812 | -3229 | -3049 | -1885 | 1013 | -2038 | -1963 | 563 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 543(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 564 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 544(I) | -1257 | -1007 | -3424 | -2868 | 1397 | -2811 | -1254 | 2188 | -2500 | 1333 | 382 | -2341 | -2749 | -1996 | -2283 | -1922 | -1186 | -115 | -815 | 2061 | 565 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 545(I) | -1831 | -1391 | -4327 | -3871 | -1200 | -3991 | -3265 | 2941 | -3675 | 1302 | -22 | -3631 | -3727 | -3275 | -3598 | -3245 | -1791 | 1578 | -2650 | -2410 | 566 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 546(E) | 999 | -1712 | 787 | 1203 | -1974 | -1412 | -152 | -1661 | 194 | -1721 | -863 | -101 | -1546 | 266 | -305 | 466 | -419 | 822 | -1983 | -1349 | 567 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 547(T) | 590 | -1479 | 974 | -206 | -2293 | -1346 | -555 | -1995 | -272 | -2077 | -1218 | -407 | -1671 | -167 | -745 | 1655 | 1771 | -1514 | -2333 | -1741 | 568 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 548(S) | -897 | -1462 | -233 | -2543 | -3185 | -1640 | -2474 | -3294 | -2686 | -3497 | -2780 | -1973 | -2360 | -2483 | -2703 | 3465 | -1316 | -2413 | -3310 | -3025 | 569 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 549(T) | -866 | -1511 | -1211 | -1054 | -1813 | -1680 | 2857 | -1969 | -793 | -2130 | -1455 | -1074 | -2117 | -914 | -1013 | -989 | 3041 | -1609 | -2119 | -1469 | 570 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 550(W) | -587 | -608 | -2405 | -1898 | -479 | -1928 | -933 | -42 | -1552 | -528 | 62 | -1554 | -2129 | -1332 | -1550 | 365 | -609 | 2511 | 3028 | -502 | 571 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 551(W) | 947 | -1346 | -3135 | -2759 | 3172 | -2759 | -620 | -882 | -2412 | -912 | -526 | -2088 | -2831 | -1938 | -2273 | -1901 | -1498 | -870 | 3648 | 929 | 572 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 552(O) | -1772 | -2604 | -1870 | -1079 | -3217 | -2374 | -569 | -2777 | 660 | -2529 | -1835 | -1110 | -2420 | 3075 | 2723 | -1671 | -1571 | -2504 | -2437 | -2192 | 573 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 553(O) | -2562 | -2904 | -1886 | -1971 | -3251 | -2661 | -2079 | -3690 | -1565 | -3469 | -3081 | -2107 | -3091 | 4371 | -1665 | -2585 | -2674 | -3411 | -3077 | -2821 | 574 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 554(D) | -1791 | -3663 | 3414 | 1659 | -3853 | -1647 | -1043 | -3807 | -1343 | -3679 | -3054 | -251 | -2201 | -725 | -2227 | -1438 | -1872 | -3282 | -3836 | -2831 | 575 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 555(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 576 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 556(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 577 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 557(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 578 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 558(Y) | -3620 | -2706 | -4179 | -4428 | 3303 | -4051 | -393 | -2536 | -4005 | -1939 | -1984 | -2749 | -3933 | -2855 | -3452 | -3299 | -3498 | -2688 | 350 | 3843 | 579 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 559(S) | -344 | -978 | -2187 | -2155 | -2953 | -1227 | -2035 | -2643 | -2108 | -2926 | -2093 | -1523 | -1940 | -1902 | -2216 | 2907 | 1859 | -1800 | -3181 | -2875 | 580 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 560(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 581 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 561(O) | -2562 | -2904 | -1886 | -1971 | -3251 | -2661 | -2079 | -3690 | -1565 | -3469 | -3081 | -2107 | -3091 | 4371 | -1665 | -2585 | -2674 | -3411 | -3077 | -2821 | 582 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 562(D) | -1724 | -3448 | 3411 | 103 | -3726 | -1642 | -1058 | -3734 | -1342 | -3628 | -2991 | 1884 | -2196 | -745 | -2191 | -1408 | -1822 | -3197 | -3743 | -2768 | 583 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 563(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 584 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 564(G) | -468 | -1108 | -1987 | -2183 | -3307 | 3093 | -2261 | -3159 | -2489 | -3374 | -2507 | -1593 | -2035 | -2163 | -2570 | 1410 | -895 | -2119 | -3471 | -3217 | 585 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 565(V) | 371 | -671 | -3209 | -2618 | 1562 | -2580 | -1515 | 1368 | -2275 | 648 | 269 | -2195 | -2574 | -1917 | -2132 | -1689 | -852 | 2127 | -1337 | -1001 | 586 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 566(T) | -1238 | -1032 | -3270 | -2717 | -705 | -2883 | -1871 | 1700 | -2401 | 1666 | 301 | -2442 | -2848 | -2072 | -2345 | -2015 | 1957 | 452 | -1675 | -1395 | 587 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 567(T) | -307 | -965 | -2051 | -1918 | -2899 | 1272 | -1866 | -2617 | -1903 | -2838 | -1975 | -1405 | -1889 | -1683 | -2089 | 1577 | 2739 | -1773 | -3100 | -2780 | 588 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 568(H) | 837 | -578 | -1703 | -1139 | -579 | -1822 | 2864 | -45 | -902 | -418 | 1836 | -1086 | -1915 | -740 | -1071 | -867 | -423 | 1342 | -1041 | -648 | 589 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 569(L) | -2092 | -1719 | -4323 | -3846 | -712 | -3925 | -2989 | 451 | -3531 | 2641 | 428 | -3624 | -3640 | -2952 | -3339 | -3191 | -2044 | 1542 | -2221 | -2096 | 590 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 570(L) | 1056 | -648 | -2733 | -2160 | 1291 | -2277 | -874 | 5 | -1827 | 1649 | 341 | -1760 | -2303 | -1464 | -1729 | -1359 | -733 | 2 | -647 | 1605 | 591 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 571(E) | -994 | -2497 | 67 | 2352 | -2818 | -1564 | -437 | -2572 | 1391 | -2487 | -1645 | 1818 | -1831 | -24 | -503 | -812 | -956 | -2133 | -2633 | -1933 | 592 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 572(K) | -1592 | -2196 | -1883 | -1179 | -2203 | -2360 | -733 | -1718 | 3129 | 666 | -1212 | -1218 | -2435 | -383 | 258 | -1621 | -1460 | -1669 | -2199 | -1837 | 593 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -971 | -7108 | -1051 | -894 | -1115 | -701 | -1378 | * | * | | | | | | | | | | | | |
| 573(C) | -39 | 2488 | -473 | 1144 | -1043 | -1085 | -142 | -526 | 67 | -851 | -125 | -185 | -1325 | 126 | -296 | -170 | 1058 | -295 | -1316 | -837 | 594 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -360 | -6167 | -2274 | -894 | -1115 | -1874 | -459 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 574(F) | -1315 | -1110 | -2334 | -2129 | 3522 | -2099 | -247 | -203 | -1900 | 58 | 60 | -1632 | -2283 | -1510 | -1804 | -1624 | -1357 | -396 | 303 | 1334 | 595 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 575(H) | -354 | -1360 | 326 | 436 | -1031 | -1026 | 2689 | -1410 | 436 | -1450 | -724 | 1667 | -1303 | 383 | 89 | -286 | -351 | -1096 | -1280 | -501 | 596 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -238 | -2716 | * | * | | | | | | | | | | | | |
| 576(K) | -1086 | -2304 | -1032 | -362 | -2797 | -1910 | -283 | -2399 | 2361 | -2235 | -1413 | 1695 | -1959 | 1479 | 1362 | -963 | -952 | -2031 | -2264 | -1826 | 597 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 577(P) | -1766 | -2832 | 2091 | -503 | -3634 | -1897 | -1480 | -3629 | -1677 | -3608 | -2962 | -830 | 3445 | -1206 | -2322 | -1624 | -1926 | -3087 | -3516 | -2951 | 598 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 578(H) | -480 | -1902 | 1434 | 926 | -2176 | -1399 | 2271 | -1932 | 300 | -1903 | -1004 | -39 | -1521 | 347 | 782 | -362 | -423 | -1511 | -2083 | 1389 | 599 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 579(Y) | 839 | -383 | -2642 | -2032 | 1206 | -2056 | -863 | 223 | -1678 | 569 | 461 | -1617 | -2100 | -1333 | -1555 | -1135 | -472 | 1465 | -747 | 1987 | 600 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 580(I) | 865 | -836 | -3163 | -2646 | -1108 | -2692 | -1893 | 2677 | -2382 | -556 | -157 | -2324 | -2771 | -2135 | -2380 | -1845 | 504 | 1519 | -1868 | -1491 | 601 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 581(R) | -1066 | -2251 | -943 | -347 | -2740 | 308 | -313 | -2349 | 1342 | -2216 | -1401 | 854 | -1954 | 119 | 2761 | -953 | -949 | -1986 | -2272 | -1823 | 602 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 582(E) | -370 | -640 | -961 | 1875 | -770 | -1558 | -279 | 900 | -284 | -670 | 84 | -547 | -1598 | -160 | -606 | -577 | -301 | 965 | -907 | -668 | 603 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 583(Y) | -3618 | -2707 | -4172 | -4418 | 2748 | -4047 | -395 | -2537 | -3997 | -1940 | -1986 | -2748 | -3932 | -2853 | -3448 | -3297 | -3496 | -2688 | 348 | 4199 | 604 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 584(F) | -2597 | -2122 | -4519 | -4416 | 2769 | -4202 | -2114 | -140 | -3797 | 2428 | 469 | -3639 | -3772 | -2912 | -3436 | -3471 | -2488 | -783 | -1265 | -532 | 605 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 585(P) | 1615 | -1136 | -2222 | -2310 | -3082 | -1373 | -2227 | -2731 | -2358 | -3036 | -2272 | -1689 | 3445 | -2139 | -2424 | -761 | -938 | -1937 | -3279 | -3042 | 606 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 586(A) | 2397 | -935 | -2082 | -1846 | -2575 | -1236 | -1722 | -2190 | -1737 | -2475 | -1666 | -1377 | 1554 | -1552 | -1929 | -527 | 1772 | -1532 | -2826 | -2490 | 607 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 587(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 608 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 588(A) | 3098 | -930 | -2580 | -2583 | -2894 | -1243 | -2249 | -2309 | -2448 | -2781 | -2022 | -1697 | -1976 | -2194 | -2449 | -591 | 1113 | -1602 | -3196 | -2952 | 609 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 589(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 610 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 590(M) | -387 | -854 | -1643 | -1199 | -1437 | -1461 | -1020 | -962 | -1012 | -1269 | 2610 | -1075 | -1857 | -895 | -1259 | 1806 | 1865 | -709 | -1810 | -1406 | 611 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 591(H) | -30 | 439 | 11 | 363 | -394 | -739 | 699 | -414 | 463 | -757 | 501 | 286 | -577 | 639 | 165 | -23 | 111 | -312 | 697 | -25 | 612 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 592(L) | -2625 | -2145 | -4613 | -4174 | 1968 | -4304 | -2386 | -72 | -3866 | 2741 | 551 | -3801 | -3814 | -2959 | -3500 | -3585 | -2511 | -745 | -1483 | -874 | 613 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 593(L) | -2193 | -1789 | -4457 | -3877 | -523 | -4057 | -2894 | 279 | -3584 | 2588 | 2231 | -3689 | -3624 | -2841 | -3310 | -3261 | -2096 | 1093 | -2048 | -2035 | 614 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 594(A) | 2970 | -925 | -2555 | -2528 | -2849 | -1243 | -2202 | -2276 | -2388 | -2737 | -1975 | -1675 | -1968 | -2140 | -2406 | -585 | 1607 | -1581 | -3151 | -2898 | 615 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 595(V) | -1334 | -1034 | -3629 | -3155 | -1390 | -3214 | -2516 | 2107 | -2918 | -591 | -331 | -2852 | -3211 | -2701 | -2928 | -2407 | 1824 | 2364 | -2380 | -1985 | 616 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 596(M) | 998 | -406 | -1988 | -1399 | 1077 | -46 | -692 | 73 | -1142 | 733 | 1731 | -1227 | -1918 | -903 | -1209 | 286 | -359 | 167 | -855 | -487 | 617 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 597(H) | -1095 | -2732 | 1291 | 2125 | -2985 | -1512 | 3032 | -2799 | -427 | -2721 | -1890 | 1256 | -1861 | -159 | -1055 | -875 | -1088 | -2329 | -2902 | -2089 | 618 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 598(H) | -971 | -1917 | -1026 | -424 | -2119 | -1866 | 2995 | -1811 | 2402 | -1852 | -1093 | -602 | -1947 | 34 | 266 | -932 | -871 | 294 | -1999 | -1507 | 619 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 599(C) | 1836 | 3931 | -2905 | -2499 | -1252 | -1823 | -1705 | 1152 | -2189 | -888 | -389 | -1893 | -2246 | -1917 | -2150 | -1063 | -756 | 157 | -1855 | -1509 | 620 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 600(F) | 528 | -777 | -2899 | -2354 | 2441 | -2415 | -823 | -127 | -2008 | 1363 | 215 | -1876 | -2433 | -1604 | -1876 | -1506 | -889 | -142 | -490 | 1736 | 621 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 601(K) | -1239 | -2390 | -1266 | -522 | -2934 | -2031 | -324 | -2495 | 2422 | -2300 | -1501 | 979 | -2062 | 1504 | 1964 | -1116 | -1081 | -2146 | -2296 | -1915 | 622 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 602(S) | 699 | -1151 | -903 | -440 | -1699 | -1408 | -579 | -1323 | -350 | -1526 | 1574 | 974 | -1694 | -269 | -750 | 2107 | -464 | -1002 | -1909 | -1408 | 623 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 603(Q) | -873 | -2060 | -736 | -198 | -2478 | -1732 | -282 | -2118 | 1944 | -2060 | -1235 | -426 | -1836 | 1968 | 230 | -780 | 1853 | -1758 | -2189 | -1681 | 624 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 604(N) | -1080 | -2639 | 214 | 1688 | -2924 | -1545 | -527 | -2711 | -282 | -2635 | -1807 | 2572 | -1867 | 2104 | -814 | -876 | -1062 | -2261 | -2801 | -2043 | 625 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 605(K) | -457 | 1622 | -593 | -29 | -1532 | -1520 | -184 | -1170 | 1745 | -1320 | -528 | -275 | -1605 | 1259 | -206 | -467 | 609 | -916 | -1655 | 1434 | 626 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 606(I) | -1995 | -1561 | -4353 | -3926 | -1045 | -4065 | -3261 | 3346 | -3652 | 924 | 94 | -3716 | -3783 | -3240 | -3554 | -3362 | -1957 | 705 | -2551 | -2295 | 627 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 607(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -35253 | -2909 | 628 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 608(Y) | 1025 | -487 | -2483 | -1892 | -336 | -2087 | -935 | 224 | -1576 | 1270 | 403 | -1587 | -2140 | -1281 | -1535 | -1165 | -537 | 999 | -908 | 2074 | 629 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 609(M) | -797 | -587 | -3073 | -2468 | 1091 | -2423 | -1329 | 2169 | -2112 | -34 | 2364 | -2036 | -2429 | -1745 | -1959 | -1522 | 645 | 1209 | -1165 | -836 | 630 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 610(V) | -1573 | -1179 | -4043 | -3576 | 867 | -3627 | -2822 | 2175 | -3353 | -312 | -198 | -3256 | -3486 | -3047 | -3296 | -2841 | -1540 | 2804 | -2430 | -2026 | 631 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 611(A) | 2440 | -912 | -2339 | -2201 | -2840 | 1287 | -1997 | -2505 | -2116 | -2780 | -1935 | -1522 | -1901 | -1868 | -2234 | -517 | 1851 | -1699 | -3081 | -2199 | 632 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 612(S) | -437 | -1083 | -2006 | -2144 | -3262 | 1583 | -2197 | -3097 | -2380 | -3307 | -2434 | -1562 | -2008 | -2077 | -2485 | 2965 | -857 | -2074 | -3426 | -3160 | 633 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 613(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 634 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 614(H) | -1501 | -2478 | -747 | -589 | -1969 | -2033 | 3845 | -2617 | -5 | -2483 | -1816 | -796 | -2272 | 2881 | -187 | -1387 | -1442 | -2314 | -2008 | -1345 | 635 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 615(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 636 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 616(R) | 1242 | -1347 | -1254 | -731 | -2201 | -1510 | -719 | -1792 | -153 | -1944 | -1159 | -782 | -1844 | -375 | 2580 | -656 | 1294 | -1393 | -2232 | -1788 | 637 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 617(P) | 1448 | -1164 | -798 | -305 | -1387 | -1533 | -406 | -980 | -151 | 81 | -453 | -488 | 1572 | 1113 | -529 | -556 | -448 | -759 | -1638 | -1144 | 638 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 618(Q | -557 | -1175 | -1028 | -563 | -1488 | -1618 | -611 | -820 | -317 | -1222 | -557 | -696 | -1835 | 2724 | -638 | -698 | -1378 | 1031 | -1782 | -1308 | 639 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 619(W) | -3603 | -2685 | -4198 | -4439 | 2092 | -4053 | -373 | -2561 | -4004 | -1981 | -2004 | -2736 | -3927 | -2842 | -3443 | -3284 | -3472 | -2688 | 5224 | 2884 | 640 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 620(F) | -1507 | -1226 | -2587 | -3073 | 2681 | -3022 | -1217 | 950 | -2707 | 1659 | 313 | -2490 | -2927 | -2137 | -2464 | -2143 | -1430 | -380 | -687 | 1671 | 641 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 621(S) | -344 | -978 | -2188 | -2158 | -3955 | -1227 | -2038 | -2646 | -2111 | -2929 | -2096 | -1524 | -1940 | -1904 | -2218 | 2919 | 1829 | -1801 | -3183 | -2878 | 642 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 622(I) | -1092 | -874 | -3179 | -2611 | -721 | -2765 | -1721 | 1891 | -2310 | 1192 | 241 | -2311 | 1836 | -1986 | -2249 | -1880 | -1042 | 1298 | -1570 | -1257 | 643 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 623(D) | -891 | -2456 | 2161 | 1856 | -2735 | -1474 | -410 | -2519 | -186 | -2456 | -1593 | -91 | -1753 | 1291 | -767 | -707 | 782 | -2062 | -2639 | -1876 | 644 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 624(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 645 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 625(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 646 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 626(K) | -719 | -2060 | -577 | 1623 | -2444 | -1622 | -164 | -2125 | 1699 | -2035 | -1164 | -266 | -1703 | 282 | 1624 | -601 | 634 | -1722 | -2150 | -1583 | 647 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 627(O) | 1243 | -1432 | -728 | -405 | -2358 | -1377 | -690 | -2055 | -351 | -2150 | -1310 | -555 | -1744 | 2880 | -751 | 1081 | -618 | -1561 | -2401 | -1849 | 648 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 628(H) | -780 | -1536 | -555 | 1361 | -1393 | -1709 | 2249 | -1189 | -144 | 1529 | -640 | -494 | -1865 | -169 | -489 | -816 | -724 | -1022 | -1690 | -1099 | 649 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 629(C) | 456 | 2634 | -3043 | -2479 | -719 | -2386 | -1463 | 624 | -2148 | 1022 | 146 | -2055 | -2467 | -1831 | -2047 | -1515 | -777 | 2135 | -1370 | -1020 | 650 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 630(D) | 59 | -1947 | 1795 | 1154 | -2254 | -1392 | -111 | -1999 | 273 | -1959 | -1053 | -30 | -1526 | 335 | 1177 | -370 | 709 | -1564 | -2142 | -1456 | 651 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 631(Q) | 1161 | -1938 | -287 | 164 | -2274 | -1471 | -154 | -1990 | 1104 | -1956 | -1072 | 1604 | -1598 | 1906 | -101 | -461 | -513 | -1579 | -2132 | -1496 | 652 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 632(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 653 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 633(L) | 2002 | -1175 | -2785 | -2475 | -1055 | -2185 | -1898 | -221 | -2172 | 2054 | -104 | -2097 | -2542 | -1964 | -2186 | -1458 | -1162 | -325 | -1982 | -1669 | 654 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 634(K) | 943 | -1709 | -403 | 133 | -2096 | 781 | -142 | -1801 | 944 | -1811 | -930 | -144 | -1543 | 292 | 938 | 844 | -405 | -1399 | -2023 | -1402 | 655 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 635(I) | 525 | -452 | -2111 | 23 | -445 | -1963 | -805 | 1776 | -1266 | -283 | 345 | -1346 | -2019 | -1026 | -1323 | -1017 | -436 | 1518 | -942 | 1179 | 656 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 636(W) | -1626 | -1321 | -3570 | -3141 | 2053 | -3057 | -937 | 2580 | -2760 | -226 | -54 | -2426 | -2999 | -2185 | -2514 | -2189 | -1555 | -448 | 3586 | 581 | 657 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 637(D) | -1498 | -3029 | 3115 | 17 | -3354 | -1691 | -852 | -3199 | 1912 | -3109 | -2371 | -341 | -2120 | -495 | -1230 | -1252 | -1519 | -2742 | -3208 | -2450 | 658 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 638(W) | -3358 | -2599 | -4116 | -4259 | 2442 | -3892 | -536 | -2247 | -3821 | -1683 | -1712 | -2792 | -3835 | -3843 | -3352 | -3227 | -3271 | -2441 | 5485 | 1363 | 659 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 639(C) | 3004 | 3179 | -3175 | -3184 | -2750 | -1300 | -2459 | -2082 | -2872 | -2641 | -1933 | -1922 | -2041 | -2538 | -2722 | -657 | -796 | -1473 | -3106 | -2895 | 660 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 640(S) | -897 | -1462 | -2333 | -2543 | -3185 | -1640 | -2474 | -3294 | -2676 | -3497 | -2780 | -1973 | -2360 | -2483 | -2703 | 3465 | -1316 | -2413 | -3310 | -3025 | 661 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 641(T) | -638 | -1323 | -1200 | -1263 | -2717 | -1420 | -1550 | -2421 | -1436 | -2697 | -1948 | 1009 | -2035 | -1340 | -1682 | -796 | 3384 | -1817 | -2917 | -2452 | 662 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 642(H) | -30 | 439 | 11 | 363 | -394 | -739 | 699 | -414 | 463 | -757 | 501 | 286 | -577 | 639 | 165 | -23 | 111 | -312 | 697 | -25 | 663 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 643(D) | 1256 | -1810 | 2828 | -193 | -2711 | -1421 | -825 | -2377 | -710 | -2507 | -1697 | -438 | -1858 | -471 | -1243 | -735 | 787 | -1875 | -2779 | -2131 | 664 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 644(K) | -1038 | -2259 | -689 | -253 | -2738 | 777 | -360 | -2382 | 2468 | -2269 | -1451 | -481 | -1931 | 2027 | 226 | -921 | -949 | -2002 | -2343 | -1850 | 665 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -535 | -1708 | -8150 | -140 | -3430 | -701 | -1378 | * | * | | | | | | | | | | | | |
| 645(G) | -1044 | -1813 | -773 | -1023 | -3345 | 2987 | -1699 | -3331 | -1775 | -3418 | -2659 | 2131 | -2239 | -1475 | -2156 | -1127 | -1361 | -2539 | -3373 | -2907 | 667 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 646(E) | -488 | -1836 | 1360 | 1439 | -2104 | -1403 | -131 | -1820 | 229 | 87 | -955 | -60 | -1537 | 301 | -280 | 469 | 631 | -1431 | -2061 | -1399 | 668 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 647(E) | -1127 | -2366 | -800 | 2480 | -2838 | -1878 | -336 | -2455 | 1396 | -2301 | -1488 | -522 | -1975 | 95 | 1670 | -993 | -1007 | -2085 | -2343 | -1881 | 669 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 647(E) | -1127 | -2366 | -800 | 2480 | -2838 | -1878 | -336 | -2455 | 1396 | -2301 | -1488 | -522 | -1975 | 95 | 1670 | -993 | -1007 | -2085 | -2343 | -1881 | 669 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 648(P) | 955 | -915 | -2251 | -2048 | -2204 | -1361 | -1790 | -1375 | -1894 | -1974 | -1329 | -1523 | 3265 | -1711 | -2016 | 660 | -714 | 631 | -2606 | -2267 | 670 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 649(D) | -1535 | -3339 | 3248 | 856 | -3535 | -1586 | -853 | -3417 | -967 | -3307 | -2587 | -180 | -2074 | 1731 | -1720 | -1229 | -1578 | -2919 | -3496 | -2555 | 671 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 650(V) | -1754 | -1297 | -4329 | -3968 | -1770 | -4053 | -3752 | 2602 | -3840 | -621 | -545 | -3728 | -3878 | -3699 | -3917 | -3370 | -1746 | 2861 | -3276 | -2829 | 672 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 651(V) | -1736 | -1298 | -4275 | -3915 | -1773 | -3969 | -3654 | 1867 | -3766 | -598 | -525 | -3663 | -3828 | -3619 | -3833 | -3283 | -1733 | 3222 | -3208 | -2763 | 673 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 652(M) | -2158 | -1763 | -4466 | -3857 | 2098 | -3961 | -2711 | 1339 | -3551 | 2194 | 2215 | -3609 | -3535 | -2747 | -3220 | -3143 | -2048 | -438 | -1879 | -1836 | 674 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 653(A) | 2500 | -821 | -2504 | -2171 | -1756 | -1515 | -1719 | -589 | -1953 | -1465 | -872 | -1633 | -2062 | -1734 | -2039 | -780 | 1073 | 1394 | -2251 | -1909 | 675 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 654(A) | 2412 | -931 | -2308 | -2228 | -3059 | 1309 | -2079 | -2797 | -2207 | -3025 | -2139 | -1529 | -1901 | -1934 | -2326 | 1722 | -691 | -1849 | -3263 | -2994 | 676 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 655(A) | 2464 | -791 | -2155 | -1787 | -1514 | -1500 | -1408 | 1386 | -1595 | -1309 | -672 | -1424 | -1982 | -1405 | -1732 | 688 | -324 | -473 | -1963 | -1596 | 677 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 656(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 678 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 657(T) | -457 | -1344 | 1397 | -166 | -1749 | -1438 | -424 | -1324 | -173 | -1546 | -757 | -384 | -1663 | -77 | -623 | 628 | 1799 | 847 | -1920 | -1372 | 679 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 658(E) | -1108 | -1855 | -497 | 2835 | -2161 | -1834 | -982 | -964 | -783 | -1744 | -1237 | -739 | -2163 | -677 | -1197 | -1164 | -1148 | 1427 | -2502 | -1927 | 680 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 659(P) | -853 | -1252 | -2460 | -2393 | -2139 | -1784 | -2109 | -974 | -2210 | -1748 | -1364 | -1924 | 3453 | -2108 | -2271 | -1167 | -1152 | 1448 | -2678 | -2307 | 681 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 660(T) | -495 | -998 | -1197 | -789 | -1334 | -1567 | -751 | -851 | -618 | -1153 | 2261 | 892 | -1849 | -564 | -910 | -695 | 2581 | -648 | -1684 | -1235 | 682 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 661(O) | -425 | -1001 | -831 | 629 | 1174 | -1595 | -316 | 637 | -152 | 579 | -150 | -476 | -1677 | 1648 | -532 | -563 | 735 | -470 | -1354 | -875 | 683 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 662(E) | -2641 | -3308 | -896 | 3732 | -3966 | -2458 | -2043 | -4105 | -2128 | -4016 | -3555 | -1531 | -2959 | -1542 | -2560 | -2479 | -2750 | -3722 | -3563 | -3385 | 684 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 663(I) | 525 | -535 | -2111 | -1551 | -638 | -1888 | -920 | 1560 | -1309 | -455 | 170 | -1362 | -2031 | -1084 | -1399 | 1061 | 708 | 1332 | -1134 | -763 | 685 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 664(M) | -2362 | -1913 | -4673 | -4086 | -501 | -4285 | -3077 | 1692 | -3808 | 2336 | 2939 | -3933 | -3746 | -2955 | -3477 | -3510 | -2250 | -300 | -2098 | -2139 | 686 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 665(A) | 2734 | -1554 | -1235 | -966 | -2607 | -1620 | -1015 | -2163 | 1487 | -2343 | -1601 | -988 | -2045 | -691 | -583 | -903 | -969 | -1725 | -2578 | -2168 | 687 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 666(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 688 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 667(I) | 1114 | -756 | -2253 | -1864 | -1305 | -1646 | -1394 | 2517 | -1656 | -1054 | -461 | -1512 | -2066 | -1454 | -1761 | 1262 | -650 | -138 | -1806 | -1439 | 689 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 668(D) | 900 | -2457 | 2570 | 175 | -2815 | -1502 | -553 | -2590 | -386 | -2564 | -1737 | -168 | -1841 | 2095 | -969 | -821 | -1001 | -2141 | -2768 | -2010 | 690 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 669(I) | 292 | -707 | -2167 | -1590 | -719 | -2180 | -1027 | 2540 | 537 | -441 | 146 | -1486 | -2230 | -1118 | -1321 | -1247 | -668 | 405 | -1287 | -917 | 691 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 670(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 692 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 671(H) | -1177 | -2326 | -1134 | -457 | -2809 | -1977 | 3593 | -2401 | 1445 | -2244 | -1443 | 844 | -2024 | 111 | 1735 | -1061 | -1033 | -2058 | -2268 | -1857 | 693 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 672(E) | 15 | -2170 | 1563 | 1959 | -2472 | -1425 | -226 | -2237 | 855 | -2177 | -1280 | -49 | -1617 | 1268 | -431 | -502 | -609 | -1785 | -2349 | -1631 | 694 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 673(H) | -403 | -1628 | -358 | 195 | -1861 | -1414 | 1618 | -1548 | 320 | -279 | 1074 | 912 | -1503 | 1197 | 1139 | 446 | -340 | -1203 | -1863 | -1247 | 695 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 674(C) | -513 | 2550 | -2600 | -2019 | 2246 | 845 | -943 | 1137 | -1680 | -244 | 350 | -1605 | -2090 | -1357 | -1587 | -1083 | -488 | 249 | -881 | -474 | 696 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -340 | -7108 | -2304 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 675(P) | -2312 | -2374 | -2796 | -3036 | -3591 | -2432 | -2883 | -3881 | -3157 | -3835 | -3473 | -2848 | 4156 | -3101 | -3072 | -2546 | -2648 | -3391 | -3143 | -3459 | 697 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -20 | -6788 | -7830 | -894 | -1115 | -1306 | -747 | * | * | | | | | | | | | | | | |
| 676(E) | -985 | -2607 | 1546 | 2542 | -2883 | -1323 | -441 | -2699 | -378 | -2634 | -1828 | 58 | -1713 | -60 | -1032 | 869 | -997 | -2229 | -2828 | -1997 | 698 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -20 | -6788 | -7830 | -894 | -1115 | -421 | -1984 | * | * | | | | | | | | | | | | |
| 677(L) | -2103 | -1693 | -4449 | -3873 | -568 | -4003 | -2874 | 1606 | -3596 | 2406 | 2166 | -3648 | -3596 | -2862 | -3318 | -3203 | -2010 | 674 | -2059 | -2029 | 699 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 678(K) | -2059 | -2767 | -2575 | -1375 | -3583 | -2596 | -558 | -2947 | 3236 | -2620 | -1947 | -1295 | -2560 | -141 | 2026 | -1942 | -1766 | -2709 | -2469 | -2350 | 700 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 679(I) | -1544 | -1176 | -3965 | -3470 | 1894 | -3502 | -2556 | 2750 | -3215 | -120 | -27 | -3124 | -3366 | -2846 | -3113 | -2694 | -1504 | 1816 | -2142 | -1735 | 701 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 680(R) | -2118 | -2789 | -2710 | -1441 | -3626 | -2635 | -569 | -2972 | 2088 | -2636 | -1971 | -1337 | -2591 | -153 | 3343 | -2003 | -1811 | -2743 | -2476 | -2375 | 702 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 681(Y) | -1738 | -1421 | -3486 | -3138 | 2368 | -3054 | -658 | -643 | -2769 | -827 | -509 | -2313 | -3036 | -2175 | -2527 | -2188 | -1672 | 2239 | -69 | 2812 | 703 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 682(V) | -1754 | -1297 | -4329 | -3968 | -1770 | -4053 | -3752 | 2614 | -2840 | -621 | -545 | -3729 | -3878 | -3699 | -3917 | -3370 | -1746 | 2852 | -3276 | -2830 | 704 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 683(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 705 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 684(V) | -1733 | -1299 | -4267 | -3907 | -1727 | -3955 | -3640 | 1809 | -3755 | -594 | -523 | -3653 | -3820 | -3608 | -3821 | -3270 | -1732 | 3240 | -3198 | -2753 | 706 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 685(V) | 484 | -646 | -2970 | -2395 | -744 | -2499 | -1461 | 1423 | -2091 | 572 | 130 | -2055 | -2521 | -1798 | -2031 | -1603 | 1127 | 2072 | -1395 | -1034 | 707 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 686(D) | -1820 | -3681 | 3540 | 1270 | -3878 | -1659 | -1068 | -3841 | -1383 | -3714 | -3101 | -268 | -2218 | -754 | -2274 | -1465 | -1906 | -3315 | -3861 | -2859 | 708 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 687(L) | -2374 | -1911 | -4667 | -4149 | -624 | -4356 | -3248 | 1959 | -3860 | 2621 | 550 | -4014 | -3844 | -3100 | -3584 | -3637 | -2284 | -16 | -2252 | -2226 | 709 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 688(F) | -2145 | -1754 | -4444 | -3835 | 2481 | -3940 | -2678 | 1114 | -3528 | 2066 | 2253 | -3582 | -3521 | -2731 | -3201 | -3119 | -2036 | -444 | -1859 | -1796 | 710 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 689(K) | -770 | -1778 | -879 | -243 | -2063 | -1733 | -251 | 850 | 2294 | -1721 | -926 | -452 | -1801 | 148 | 1146 | 500 | -677 | -1382 | -1948 | -1464 | 711 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 690(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 712 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 691(O) | -506 | -1867 | -390 | 1178 | -2181 | -1467 | 1538 | -1890 | 436 | -1856 | 1294 | -116 | -1554 | 1790 | 1511 | -401 | -435 | -1488 | -2030 | -1407 | 713 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 692( ) | -30 | 439 | 11 | 363 | -394 | -739 | 699 | -414 | 463 | -757 | 501 | 286 | -577 | 639 | 165 | -23 | 111 | -312 | 697 | -25 | 714 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 693(N) | 911 | -1243 | -1049 | -908 | -2750 | -1283 | -1224 | -2483 | -1070 | -2619 | -1762 | 2307 | -1836 | -911 | -1451 | 2263 | -707 | -1785 | -2854 | -2361 | 715 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 694(E) | 462 | -1884 | 883 | 1229 | -2200 | -1380 | -99 | -1941 | 284 | -1912 | -1007 | -31 | 1086 | 347 | -229 | 391 | 628 | -1510 | -2102 | -1423 | 716 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 695(K) | 472 | -1945 | 816 | 942 | -2258 | 507 | -83 | -2010 | 1429 | -1957 | -1042 | -12 | -1504 | 1244 | -204 | -340 | -412 | -1564 | -2129 | -1439 | 717 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 696(K) | 725 | -1680 | -306 | 1306 | 355 | -1399 | -79 | -1633 | 1414 | -1671 | -800 | -73 | -1499 | 350 | -177 | 548 | -349 | -1268 | -1917 | -1284 | 718 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -195 | -7108 | -3069 | -894 | -1115 | -701 | -1378 | * | * | | | | | | | | | | | | |
| 697(H) | -1103 | -2714 | 2043 | 320 | -2881 | -1429 | 2588 | -2787 | -470 | -2720 | -1925 | 2549 | -1819 | -164 | -1109 | -872 | -1112 | -2328 | -2864 | -2024 | 719 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -6931 | -7973 | -894 | -1115 | -1083 | -922 | * | * | | | | | | | | | | | | |
| 698(P) | -1509 | -2622 | 2222 | -258 | -3351 | -1688 | -1206 | -3299 | -1351 | -3294 | -2623 | -586 | 3242 | -916 | -1988 | -1364 | -1649 | -2782 | -3270 | -2663 | 720 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -6931 | -7973 | -894 | -1115 | -505 | -1760 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 699(H) | -601 | -1891 | -436 | 1733 | -2050 | -1535 | 2121 | -1882 | 387 | -1862 | -1003 | -192 | -1631 | 281 | 1501 | -502 | -527 | -1509 | -1978 | 1072 | 721 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 700(G) | 2344 | -1041 | -2392 | -2527 | -3249 | 2572 | -2371 | -2970 | -2636 | -3255 | -2405 | -1721 | -2031 | -2309 | -2645 | -661 | -858 | -2002 | -3433 | -3246 | 722 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 701(L) | -2642 | -2168 | -4788 | -4235 | -465 | -4513 | -3241 | 96 | -3878 | 2891 | 2122 | -4166 | -3888 | -3023 | -3544 | -3807 | -2521 | -607 | -2140 | -2183 | 723 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 702(S) | -532 | -1511 | -753 | -320 | -2262 | -1447 | -524 | -1930 | 1366 | -2008 | -1173 | -494 | -1732 | -137 | -413 | 1983 | 1521 | -1495 | -2248 | -1710 | 724 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 703(D) | -1718 | -3250 | 3403 | -27 | -3066 | -1736 | 2667 | -3486 | -1211 | -3381 | -2732 | -400 | -2240 | -752 | -1917 | -1439 | -1784 | -3023 | -3204 | -2299 | 725 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 704(E) | 1165 | -2746 | 1435 | 2588 | -3046 | -1525 | -639 | -2845 | -567 | -2796 | -1988 | -154 | -1909 | -258 | -1213 | -943 | -1174 | -2380 | -2996 | -2179 | 726 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 705(E) | 921 | -2774 | 1237 | 2767 | -3077 | -1530 | -662 | -2877 | -603 | -2830 | -2029 | -161 | -1924 | -284 | -1256 | -967 | -1205 | -2412 | -3032 | -2209 | 727 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 706(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 728 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 707(D) | 1198 | -2653 | 2928 | 116 | -3154 | -1523 | -794 | -2975 | -806 | -2952 | -2173 | 1307 | -1973 | -435 | -1474 | -1014 | -1273 | -2473 | -3161 | -2340 | 729 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 708(N) | 497 | -2045 | 1492 | 265 | -2357 | -1412 | 1608 | -2108 | 128 | -2074 | -1183 | 1928 | -1592 | 229 | -403 | 517 | -553 | -1673 | -2265 | -1565 | 730 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 709(Y) | -1550 | -1282 | -3519 | -3004 | -2 | -3093 | -1385 | 1232 | -2635 | 1579 | 299 | -2537 | -2990 | -2153 | -2464 | -2220 | -1477 | -195 | -891 | 3290 | 731 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 710(F) | -3342 | -2276 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 732 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 711(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 733 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 712(K) | 921 | -1810 | -280 | 1204 | -2126 | -1422 | -125 | -1835 | 1451 | -1838 | -956 | -97 | -1544 | 311 | -168 | -386 | 1295 | -1438 | -2048 | -1407 | 734 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 713(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 735 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 714(K) | -1441 | -2413 | -1657 | -802 | -3025 | -2193 | -410 | -2523 | 2846 | -2335 | -1581 | -885 | -2213 | 14 | 1863 | -1343 | 790 | -2218 | -2320 | -2022 | 736 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 715(P) | -540 | -1180 | -1850 | -1974 | -3103 | -1352 | -2072 | -2962 | -2149 | -3170 | -2355 | -1527 | 3509 | -1943 | -2279 | 1382 | -938 | -2068 | -3276 | -2949 | 737 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 716(V) | -1751 | -1297 | -4323 | -3962 | -1768 | -4044 | -3741 | 2446 | -3832 | -620 | -545 | -3721 | -3872 | -3691 | -3908 | -3361 | -1744 | 2965 | -3270 | -2823 | 738 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 717(H) | -792 | -632 | -2808 | -2210 | -439 | -2360 | 2159 | 1209 | -1870 | 1529 | 409 | -1883 | -2368 | -1554 | -1794 | -1446 | -733 | 1579 | -1121 | -776 | 739 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 718(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 740 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 719(A) | 2895 | -1250 | -1253 | -1325 | -2863 | -1348 | -1637 | -2577 | -1616 | -2833 | -2042 | 1775 | -1991 | -1424 | -1888 | -716 | -888 | -1873 | -3053 | -2611 | 741 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 720(Y) | -3687 | -2724 | -4232 | -4508 | 3154 | -4089 | -368 | -2628 | -4071 | -2023 | -2062 | -2751 | -3956 | -2869 | -3483 | -3324 | -3551 | -2761 | 3099 | 3684 | 742 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 721(H) | -3205 | -3079 | -2723 | -2890 | -2110 | -3046 | 5295 | -4135 | -2617 | -3813 | -3561 | -2886 | -3482 | -2833 | -2620 | -3291 | -3356 | -3895 | -2397 | -1681 | 743 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 722(G) | -459 | -1100 | -1991 | -2176 | -3299 | 3009 | -2246 | -3146 | -2470 | -3360 | -2491 | -1586 | -2028 | -2146 | -2555 | 1630 | -885 | -2108 | -3464 | -3207 | 744 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 723(Y) | -3590 | -2700 | -4146 | -4380 | 2110 | -4028 | -403 | -2517 | -3963 | -1928 | -1973 | -2744 | -3921 | -2844 | -3431 | -3284 | -3474 | -2669 | 338 | 4419 | 745 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 724(E) | 930 | -1529 | -450 | 1712 | -1762 | -1469 | -180 | -1376 | 198 | -1516 | -699 | -206 | -1582 | 213 | 806 | -430 | -409 | 672 | -1834 | -1256 | 746 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 725(D) | -696 | -2211 | 2006 | 276 | -2503 | -1435 | 1781 | -2271 | 47 | -2216 | -1327 | 1502 | 621 | 1163 | -498 | -540 | -655 | -1822 | -2394 | -1669 | 747 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 726(M) | -522 | -1463 | 1325 | 1144 | -1558 | -1519 | -266 | -1159 | 3 | 493 | 2326 | -260 | -1645 | 90 | -458 | -522 | -468 | -941 | -1762 | -1204 | 748 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 727(I) | -1755 | -1312 | -4289 | -3853 | -1390 | -3961 | -3331 | 2559 | -3677 | 1028 | -208 | -3600 | -3736 | -3367 | -3647 | -3222 | -1724 | 2382 | -2800 | -2488 | 749 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 728(O) | -1019 | -2299 | -664 | 1508 | -2732 | -1794 | -307 | -2378 | 502 | -2248 | -1420 | -437 | -1902 | 2305 | 2189 | -887 | -914 | -1997 | -2316 | -1812 | 750 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 729(G) | 676 | -1581 | 1006 | -319 | -2686 | 1982 | -822 | -2430 | -639 | -2491 | -1630 | -507 | -1785 | -454 | -1335 | 1417 | -738 | -1837 | -2718 | -2108 | 751 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 730(L) | -2364 | -1901 | -4660 | 4144 | -630 | -4349 | -3246 | 2015 | -3856 | 2597 | 544 | -4006 | -3841 | -3101 | -3583 | -3629 | -2275 | 2 | -2255 | -2227 | 752 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 731(F) | -2056 | -1668 | -4299 | -3752 | 3006 | -3840 | -2396 | 1861 | -3446 | 1502 | 554 | -3415 | -3499 | -2733 | -3168 | -3023 | -1964 | -161 | -1660 | -1259 | 753 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 732(F) | -3581 | -2688 | -4165 | -4401 | 3865 | -4034 | -401 | -2491 | -3981 | -1903 | -1944 | -2746 | -3921 | -2847 | -3438 | -3284 | -3462 | -2647 | 341 | 3054 | 754 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 733(D) | -1066 | -2664 | 2593 | 230 | -2949 | 899 | -545 | -2751 | 996 | -2680 | -1846 | 1209 | -1852 | -148 | -1001 | -857 | -1060 | -2284 | -2863 | -2068 | 755 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 734(R) | -2957 | -3022 | -3318 | -2735 | -3796 | -2998 | -1968 | -3912 | -846 | -3631 | -3157 | -2611 | -2380 | -1724 | 4056 | -3026 | -2913 | -3650 | -3096 | -3185 | 756 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 735(H) | 673 | -1400 | -855 | -643 | -2108 | -1470 | 3344 | -1923 | -596 | -2073 | -1302 | -744 | 2404 | -583 | -931 | -699 | -761 | -1503 | -2291 | -1733 | 757 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 736(N) | -1426 | -2353 | -948 | -735 | -2920 | -1991 | -796 | -2769 | 68 | -2666 | -1942 | 3441 | -2268 | -432 | 1742 | -1361 | -1415 | -2383 | -2592 | -2147 | 758 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 737(H) | -1168 | -1729 | -1567 | -889 | -1360 | -2118 | 3917 | -1446 | 284 | -543 | -865 | -957 | -2175 | -247 | 1258 | -1239 | -1055 | -1304 | -1577 | -976 | 759 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 738(D) | -1353 | -3032 | 2615 | 202 | -3188 | -1564 | 2079 | -3118 | -756 | -3034 | -2267 | 2486 | -1998 | -383 | -1443 | -1092 | -1377 | -2642 | -3178 | -2294 | 760 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -812 | -7108 | -1241 | -894 | -1115 | -701 | -1378 | * | * | | | | | | | | | | | | |
| 739(N) | -667 | -1675 | -384 | -20 | -2103 | -1394 | -82 | -1850 | 715 | -1813 | -1049 | 2293 | -1591 | 303 | 2121 | -603 | -621 | -1504 | -1871 | -1383 | 761 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -27 | -6323 | -7365 | -894 | -1115 | -292 | -2448 | * | * | | | | | | | | | | | | |
| 740(F) | 835 | -719 | -3036 | -2438 | 1835 | -2475 | -1354 | 332 | -2101 | 1627 | 473 | -2059 | -2472 | -1719 | -1973 | -1574 | -844 | 1081 | -1167 | -839 | 762 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 741(H) | 501 | -1345 | -519 | 3 | -1474 | -1478 | 2277 | -1148 | 102 | -1306 | -513 | 945 | -1582 | 159 | -343 | -433 | 1418 | -890 | -1646 | 876 | 763 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 742(V) | -1752 | -1297 | -4324 | -3962 | -1768 | -4045 | -3742 | 2459 | -3833 | -621 | -545 | -3722 | -3873 | -3691 | -3909 | -3362 | -1744 | 2956 | -3271 | -2823 | 764 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 743( ) | -30 | 439 | 11 | 363 | -394 | -739 | 699 | -414 | 463 | -757 | 501 | 286 | -577 | 639 | 165 | -23 | 111 | -312 | 697 | -25 | 765 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 744(H) | -991 | -1830 | -1052 | -504 | -1930 | -1886 | 3890 | -1681 | 1542 | -1767 | -1038 | -666 | -1989 | -60 | 176 | -985 | -903 | 206 | -1921 | -1408 | 766 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 745(G) | -494 | -1130 | -1974 | -2194 | -3326 | 3328 | -2287 | -3191 | -2529 | -3407 | -2546 | -1609 | -2055 | -2198 | -2601 | 938 | -923 | -2148 | -3486 | -3235 | 767 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 746(Y) | -3482 | -2868 | -3701 | -3919 | 238 | -3552 | -1112 | -3000 | -3638 | -2516 | -2526 | -3027 | -3772 | -3101 | -3341 | -3418 | -3527 | -3027 | -441 | 4711 | 768 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 747(R) | -1317 | -2448 | -1232 | 1501 | -3004 | -2062 | -362 | -2555 | 2088 | -2353 | -1567 | -710 | -2107 | 70 | 2409 | -1189 | -1156 | -2213 | -2342 | -1973 | 769 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 748(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 770 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 749(E) | -603 | -2088 | 932 | 1740 | -2382 | -1414 | -194 | -2138 | 145 | -2093 | -1197 | 1660 | -1589 | 1157 | -389 | -462 | -557 | 226 | -2276 | -1569 | 771 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 750(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 772 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 751(D) | -1252 | -2482 | 2856 | -92 | -3324 | -1544 | -1056 | -3220 | -1180 | -3222 | -2479 | -441 | -2078 | -735 | -1856 | 2119 | -1401 | -2625 | -3370 | -2572 | 773 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 752(I) | -1125 | -1077 | -3099 | -2749 | -1383 | -2564 | -2209 | 2720 | -2446 | -620 | -388 | -2395 | -2828 | -2300 | -2481 | -1819 | 2258 | 661 | -2292 | -1909 | 774 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 753(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 775 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 754(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 776 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 755(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 777 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 756(F) | -3533 | -2667 | -4143 | -4362 | 4034 | -4011 | -413 | -2435 | -3947 | -1856 | -1895 | -2743 | -3904 | -2837 | -3418 | -3264 | -3419 | -2596 | 327 | 2564 | 778 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 757(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 779 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 758(M) | -1664 | -1479 | -3731 | -3304 | -822 | -3209 | -2514 | 381 | -2903 | 307 | 4447 | -2987 | -3235 | -2579 | -2815 | -2469 | -1688 | 1155 | -2108 | -1854 | 780 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 759(R) | -841 | -995 | -1971 | -1321 | -932 | -2129 | -856 | -136 | -533 | -467 | 2304 | -1291 | -2194 | -758 | 2401 | -1211 | -783 | 1416 | -1446 | -1079 | 781 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 760(V) | -954 | -916 | -2489 | -1863 | -806 | -2402 | -1212 | 292 | -1157 | 906 | 98 | -1725 | -2437 | -1258 | 1435 | -1506 | -901 | 2327 | -1472 | -1115 | 782 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 761(V) | -1831 | -1468 | -4142 | -3585 | -674 | -3694 | -2641 | 526 | -3292 | 1920 | 2093 | -3318 | -3425 | -2728 | -3099 | -2876 | -1760 | 2327 | -2028 | -1893 | 783 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 762(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 784 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 763(E) | -447 | -1916 | 638 | 1762 | -2239 | -1385 | 1510 | -1986 | 1083 | -1928 | -1009 | -19 | -1493 | 1244 | 466 | -323 | -386 | -1540 | -2092 | -1413 | 785 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 764(M) | -1749 | -1382 | -4134 | -3576 | -706 | -3632 | -2595 | 1821 | -3291 | 1705 | 2738 | -3271 | -3384 | -2732 | -3086 | -2809 | -1680 | 1590 | -2012 | -1860 | 786 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 765(D) | -1369 | -2674 | 3374 | -58 | -3453 | -1571 | -1095 | -3380 | -1289 | -3368 | -2659 | -394 | -2124 | -784 | -2016 | 1149 | -1529 | -2785 | -3505 | -2662 | 787 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 766(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 788 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 767(Y) | -3616 | -2704 | -4178 | -4426 | 3471 | -449 | -394 | -2531 | -4004 | -1934 | -1979 | -2749 | -3932 | -2854 | -3451 | -3298 | -3493 | -2683 | 349 | 3677 | 789 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 768(H) | 274 | -2294 | 1079 | 1119 | -2578 | -1451 | 3282 | -2348 | -50 | -2296 | -1419 | 1227 | -1687 | 101 | -610 | -606 | -736 | -1901 | -2481 | -1745 | 790 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 769(L) | -2092 | -1719 | -4323 | -3846 | -712 | -3925 | -2989 | 451 | -3531 | 2641 | 428 | -3624 | -3640 | -2952 | -3339 | -3191 | -2044 | 1542 | -2221 | -2096 | 791 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 770(A) | 2058 | -944 | -1182 | -683 | -1304 | -1522 | -653 | -783 | -528 | -1127 | -414 | -754 | -1773 | 942 | -860 | -602 | 852 | 742 | -1630 | -1185 | 792 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 771(K) | 1238 | -1887 | -1224 | -813 | -2786 | -1805 | -755 | -2335 | 3008 | -2384 | -1637 | -879 | -2102 | -378 | -48 | -1055 | -1089 | -1935 | -2512 | -2122 | 793 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -169 | -7108 | -3273 | -894 | -1115 | -701 | -1378 | * | * | | | | | | | | | | | | |
| 772(A) | 1327 | -1917 | 950 | 1094 | -2220 | -1330 | -74 | -1968 | 946 | -1930 | -1028 | 32 | -1480 | 360 | -228 | 547 | -411 | -1533 | -2115 | -1424 | 794 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -6956 | -7998 | -894 | -1115 | -1036 | -964 | * | * | | | | | | | | | | | | |
| 773(A) | 3386 | -1299 | -2601 | -2766 | -3046 | -1599 | -2499 | -2553 | -2749 | -2990 | -2405 | -2021 | -2272 | -2539 | -2697 | -1037 | -1201 | -1940 | -3200 | -3073 | 795 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -6956 | -7998 | -894 | -1115 | -525 | -1714 | * | * | | | | | | | | | | | | |
| 774(I) | -1087 | -861 | -3107 | 161 | -882 | -2803 | -1771 | 2342 | -2281 | 1091 | 78 | -2300 | -2777 | -2009 | -2269 | -1916 | -1039 | 1702 | -1691 | -1345 | 796 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 775(O) | 375 | -1755 | -273 | 815 | -2036 | -1376 | -39 | -1756 | 367 | -1753 | -857 | 1007 | -1469 | 1244 | 843 | -290 | 959 | 12 | -1964 | -1309 | 797 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 776(M) | -1052 | -610 | -1546 | -994 | -696 | 582 | -640 | -244 | -804 | 810 | 1789 | -967 | -1833 | -639 | -1021 | 395 | -384 | -113 | -1120 | -726 | 798 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 777(I) | -416 | -776 | -1113 | 474 | -802 | 469 | -424 | 1231 | -400 | 255 | 48 | -674 | -1747 | 951 | -718 | -659 | -357 | 665 | -1177 | -745 | 799 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 778(D) | 1034 | -2035 | 2294 | -106 | -2869 | -1459 | -830 | -2614 | -751 | -2671 | -1863 | -387 | 2260 | -474 | -1320 | -825 | -1014 | -2092 | -2906 | -2215 | 800 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 779(A) | 1299 | -1548 | -409 | 909 | -1800 | 43 | -141 | -1467 | 231 | -1558 | -718 | -156 | -1540 | 264 | 1154 | -374 | -369 | 158 | -1848 | -1253 | 801 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1040 | -7108 | -981 | -894 | -1115 | -701 | -1378 | * | * | | | | | | | | | | | | |
| 780(F) | -585 | -915 | -883 | -659 | 2573 | -1541 | -52 | -591 | -624 | -695 | -233 | 1803 | -1767 | -468 | -869 | -739 | -609 | -487 | -70 | 917 | 802 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -424 | -6099 | -2060 | -894 | -1115 | -1914 | -445 | * | * | | | | | | | | | | | | |
| 781(N) | -313 | -1042 | 254 | 152 | -1409 | -814 | -286 | -1511 | -122 | -1692 | -1083 | 3011 | -1287 | -82 | -434 | -340 | -474 | -1140 | -1574 | -976 | 803 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -41 | -5717 | -6759 | -894 | -1115 | -2091 | -386 | * | * | | | | | | | | | | | | |
| 782(E) | -647 | -1563 | 589 | 2680 | -1901 | -941 | -188 | -1630 | 4 | -1762 | -1176 | 156 | -1345 | 101 | -395 | -544 | -693 | -1348 | -1863 | -1374 | 804 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -41 | -5717 | -6759 | -894 | -1115 | -2091 | -386 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 783(K) | -682 | -1365 | -434 | -118 | -1773 | -1231 | -19 | -1449 | 2744 | -1499 | -2893 | -244 | -1470 | 310 | 740 | -670 | -643 | -1208 | -1538 | -1198 | 805 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -41 | -5717 | -6759 | -894 | -1115 | -612 | -1532 | * | * | | | | | | | | | | | | |
| 784(Y) | -620 | -433 | -2763 | -2164 | -265 | -2214 | -1076 | 1484 | -1822 | 144 | 2036 | -1779 | -2223 | -1475 | -1707 | -1306 | -562 | 1635 | -935 | 2216 | 806 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -20 | -6788 | -7830 | -894 | -1115 | -1306 | -747 | * | * | | | | | | | | | | | | |
| 785(K) | -540 | -1908 | -286 | 1554 | -2271 | 235 | -21 | -1969 | 1597 | -1892 | -1016 | -65 | -1527 | 423 | 1275 | -418 | -461 | -1559 | -2023 | -1427 | 807 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -20 | -6788 | -7830 | -894 | -1115 | -1306 | -747 | * | * | | | | | | | | | | | | |
| 786(D) | -495 | -1834 | 1772 | 243 | -2095 | -1409 | -135 | -1811 | 226 | 93 | -952 | 959 | -1543 | 1255 | -279 | -392 | 713 | -1426 | -2056 | -1398 | 808 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 787(K) | -1474 | -2433 | -1703 | -833 | -3058 | -2216 | -418 | -2547 | 2890 | -2352 | -1602 | -908 | -2333 | 6 | 1874 | -1375 | 633 | -2246 | -2329 | -2042 | 809 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 788(H) | -451 | -1596 | -374 | 131 | -1721 | 4 | 2032 | -1490 | 223 | -1570 | -735 | -150 | -1554 | 1294 | -242 | 993 | -394 | -1170 | -1803 | 1657 | 810 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 789(A) | 2417 | -1302 | -925 | -642 | -2356 | -1358 | -885 | -2038 | -600 | -2179 | -1358 | -718 | -1792 | 1772 | -969 | 686 | -646 | -1531 | -2461 | 1952 | 811 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 790(E) | 1699 | -2717 | 1896 | 1966 | -3018 | -1521 | -628 | -2814 | -547 | -2768 | -1958 | -152 | -1900 | -245 | -1190 | -928 | -1153 | -2352 | -2970 | -2159 | 812 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 791(F) | -576 | -843 | -1351 | 18 | 2111 | -1835 | -543 | -341 | 927 | 1121 | 58 | -880 | -1903 | -468 | -730 | -859 | -511 | -255 | -1145 | -680 | 813 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 792(C) | -1112 | 2697 | -3476 | -2950 | -1103 | -2900 | -2047 | 2026 | -2659 | -523 | -143 | -2556 | -2914 | -2378 | -2583 | -2056 | 623 | 2331 | -1900 | -1524 | 814 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 793(O) | 419 | -1959 | 511 | 264 | -2287 | -1397 | -160 | -2033 | 201 | -2001 | -1102 | 892 | -1555 | 2127 | -318 | 1297 | -485 | -1597 | -2190 | -1503 | 815 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 794( ) | -30 | 439 | 11 | 363 | -394 | -739 | 699 | -414 | 463 | -757 | 501 | 286 | -577 | 639 | 165 | -23 | 111 | -312 | 697 | -25 | 816 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 795(E) | -617 | -2049 | -177 | 2132 | -2369 | -1467 | 1606 | -2104 | 1334 | -2049 | -1159 | -104 | -1611 | 267 | -171 | 468 | -558 | -1677 | -2212 | -1550 | 817 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 796(M) | -2288 | -1880 | -4481 | -3899 | 1874 | -4066 | -2635 | 72 | -3594 | 1748 | 3848 | -3656 | -3608 | -2775 | -3272 | -3259 | -2174 | -566 | -1778 | -1555 | 818 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 797(D) | -1194 | -2847 | 2837 | 1238 | -3100 | -1527 | -634 | -2920 | -571 | -2845 | -2036 | 1124 | -1913 | -251 | -1231 | -958 | 827 | -2447 | -3037 | -2200 | 819 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 798(H) | -831 | -2392 | 1999 | 980 | -2678 | -1463 | 2287 | -2459 | 551 | -2391 | -1516 | 1798 | -1718 | 62 | -667 | -653 | -799 | -2000 | -2566 | -1815 | 820 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 799(M) | -496 | -1070 | -899 | -350 | 1464 | -1648 | -334 | -716 | 1384 | -934 | 2286 | 1246 | -1730 | -100 | -455 | -629 | -434 | -548 | -1346 | -826 | 821 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 800(I) | -1200 | -1080 | -2894 | -2252 | -618 | -2712 | -1476 | 2020 | -1547 | 1701 | 361 | -2078 | -2664 | -1554 | 1445 | -1820 | -1129 | 84 | -1503 | -1217 | 822 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 801(O) | 1195 | -1999 | 1275 | 287 | -2307 | -1399 | -132 | -2058 | 888 | -2010 | -1104 | 1022 | -1544 | 1594 | -271 | -396 | -475 | -1616 | -2187 | -1494 | 823 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 802(E) | -464 | -1834 | -313 | 1601 | -2133 | -1426 | -72 | -1849 | 1475 | -301 | -936 | -76 | -1522 | 1237 | -64 | -359 | 488 | -1446 | -2019 | -1377 | 824 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 803(H) | 1285 | -1168 | -1100 | -753 | -1895 | -1421 | 3671 | -1567 | -616 | -1783 | -1019 | -796 | -1815 | -585 | -942 | -599 | 1325 | -1196 | -2122 | -1628 | 825 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 804(H) | -457 | -1111 | -796 | -240 | 1415 | -1595 | 1499 | -796 | -56 | -1014 | -275 | 1464 | -1677 | -16 | 1113 | -558 | -395 | 539 | -1363 | -816 | 826 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 805(O) | 961 | -1898 | 742 | 284 | -2209 | -1388 | 1553 | -1951 | 1291 | -1907 | -995 | -26 | -1499 | 1771 | -144 | -331 | -392 | -1516 | -2082 | -1407 | 827 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 806(Y) | -3616 | -2706 | -4170 | -4415 | 2670 | -4045 | -396 | -2536 | -3994 | -1940 | -1985 | -2748 | -3931 | -2852 | -3447 | -3296 | -3495 | -2687 | 347 | 4234 | 828 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 807(I) | 1201 | -821 | -2746 | -2313 | -1223 | -2126 | -1705 | 2731 | -2058 | -749 | -304 | -1944 | -2428 | -1844 | -2105 | -1330 | 893 | 505 | -1890 | -1524 | 829 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 808(R) | -841 | -995 | -1971 | -1321 | -932 | -2129 | -856 | -136 | -533 | -467 | 2304 | -1291 | -2194 | -758 | 2401 | -1211 | -783 | 1416 | -1446 | -1079 | 830 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 809(D) | -1157 | -2811 | 2313 | 1149 | -3071 | -1519 | -606 | -2891 | -523 | -2811 | -1992 | 1715 | -1893 | -218 | -1175 | 1334 | -1159 | -2414 | -2998 | -2166 | 831 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 810(N) | 377 | -1890 | -201 | 941 | -2201 | -1398 | -93 | -1936 | 1328 | -1904 | -1001 | 1972 | -1518 | 353 | -173 | -356 | 594 | -1511 | -2089 | -1420 | 832 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 811(G) | -1501 | -2131 | -1258 | -1392 | -2600 | 3138 | 2851 | -3219 | -1608 | -3233 | -2576 | -1477 | -2541 | -1589 | -1850 | -1578 | -1737 | -2674 | -2756 | -2168 | 833 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 812(Y) | 385 | -1523 | -449 | 96 | -1722 | -1461 | -132 | -1384 | 959 | -1486 | -659 | -175 | -1554 | 1557 | -186 | -399 | 1250 | -1083 | -1786 | 1631 | 834 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 813(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 835 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 814(L) | -587 | -625 | -1931 | -1364 | -454 | -1983 | 1655 | 818 | -1068 | 1666 | 322 | -1268 | 955 | -903 | -1182 | -1033 | -529 | 21 | -1001 | -559 | 836 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 815(P) | -1667 | -2676 | -329 | 1564 | -3405 | -1913 | -1351 | -3268 | -1273 | -3276 | -2612 | -852 | 3489 | -1057 | -1736 | -1555 | -1787 | -2810 | -3275 | -2761 | 837 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 816(E) | -1715 | -3562 | 2447 | 2878 | -3759 | -1632 | -991 | -3691 | -1235 | -3569 | -2910 | -235 | -2166 | -663 | -2079 | -1378 | -1784 | -3173 | -3732 | -2750 | 838 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 817(V) | -537 | -374 | -2717 | -2103 | 914 | -2090 | -949 | 1111 | -1742 | -147 | 443 | -1675 | -2132 | -1398 | -1608 | -1173 | 1109 | 1932 | -845 | 1322 | 839 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 818(T) | -442 | -1699 | -325 | 943 | -1942 | -1425 | -95 | -1640 | 311 | -1680 | -816 | 906 | -1525 | 330 | 784 | -363 | 1592 | -2383 | -1922 | 1369 | 840 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 819(D) | -1684 | -3395 | 2909 | 109 | -3677 | -1635 | -1030 | -3669 | -1283 | -3567 | -2912 | 2851 | -2178 | -713 | -2110 | -1377 | -1776 | -3137 | -3688 | -2726 | 841 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 820(W) | -2023 | -1815 | -3480 | -3119 | 26 | -3133 | -1280 | -780 | -2462 | -329 | 2687 | -2604 | -3188 | -2264 | -2350 | -2462 | -2001 | -1067 | 5349 | 158 | 842 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 821(Q) | -408 | -1655 | -342 | 851 | -1897 | -1411 | -76 | -1588 | 323 | -1635 | -770 | -87 | 785 | 1202 | 869 | -334 | 619 | 752 | -1887 | -1265 | 843 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 822(W) | -2077 | -1892 | -3023 | -2742 | 805 | -3065 | -450 | -1653 | -2397 | -1546 | -1211 | -2106 | -3118 | -1977 | -2345 | 1002 | -2038 | -1614 | 4785 | 2862 | 844 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 823(K) | -479 | -1638 | -472 | 91 | 1024 | -1483 | -125 | -1548 | 1811 | -1610 | -769 | -180 | 147 | 288 | 950 | 516 | -413 | -1222 | -1868 | -1282 | 845 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 824(G) | -736 | -2137 | 965 | 180 | -2586 | 1581 | -401 | -2350 | -145 | -2321 | -1448 | 1563 | 712 | 15 | -699 | 528 | -738 | -1882 | -2516 | -1799 | 846 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -276 | -7108 | -2582 | -894 | -1115 | -701 | -1378 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 825(L) | -1714 | -1375 | -3901 | -3421 | -618 | -3530 | -2616 | 734 | -3109 | 2342 | 497 | -3185 | -3329 | -2647 | -2982 | -2766 | -1674 | 1950 | -2019 | -1825 | 847 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6850 | -7893 | -894 | -1115 | -1215 | -813 | * | * | | | | | | | | | | | | |
| 826(K) | -1321 | -2321 | -787 | -481 | -1892 | -1879 | -447 | -2552 | 3186 | -2406 | -1676 | 717 | -2074 | -54 | 419 | -1212 | -1230 | -2209 | -2369 | -1979 | 848 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1043 | -6850 | -983 | -894 | -1115 | -1215 | -813 | * | * | | | | | | | | | | | | |
| 827(V) | 11 | -281 | -1388 | -1014 | -772 | -1145 | -782 | 672 | -779 | -271 | 145 | -834 | -1527 | -694 | -967 | -363 | 1648 | 1687 | -1388 | -977 | 849 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 828(D) | -878 | -1818 | 3239 | 428 | -2222 | -972 | -438 | -2180 | -575 | -2276 | -1711 | 95 | -1458 | -189 | -1148 | -733 | -979 | -1822 | -2152 | -1652 | 850 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 829(K) | -453 | -1667 | 328 | 1484 | -2007 | -1088 | 173 | -1659 | 1862 | -1641 | -861 | 236 | -1304 | 570 | 510 | -325 | -390 | -1317 | -1793 | -1239 | 851 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 830(K) | -207 | -1058 | -256 | 150 | -1533 | -1073 | 83 | -1043 | 1817 | -1222 | -493 | -14 | -1295 | 442 | 505 | -228 | 1299 | -760 | -1520 | -1048 | 852 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 831(G) | 414 | -272 | -462 | -426 | -1782 | 1704 | -635 | -1518 | -577 | -1737 | -936 | -257 | -1039 | -416 | -850 | 1592 | 98 | -853 | -1974 | -1547 | 853 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 832(M) | 1337 | -339 | -1188 | -761 | -497 | -1179 | -525 | 361 | -511 | 26 | 2356 | -679 | -1477 | -431 | -716 | -350 | -116 | 415 | -1109 | -709 | 854 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 833(V) | -753 | 590 | -2446 | -1973 | -226 | -2358 | -1433 | 1299 | -1657 | 1429 | 779 | -1837 | -2356 | -1469 | -1726 | -1538 | -740 | 2084 | -1336 | -966 | 855 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 834(T) | 413 | -229 | -707 | -500 | -1469 | -500 | -543 | -1022 | -421 | -1349 | -599 | -312 | -1063 | -330 | -674 | 1483 | 1911 | -534 | -1729 | 1303 | 856 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 835(A) | 2597 | -310 | -1033 | -1004 | -1499 | -618 | -950 | -768 | -944 | -1290 | -768 | -669 | -1235 | -852 | -1081 | -19 | -107 | -412 | -1828 | -1482 | 857 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 836(T) | 93 | -414 | -954 | -868 | -1353 | -741 | -817 | -616 | -701 | -1116 | -632 | -643 | -1304 | -696 | -854 | -136 | 2822 | -336 | -1700 | -1317 | 858 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 837(A) | 2597 | -310 | -1033 | -1004 | -1499 | -618 | -950 | -768 | -944 | -1290 | -768 | -669 | -1235 | -852 | -1081 | -19 | -107 | -412 | -1828 | -1482 | 859 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 838(A) | 2597 | -310 | -1033 | -1004 | -1499 | -618 | -950 | -768 | -944 | -1290 | -768 | -669 | -1235 | -852 | -1081 | -19 | -107 | -412 | -1828 | -1482 | 860 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 839(T) | 93 | -414 | -954 | -868 | -1353 | -741 | -817 | -616 | -701 | -1116 | -632 | -643 | -1304 | -696 | -854 | -136 | 2822 | -336 | -1700 | -1317 | 861 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 840(A) | 2597 | -310 | -1033 | -1004 | -1499 | -618 | -950 | -768 | -944 | -1290 | -768 | -669 | -1235 | -852 | -1081 | -19 | -107 | -412 | -1828 | -1482 | 862 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 841(G) | -461 | -838 | -976 | -1119 | -2120 | 3148 | -1219 | -2101 | -1326 | -2273 | -1700 | -986 | -1505 | -1212 | -1430 | -653 | -781 | -1558 | -1923 | -1928 | 863 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 842(D) | -878 | -1818 | 3239 | 428 | -2222 | -972 | -438 | -2180 | -575 | -2276 | -1711 | 95 | -1458 | -189 | -1148 | -733 | -979 | -1822 | -2152 | -1652 | 864 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 843(N) | -431 | -1158 | 164 | 47 | -1545 | -910 | -407 | -1680 | -257 | -1848 | -1242 | 3201 | -1391 | -207 | -570 | -456 | -599 | -1296 | -1696 | -1106 | 865 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -2039 | -402 | * | * | | | | | | | | | | | | |
| 844(E) | -771 | -1700 | 518 | 2837 | -2056 | -1033 | -298 | -1811 | -123 | -1925 | -1338 | 65 | -1445 | -9 | -532 | -658 | -819 | -1519 | -1994 | -1511 | 866 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -38 | -5845 | -6888 | -894 | -1115 | -238 | -2716 | * | * | | | | | | | | | | | | |
| 845( ) | -30 | 439 | 11 | 363 | -394 | -739 | 699 | -414 | 463 | -757 | 501 | 286 | -577 | 639 | 165 | -23 | 111 | -312 | 697 | -25 | 867 |
| - | * | * | * | * | * | * | * | * | * | * | * | * | * | * | * | * | * | * | * | * | |
| - | * | * | * | * | * | * | * | * | 0 | | | | | | | | | | | | |

TABLE 7

HMMER2.0 12.3.21
NAME XFP N
ACC PF09364.1
DESC XFP N-terminal domain
LENG 396
ALPH Amino
RF no
CS no
MAP yes
COM hmmbuild -f -F HMM fs.ann SEED.ann
COM hmmcalibrate --seed 0 HMM fs.ann
NSEQ 6
DATE Thu May 3 17:57:17 2007
CKSUM 7893
GA 15.1 15.1
TC 15.1 15.1
NC 14.6 14.6
XT -8455 -4 -1000 -1000 -8455 -4 -8455 -4
NULT -4 -8455
NULE 595 -1558 85 338 -294 453 -1158 197 249 902 -1085 -142 -21 -313 45 531 201 384 -1998 -644
EVD -10.948357 0.672333

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | -193 | * | -3000 | | | | | | | | | | | | | | | | | | |
| 1(K) | -1968 | -2951 | -2155 | -1320 | -3390 | -2747 | -966 | -3007 | 2330 | -2844 | -2086 | -1422 | 2165 | -549 | 1590 | -1872 | -1791 | -2712 | -2821 | 1937 | 1 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | * | * | | | | | | | | | | | | |
| 2(I) | -1769 | -1476 | -4090 | -3550 | -1526 | -3579 | -2618 | 2387 | -3249 | 1441 | -544 | 1396 | -3532 | -2933 | -3155 | -2723 | -1726 | 1550 | -2406 | -2063 | 2 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9624 | | | | | | | | | | | | |
| 3(S) | -1378 | -2318 | 1402 | -1145 | -3726 | -2032 | -1821 | -3503 | -1805 | -3583 | -2748 | -1309 | -2587 | -1497 | -2321 | 2452 | 2280 | -2794 | -3796 | -3178 | 3 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9622 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 4(D) | -2415 | -4334 | 2560 | 2263 | -4523 | -2295 | -1677 | -4467 | -1966 | -4327 | -3682 | -889 | 2279 | -1352 | -2856 | -2064 | -2494 | -3929 | -4515 | -3478 | 4 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9620 | | | | | | | | | | | | |
| 5(E) | 818 | -2294 | -768 | 2387 | -2689 | -1890 | -629 | -2403 | -181 | -2389 | -1504 | -596 | -2035 | -193 | 1173 | -879 | 979 | -1984 | -2580 | -1944 | 5 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9618 | | | | | | | | | | | | |
| 6(Y) | 868 | -2568 | -747 | 2575 | -2297 | -2202 | -1201 | -2582 | -1098 | -2680 | -1956 | -1001 | -2523 | -938 | -1573 | -1484 | -1571 | -2270 | -2610 | 2844 | 6 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9617 | | | | | | | | | | | | |
| 7(L) | -2772 | -2280 | -5308 | -4845 | -1620 | -5006 | -4218 | 1675 | -4673 | 2505 | -404 | -4676 | -4560 | -4047 | -4494 | -4304 | -2713 | 1658 | -3269 | -3192 | 7 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9615 | | | | | | | | | | | | |
| 8(H) | 899 | -2380 | -623 | 1169 | -2703 | -1834 | 2073 | -2447 | 1918 | -2389 | -1478 | 1301 | -1952 | -64 | -563 | -794 | -860 | -2005 | -2553 | -1878 | 8 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9613 | | | | | | | | | | | | |
| 9(K) | -1161 | -2683 | 1251 | -212 | -2990 | 727 | -723 | -2756 | 1972 | -2690 | -1794 | 1663 | -2115 | 1586 | -911 | -1006 | -1116 | -2301 | -2857 | -2139 | 9 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9611 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 10(M) | -2709 | -2269 | -5162 | -4623 | -1349 | -4724 | -3702 | 1512 | -4374 | 1792 | 3396 | -4390 | -4320 | -3675 | -4116 | -3951 | -2630 | 1553 | -2866 | -2812 | 10 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9609 | | | | | | | | | | | | |
| 11(H) | -2820 | -4339 | 3411 | -925 | -4078 | -2615 | 3698 | -4807 | -2416 | -4617 | -4088 | -1308 | -3181 | -1809 | -3221 | -2491 | -2928 | -4293 | -4210 | -3302 | 11 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9607 | | | | | | | | | | | | |
| 12(K) | 1531 | -2609 | -1521 | -881 | -3185 | 677 | -855 | -2809 | 2197 | -2705 | -1875 | -1069 | -2428 | -423 | 1698 | -1376 | -1380 | -2418 | -2783 | -2320 | 12 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9605 | | | | | | | | | | | | |
| 13(Y) | -4639 | -3574 | -5042 | -5388 | 3053 | -4919 | -1116 | -3531 | -4943 | -2851 | -2938 | -3536 | -4775 | -3673 | -4311 | -4166 | -4491 | -3684 | 3607 | 3791 | 13 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9604 | | | | | | | | | | | | |
| 14(W) | -3826 | -3700 | -3776 | -3690 | -1600 | -3954 | -2357 | -4085 | -2609 | -3642 | -3464 | -3450 | -4249 | 2161 | -2584 | -3858 | -3853 | -4045 | 5840 | -1155 | 14 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9602 | | | | | | | | | | | | |
| 15(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 15 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9600 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 16(A) | 3208 | -1704 | -3999 | -4070 | -3276 | -2242 | -3400 | -1516 | -3824 | -2767 | -2340 | -2844 | -2960 | -3485 | -3660 | -1604 | -1654 | 1301 | -3916 | -3651 | 16 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9598 | | | | | | | | | | | | |
| 17(C) | 3231 | 3331 | -4290 | -4524 | -4051 | -2061 | -3603 | -3558 | -4177 | -4038 | -321 | -2842 | -2850 | -3725 | -3864 | -1443 | -1636 | -2656 | -4310 | -4227 | 17 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9596 | | | | | | | | | | | | |
| 18(N) | -2093 | -3624 | 1842 | -565 | -4191 | -2225 | -1624 | -4071 | -1786 | -4008 | -3287 | 3436 | -2749 | -1290 | -2544 | -1859 | 1312 | -3511 | -4199 | -3291 | 18 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9594 | | | | | | | | | | | | |
| 19(Y) | -4605 | -3570 | -5021 | -5357 | 2115 | -4893 | -1140 | -3492 | -4921 | -2816 | -2906 | -3546 | -4765 | -3679 | -4305 | -4160 | -4468 | -3656 | -389 | 4545 | 19 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9592 | | | | | | | | | | | | |
| 20(L) | -3485 | -2916 | -5860 | -5269 | -1134 | -5582 | -4270 | 1416 | -5040 | 2720 | 2646 | -5288 | -4721 | -3890 | -4562 | -4907 | -3336 | -1219 | -2912 | -3094 | 20 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9591 | | | | | | | | | | | | |
| 21(A) | 2093 | -1633 | -3496 | -3406 | -3943 | 1228 | -3043 | -3705 | -3256 | -3935 | -3021 | -2418 | -2652 | -2942 | -3281 | 2007 | 1343 | -2649 | -4148 | -3944 | 21 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9589 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 22(I) | 1858 | -1782 | -4736 | -4347 | -2337 | -4240 | -3903 | 2415 | -4179 | -1341 | -1167 | -4002 | -4207 | -4002 | -4206 | -3513 | -2172 | 2258 | -3603 | -3167 | 22 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9587 | | | | | | | | | | | | |
| 23(G) | -1257 | -1874 | -3207 | -3523 | -4341 | 3341 | -3408 | -4248 | -3853 | -4463 | -3557 | -2605 | -2866 | -3402 | -3760 | 1410 | -1718 | -3031 | -4475 | -4358 | 23 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9585 | | | | | | | | | | | | |
| 24(M) | -2521 | -2386 | -3846 | -3279 | -1155 | -3984 | -2657 | -686 | -2594 | 1335 | 3429 | -3250 | -3784 | 3078 | -2603 | -3140 | -2428 | -1237 | -2461 | -2296 | 24 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9583 | | | | | | | | | | | | |
| 25(I) | -2891 | -2390 | -5370 | -4957 | -1628 | -5096 | -4334 | 3554 | -4751 | 1008 | -437 | -4806 | -4650 | -4141 | -4574 | -4462 | -2842 | -63 | -3311 | -3180 | 25 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9581 | | | | | | | | | | | | |
| 26(Y) | -4614 | -3571 | -5028 | -5366 | 3123 | -4901 | -1136 | -3497 | -4929 | -2819 | -2909 | -3545 | -4768 | -3679 | -4308 | -4163 | -4474 | -3661 | -384 | 4150 | 26 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9579 | | | | | | | | | | | | |
| 27(L) | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 27 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9577 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 28(R) | -1752 | -2663 | -1994 | -1206 | -3071 | -2612 | -927 | -2620 | 1567 | 1194 | -1815 | -1326 | -2642 | -523 | 2318 | 1048 | -1606 | -2354 | -2690 | -2328 | 28 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9576 | | | | | | | | | | | | |
| 29(D) | -2163 | -3991 | 2853 | 1466 | -4198 | -2255 | -1494 | -4086 | -1627 | -3968 | -3237 | 1901 | -2710 | -1142 | -2410 | 971 | -2206 | -3573 | -4159 | -3203 | 29 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9574 | | | | | | | | | | | | |
| 30(N) | -2100 | -2812 | -1725 | -2071 | -4541 | 1400 | -2845 | -4689 | -3101 | -4717 | -3995 | 3948 | -3237 | -2675 | -3479 | -2189 | -2459 | -3750 | -4448 | -4114 | 30 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9572 | | | | | | | | | | | | |
| 31(P) | -2845 | -2996 | -4029 | -4118 | -2821 | -3470 | -3585 | -2547 | -3827 | 1069 | -2145 | -3734 | 3854 | -3778 | -3737 | -3186 | -3115 | -2756 | -3564 | -3278 | 31 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9570 | | | | | | | | | | | | |
| 32(L) | -3571 | -3027 | -4990 | -4839 | -362 | -4751 | -2053 | -1386 | -4381 | 2878 | -762 | -3969 | -4502 | -3586 | -4013 | -4093 | -3476 | -1986 | -1288 | 2490 | 32 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9568 | | | | | | | | | | | | |
| 33(M) | -2211 | -1924 | -4481 | -3865 | 1786 | -3872 | -2670 | -469 | -3517 | 2158 | 2560 | -3505 | -3670 | -2910 | -3263 | -3004 | 1361 | -903 | -2139 | -1963 | 33 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1891 | -7944 | -464 | -894 | -1115 | -701 | -1378 | -9818 | -9566 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 34(S) | 87 | -526 | -885 | -918 | -1797 | -699 | -2670 | -1679 | -970 | -1948 | -1267 | -663 | -1335 | -874 | -1147 | 2826 | -252 | -1082 | -2036 | -1577 | 34 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -34 | -6087 | -7129 | -894 | -1115 | -2832 | -218 | -9818 | -9564 | | | | | | | | | | | | |
| 35(V) | -734 | -692 | -2391 | -2193 | -909 | -2005 | -1781 | 1094 | -1922 | -136 | -10 | -1902 | -2325 | -1852 | -1974 | -1413 | -858 | 2960 | -1857 | -1405 | 35 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -34 | -6087 | -7129 | -894 | -1115 | -2832 | -218 | -9818 | -9562 | | | | | | | | | | | | |
| 36(T) | -84 | -586 | -1220 | -1166 | -1618 | -901 | -1090 | -915 | -1004 | -1450 | -917 | -886 | -1488 | -990 | -1134 | -317 | 3114 | -605 | -1941 | -1587 | 36 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -34 | -6087 | -7129 | -894 | -1115 | -2832 | -218 | -9818 | -9560 | | | | | | | | | | | | |
| 37(R) | -2583 | -3338 | -2968 | -1938 | -4226 | 2024 | -1216 | -3597 | 1648 | -3282 | -2594 | -1884 | -3156 | -798 | 2920 | -2479 | -2342 | -3324 | -3144 | -3004 | 37 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9558 | | | | | | | | | | | | |
| 38(E) | -1678 | -2848 | -628 | 2969 | -3815 | 1219 | -1598 | -3602 | -1552 | -3614 | -2817 | -1072 | -2634 | -1251 | -2123 | -1592 | 1327 | -3012 | -3808 | -3091 | 38 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9557 | | | | | | | | | | | | |
| 39(P) | -3058 | -3915 | 1871 | -1726 | -4973 | -2986 | -2783 | -5207 | -3189 | -5075 | -4546 | -2051 | 3849 | -2577 | -3857 | -2918 | -3276 | -4561 | -4629 | -4315 | 39 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9555 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 40(L) | -3389 | -2846 | -5732 | -5157 | 1795 | -5405 | -3964 | 1554 | -4913 | 2673 | 66 | -5067 | -4642 | -3819 | -4457 | -4697 | -3249 | -1211 | -2753 | -2720 | 40 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9553 | | | | | | | | | | | | |
| 41(K) | -1121 | -2502 | -1004 | 1296 | -2888 | -2042 | -588 | -2583 | 2027 | -2485 | -1598 | -681 | -2119 | 1586 | 1299 | -1000 | 1054 | -2164 | -2595 | -2010 | 41 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9551 | | | | | | | | | | | | |
| 42(P) | 784 | -2052 | -818 | 1262 | -2296 | -1869 | -546 | -1970 | -134 | 107 | -1190 | -567 | 1773 | -132 | 1208 | -813 | -814 | -1637 | -2305 | -1705 | 42 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9549 | | | | | | | | | | | | |
| 43(E) | -2121 | -3903 | 1652 | 3001 | -4126 | -2231 | -1448 | -3991 | 1462 | -3872 | -3127 | -825 | -2693 | -1089 | -2171 | -1828 | -2151 | -3493 | -4045 | -3137 | 43 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9547 | | | | | | | | | | | | |
| 44(H) | -1900 | -3602 | 2493 | -392 | -3825 | -2165 | 3314 | -3680 | -1250 | -3583 | -2790 | 1715 | -2572 | 1675 | -1911 | -1645 | -1910 | -3197 | -3754 | -2894 | 44 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9545 | | | | | | | | | | | | |
| 45(I) | -2547 | -2059 | -5152 | -4751 | -2029 | -4889 | -4388 | 2502 | -4626 | 1616 | -797 | -4548 | -4567 | -4264 | -4595 | -4202 | -2516 | 2260 | -3637 | -3383 | 45 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9543 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 46(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 46 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9541 | | | | | | | | | | | | |
| 47(H) | 826 | -2035 | -963 | -419 | -2397 | -1898 | 3051 | -2073 | -206 | -2136 | -1290 | -675 | 932 | -235 | 1162 | -866 | 1249 | -1718 | -2394 | -1810 | 47 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9539 | | | | | | | | | | | | |
| 48(R) | -2700 | -3449 | -3065 | -1955 | -4296 | -3222 | -1177 | -3628 | 1592 | -3280 | -2601 | 1619 | -3187 | -756 | 3400 | -2568 | -2401 | -3384 | -3125 | -3003 | 48 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9537 | | | | | | | | | | | | |
| 49(L) | -2172 | -1972 | -4362 | -3884 | -1289 | -3737 | -2942 | -312 | -3536 | 2565 | -217 | -3515 | 1361 | -3084 | -3377 | -2952 | -2169 | 1219 | -2509 | -2319 | 49 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9535 | | | | | | | | | | | | |
| 50(V) | -2641 | -2155 | -5210 | -4776 | -1803 | -4918 | -4261 | 1765 | -4623 | 2179 | -584 | -4583 | -4545 | -4128 | -4515 | -4219 | -2597 | 2215 | -3420 | -3528 | 50 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9533 | | | | | | | | | | | | |
| 51(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 51 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9531 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 52(H) | -4836 | -4275 | -4356 | -4629 | -3663 | -4242 | 5422 | -5932 | -4492 | -5436 | -5298 | -4579 | -4696 | -4620 | -4352 | -5005 | -5030 | -5648 | -3750 | -3259 | 52 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9529 | | | | | | | | | | | | |
| 53(W) | -5598 | -4432 | -5385 | -5722 | -3380 | -4524 | -4140 | -5941 | -5643 | -5318 | -5354 | -5427 | -4938 | -5474 | -5178 | -5909 | -5751 | -5890 | 6275 | -2993 | 53 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9527 | | | | | | | | | | | | |
| 54(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 54 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9526 | | | | | | | | | | | | |
| 55(T) | -1093 | -1706 | -3487 | -3693 | -4074 | -1966 | -3302 | -3842 | -3638 | -4134 | -3253 | -2558 | -2748 | -3296 | -3520 | 1110 | 3646 | -2760 | -4304 | -4125 | 55 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9524 | | | | | | | | | | | | |
| 56(C) | -1052 | 2901 | -3250 | -2679 | -1060 | -2526 | -1634 | 1315 | -2341 | -866 | -266 | -2229 | -2670 | -2018 | -2238 | 1521 | 1154 | 1349 | -1596 | -1246 | 56 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9522 | | | | | | | | | | | | |
| 57(P) | -1362 | -1972 | -3107 | -3390 | -4250 | -2166 | -3327 | -4213 | -3641 | -4411 | -3553 | -2613 | 3840 | -3308 | -3600 | 1256 | -1811 | -3082 | -4372 | -4198 | 57 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9520 | | | | | | | | | | | | |

TABLE 7-continued

| | | | | | | | | | | | | | | | | | | | | |
|---|---|---|---|---|---|---|---|---|---|---|---|---|---|---|---|---|---|---|---|---|
| 58(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 58 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9518 | | | | | | | | | | | | |
| 59(O) | -2629 | -2340 | -4433 | -3873 | -1140 | -4292 | -3047 | 1389 | -3342 | 2319 | -20 | -3746 | -4000 | 2559 | -3238 | -3469 | -2536 | -946 | -2531 | -2422 | 59 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9516 | | | | | | | | | | | | |
| 60(S) | -1129 | -1869 | -2034 | -2027 | -3771 | -1956 | -2322 | -3546 | -2277 | -3697 | -2821 | 2528 | -2607 | -2062 | -2583 | 2544 | 1447 | -2665 | -3893 | -3470 | 60 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9514 | | | | | | | | | | | | |
| 61(F) | -3253 | -2755 | -5063 | -4895 | 3979 | -4679 | -2230 | 1673 | -4579 | -697 | -843 | -4029 | -4483 | -3735 | -4216 | -4008 | -3205 | -1123 | -1463 | -453 | 61 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9512 | | | | | | | | | | | | |
| 62(I) | -2667 | -2178 | -5235 | -4799 | -1779 | -4947 | -4278 | 2326 | -4646 | 2166 | -559 | -4613 | -4558 | -4130 | -4529 | -4251 | -2621 | 1716 | -3410 | -3264 | 62 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9510 | | | | | | | | | | | | |
| 63(Y) | -4030 | -3324 | -4830 | -4953 | 82 | -4664 | -1400 | -2548 | -4444 | 776 | -2024 | -3603 | -4588 | -3589 | 4024 | -4010 | -3953 | -2880 | -668 | 4492 | 63 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9508 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 64(A) | 2914 | -1624 | -3741 | -3790 | -3997 | -1911 | -3253 | -3736 | -3609 | -4009 | -3103 | -2541 | -2685 | -3231 | 3506 | 1407 | 1356 | -2665 | -4233 | -4079 | 64 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9506 | | | | | | | | | | | | |
| 65(H) | -4836 | -4275 | -4356 | -4629 | -3663 | -4242 | 5422 | -5932 | -4492 | -5436 | -5298 | -4579 | -4696 | -4620 | -4352 | -5005 | -5030 | -5648 | -3750 | -3259 | 65 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9504 | | | | | | | | | | | | |
| 66(C) | 868 | 2955 | -3843 | -3261 | -1152 | -3113 | -2129 | 1511 | -2905 | 1928 | -237 | -2799 | -3137 | -2521 | -2739 | -2241 | -1449 | -4 | -1921 | -1610 | 66 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9502 | | | | | | | | | | | | |
| 67(N) | -3642 | -3838 | -3004 | -3356 | -4743 | -3612 | -3773 | -5643 | -4099 | -5460 | -5060 | 4378 | -4185 | -3865 | -4225 | -3744 | -3940 | -5002 | -4391 | -4381 | 67 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9500 | | | | | | | | | | | | |
| 68(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 68 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9498 | | | | | | | | | | | | |
| 69(I) | 687 | -1693 | -4550 | -4054 | -1797 | -4053 | -3239 | 2451 | -3802 | 1595 | -714 | -3702 | -3939 | -3479 | -3713 | -3246 | -2027 | 1554 | -2897 | -2565 | 69 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9496 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 70(I) | -3202 | -2787 | -5004 | -4996 | -2836 | -4384 | -4440 | 3937 | -4838 | -1815 | -1871 | -4704 | -4600 | -4683 | -4704 | -4353 | -3280 | -603 | -3938 | -3661 | 70 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9494 | | | | | | | | | | | | |
| 71(N) | 777 | -2760 | -1484 | -853 | -3260 | -2383 | -822 | -2877 | 1407 | -2738 | -1911 | 2481 | -2455 | -385 | 2206 | -1436 | -1435 | -2500 | -2791 | -2332 | 71 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9492 | | | | | | | | | | | | |
| 72(K) | -1654 | -2912 | 1393 | -667 | -3173 | -2287 | -1055 | -2863 | 3038 | 286 | -2070 | -954 | -2512 | -685 | -811 | -1519 | -1598 | -2533 | -3029 | -2434 | 72 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9490 | | | | | | | | | | | | |
| 73(Y) | -3965 | -3303 | -4553 | -4498 | 2089 | -4562 | 2685 | -3175 | -3880 | -2696 | -2630 | -3283 | -4469 | -3249 | 1301 | -3756 | -3844 | -3248 | -415 | 3893 | 73 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9488 | | | | | | | | | | | | |
| 74(D) | -2647 | -4396 | 3720 | -698 | -4634 | -2448 | -1896 | -4723 | -2212 | -4559 | -3990 | -1090 | -3022 | 1848 | -3057 | -2298 | -2751 | -4181 | -4595 | -3647 | 74 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9486 | | | | | | | | | | | | |
| 75(O) | 786 | -1836 | -2085 | -1707 | -1785 | -2491 | -1572 | -1296 | -1287 | 1558 | -860 | -1741 | -2731 | 3104 | -1481 | -1664 | -1471 | -1312 | -2370 | -1975 | 75 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9484 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 76(N) | -2189 | -3961 | 2351 | -476 | -4203 | -2257 | -1501 | -4079 | 1323 | -3955 | -3231 | 3154 | -2736 | -1150 | -2219 | -1890 | -2229 | -3577 | -4120 | -3208 | 76 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9482 | | | | | | | | | | | | |
| 77(M) | -1639 | -1552 | -3944 | -3485 | -1584 | -3112 | -2598 | -102 | -3126 | -813 | 4345 | -2996 | -3316 | -2834 | -3037 | -2326 | 1195 | 1340 | -2475 | -2167 | 77 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9480 | | | | | | | | | | | | |
| 78(I) | -2541 | -2130 | -4989 | -4447 | 1768 | -4503 | -3473 | 2245 | -4181 | 1829 | -210 | -4162 | -4181 | -3554 | -3947 | -3708 | -2469 | 1402 | -2759 | -2626 | 78 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9478 | | | | | | | | | | | | |
| 79(Y) | -4613 | -3570 | -5027 | -5365 | 3096 | -4900 | -1135 | -3496 | -4928 | -2818 | -2908 | -3544 | -4767 | -3678 | -4307 | -4162 | -4473 | -3660 | -383 | 4168 | 79 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9476 | | | | | | | | | | | | |
| 80(M) | -2401 | -1938 | -4995 | -4588 | -2135 | -4683 | -4177 | 2411 | -4441 | -955 | 3356 | -4340 | -4447 | -4169 | -4437 | -3971 | -2375 | 2371 | -3610 | -3272 | 80 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9474 | | | | | | | | | | | | |
| 81(C) | -924 | 2595 | -3097 | -2552 | -1083 | 823 | -1551 | -560 | -2221 | -963 | 2359 | -2072 | -2516 | -1903 | -2136 | 739 | -963 | 2007 | -1573 | -1229 | 81 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9472 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 82(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 82 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9470 | | | | | | | | | | | | |
| 83(P) | -4497 | -4117 | -4899 | -5251 | -5560 | -4139 | -4798 | -6328 | -5454 | -5976 | -5741 | -5026 | 4302 | -5328 | -5104 | -4798 | -4484 | -5739 | -4665 | -5484 | 83 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9468 | | | | | | | | | | | | |
| 84(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 84 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9466 | | | | | | | | | | | | |
| 85(H) | -4836 | -4275 | -4356 | -4629 | -3663 | -4242 | 5422 | -5932 | -4492 | -5436 | -5298 | -4579 | -4696 | -4620 | -4352 | -5005 | -5030 | -5648 | -3750 | -3259 | 85 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9464 | | | | | | | | | | | | |
| 86(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 86 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9461 | | | | | | | | | | | | |
| 87(G) | 2125 | -1842 | -3631 | -3927 | -4350 | 3048 | -3538 | -4169 | -4033 | -4428 | -3528 | -2733 | -2876 | -3575 | -3746 | -1489 | -1707 | -2984 | -4482 | -4443 | 87 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9459 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 88(P) | -2640 | -3260 | -2127 | -2297 | -4320 | -2987 | -2661 | -4510 | -2216 | -4379 | -3792 | -2411 | 3576 | 2864 | -2373 | -2683 | -2863 | -3935 | -4069 | -3806 | 88 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9457 | | | | | | | | | | | | |
| 89(A) | 2982 | -1594 | -3754 | -3796 | -3529 | 1052 | -3162 | -2818 | -3604 | -3423 | -2664 | -2573 | -2719 | -3219 | -3468 | -1317 | -1463 | 1086 | -3887 | -3678 | 89 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9455 | | | | | | | | | | | | |
| 90(M) | -1348 | -1165 | -3573 | -2973 | 1525 | 706 | -1766 | 1561 | -2606 | -377 | 3758 | -2527 | -2921 | -2210 | -2439 | -2009 | -1294 | -310 | -1556 | -1184 | 90 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9453 | | | | | | | | | | | | |
| 91(V) | -1974 | -1692 | -4373 | -3885 | -1655 | -3760 | -3023 | 236 | -3586 | 1658 | -599 | -3493 | -3751 | -3250 | -3485 | -2959 | 1156 | 2628 | -2723 | -2419 | 91 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9451 | | | | | | | | | | | | |
| 92(S) | 1951 | -1569 | -3422 | -3255 | -3372 | 1033 | -2819 | -2999 | -3074 | -3315 | -2500 | -2366 | -2636 | -2776 | -3104 | 2094 | -1382 | 1224 | -3674 | -3414 | 92 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9449 | | | | | | | | | | | | |
| 93(N) | 1058 | -2388 | -785 | -572 | -3066 | -1969 | -1036 | -2804 | -709 | -2811 | -1947 | 2272 | 2144 | 1706 | -1182 | -1128 | -1239 | -2319 | -3013 | -2367 | 93 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9447 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 94(C) | -968 | 2761 | -3185 | -2743 | -1848 | -2096 | -2020 | -1352 | -2456 | 835 | -1054 | -2166 | -2572 | -2189 | -2458 | 2381 | 1213 | -1124 | -2305 | -1969 | 94 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9445 | | | | | | | | | | | | |
| 95(Y) | -4608 | -3570 | -5023 | -5360 | 2380 | -4895 | -1138 | -3494 | -4924 | -2817 | -2907 | -3545 | -4766 | -3679 | -4306 | -4161 | -4470 | -3658 | -386 | 4475 | 95 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9443 | | | | | | | | | | | | |
| 96(L) | -3428 | -2867 | -5794 | -5267 | -1216 | -5534 | -4333 | 1535 | -5028 | 2951 | -6 | -5264 | -4750 | -3972 | -4604 | -4907 | -3306 | -978 | -2993 | -3105 | 96 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9441 | | | | | | | | | | | | |
| 97(D) | -2629 | -4604 | 3026 | 2782 | -4770 | -2374 | -1828 | -4782 | -2235 | -4614 | -4052 | -973 | -2960 | -1523 | -3217 | -2241 | -2730 | -4225 | -4757 | -3689 | 97 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9439 | | | | | | | | | | | | |
| 98(G) | -2862 | -3768 | 1871 | -1615 | -5004 | 3370 | -2705 | -5181 | -3146 | -5060 | -4493 | -1931 | -3470 | -2488 | -3861 | -2740 | -3106 | -4452 | -4685 | -4318 | 98 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9437 | | | | | | | | | | | | |
| 99(T) | -1078 | -1695 | -3486 | -3659 | -4077 | -1954 | -3276 | -3853 | -3599 | -4130 | -3239 | -2539 | -2733 | -3255 | -3500 | 2681 | 2838 | -2756 | -4301 | -4124 | 99 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9435 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 100(Y) | -3992 | -3300 | -4836 | -4941 | 66 | -4664 | -1423 | -2456 | -4436 | 992 | -1925 | -3615 | -4579 | -3584 | -4019 | -4006 | -3913 | -2810 | -690 | 4437 | 100 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9433 | | | | | | | | | | | | |
| 101(S) | -1032 | -1663 | -3422 | -3512 | -4087 | 1390 | -3188 | -3870 | -3492 | -4107 | -3184 | -2468 | -2688 | -3124 | -3454 | 2496 | 2388 | -2740 | -4293 | -4121 | 101 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9430 | | | | | | | | | | | | |
| 102(E) | -1823 | -3131 | -875 | 2933 | -3614 | -2362 | -1174 | -3322 | -553 | -3205 | -2407 | -1048 | 1540 | -771 | 1382 | -1665 | -1779 | -2906 | -3277 | -2712 | 102 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9428 | | | | | | | | | | | | |
| 103(F) | 863 | -914 | -3349 | -2737 | 2502 | -2631 | -1388 | -298 | -2350 | 698 | -39 | -2234 | -2667 | -1962 | -2166 | -1719 | -1033 | 1141 | -1185 | 1869 | 103 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9426 | | | | | | | | | | | | |
| 104(Y) | -4352 | -3468 | -4770 | -5008 | 2112 | -4760 | -1124 | -3396 | -4660 | -2798 | -2831 | 1505 | -4661 | -3557 | -4156 | -4005 | -4236 | -3515 | -387 | 4271 | 104 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9424 | | | | | | | | | | | | |
| 105(P) | 1085 | -2001 | -3515 | -3791 | -4319 | -2231 | -3514 | -4118 | -3884 | -4378 | -3566 | -2802 | 3892 | -3541 | -3758 | -1662 | -1872 | -3068 | -4416 | -4363 | 105 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9422 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 106(N) | -1628 | -3254 | 1441 | 2076 | -3527 | -2085 | -1091 | -3331 | -913 | -3246 | -2403 | 2397 | -2414 | -688 | 1516 | -1414 | -1613 | -2859 | -3417 | -2622 | 106 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9420 | | | | | | | | | | | | |
| 107(I) | -1569 | 2626 | -3973 | -3416 | -1377 | -3324 | -2311 | 2751 | -3082 | -941 | -528 | -2965 | -3319 | -2753 | -2944 | -2457 | -1527 | 1473 | -2109 | 2078 | 107 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9418 | | | | | | | | | | | | |
| 108(T) | 908 | -1834 | -1592 | -1168 | -2951 | -1885 | -1379 | -2651 | -1086 | -2760 | -1898 | -1245 | -2295 | 1915 | -1496 | 1739 | 2152 | -2098 | -3019 | -2494 | 108 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9416 | | | | | | | | | | | | |
| 109(M) | -879 | -2216 | -787 | 1054 | 1375 | -1857 | -485 | -2215 | 1265 | -2203 | 1871 | -512 | -1943 | 1655 | 1154 | -781 | -811 | -1824 | -2400 | -1773 | 109 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9414 | | | | | | | | | | | | |
| 110(D) | -2264 | -3415 | 3677 | -1019 | -4473 | -2407 | -2124 | -4366 | -2457 | -4415 | -3784 | -1339 | -3017 | -1850 | -3214 | -2128 | 1551 | -3724 | -4492 | -3732 | 110 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9412 | | | | | | | | | | | | |
| 111(E) | -1628 | -2756 | -1092 | 2433 | -3004 | -2358 | -986 | -2615 | 1561 | 1281 | -1850 | -1034 | -2517 | -587 | -533 | -1527 | -1543 | -2348 | -2851 | -2339 | 111 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9409 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 112(E) | 800 | -2932 | 1355 | 2151 | -3219 | -1985 | -890 | -3005 | -643 | -2935 | -2058 | 1450 | -2244 | 1611 | -1220 | -1179 | -1330 | -2541 | -3109 | -2350 | 112 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9407 | | | | | | | | | | | | |
| 113(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 113 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9405 | | | | | | | | | | | | |
| 114(M) | -3599 | -3029 | -5877 | -5316 | -1121 | -5599 | -4270 | -608 | -5016 | 2422 | 4020 | -5344 | -4752 | -3899 | -4542 | -4979 | -3452 | -1416 | -2899 | -3042 | 114 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9403 | | | | | | | | | | | | |
| 115(K) | -1165 | -2535 | -1051 | -455 | -2930 | -2079 | -612 | -2618 | 1972 | -2514 | -1633 | 1596 | -2153 | 1677 | 1320 | 873 | -1075 | -2202 | -2617 | -2045 | 115 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9401 | | | | | | | | | | | | |
| 116(K) | -2618 | -3410 | -2984 | -1883 | -4230 | -3176 | -1148 | -3580 | 2782 | -3243 | -2552 | 1766 | -3140 | -725 | 2514 | -2486 | -2331 | -3326 | -3100 | -2957 | 116 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9399 | | | | | | | | | | | | |
| 117(L) | -3686 | -3083 | -5668 | -5295 | 2704 | -5391 | -3131 | -837 | -5017 | 2713 | -141 | -4846 | -4727 | -3862 | -4511 | -4763 | -3544 | -1624 | -2119 | -1439 | 117 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9397 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 118(F) | -2097 | 2719 | -4399 | -3936 | 3542 | -3704 | -2285 | 1698 | -3592 | -670 | -559 | -3345 | -3691 | -3092 | -3380 | -2887 | -2074 | -315 | -1780 | -1028 | 118 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9394 | | | | | | | | | | | | |
| 119(K) | -2616 | -3410 | -2980 | -1881 | -4228 | -3175 | -1148 | -3580 | 2804 | -3243 | -2552 | 1766 | -3139 | -724 | 2483 | -2484 | -2330 | -3325 | -3099 | -2957 | 119 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9392 | | | | | | | | | | | | |
| 120(O) | -1950 | -2899 | -2068 | -1380 | -3575 | -2688 | -1085 | -3122 | 5 | -2965 | -2212 | -1472 | -2788 | 3499 | 1706 | -1878 | 1393 | -2788 | -2974 | -2647 | 120 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9390 | | | | | | | | | | | | |
| 121(F) | -4720 | -3927 | -5139 | -5454 | 4513 | -4504 | -2520 | -3938 | -5326 | -3307 | -3429 | -4469 | -4782 | -4575 | -4818 | -4787 | -4810 | -4172 | -1812 | -736 | 121 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9388 | | | | | | | | | | | | |
| 122(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 122 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9386 | | | | | | | | | | | | |
| 123(F) | -4150 | -3318 | -4992 | -5163 | 3777 | -4801 | -1232 | -2695 | -4739 | 954 | -2105 | -3556 | -4637 | -3592 | -4183 | -4031 | -4023 | -3011 | -484 | 2534 | 123 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9384 | | | | | | | | | | | | |

TABLE 7-continued

| | | | | | | | | | | | | | | | | | | | | |
|---|---|---|---|---|---|---|---|---|---|---|---|---|---|---|---|---|---|---|---|---|
| 124(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 124 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9382 | | | | | | | | | | | | |
| 125(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 125 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9379 | | | | | | | | | | | | |
| 126(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 126 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9377 | | | | | | | | | | | | |
| 127(I) | -2878 | -2414 | -5081 | -4778 | 2015 | -4697 | -2956 | 3488 | -4533 | -580 | -695 | -4245 | -4462 | -3882 | -4297 | -4026 | -2840 | -329 | -2190 | -1350 | 127 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9375 | | | | | | | | | | | | |
| 128(P) | -1112 | -1752 | -3015 | -3242 | -4210 | 2077 | -3186 | -4033 | -3529 | -4251 | -3331 | -2415 | 3138 | -3114 | -3525 | 1101 | -1561 | -2858 | -4391 | -4208 | 128 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9373 | | | | | | | | | | | | |
| 129(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 129 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9371 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 130(H) | -4836 | -4275 | -4356 | -4629 | -3663 | -4242 | 5422 | -5932 | -4492 | -5436 | -5298 | -4579 | -4696 | -4620 | -4352 | -5005 | -5030 | -5648 | -3750 | -3259 | 130 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9369 | | | | | | | | | | | | |
| 131(M) | 726 | 2516 | -3320 | -2699 | 1540 | -2560 | -1464 | -135 | -2311 | -587 | 3158 | -2207 | -2612 | -1942 | -2131 | -1653 | -952 | 1415 | -1331 | -989 | 131 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9366 | | | | | | | | | | | | |
| 132(A) | 2437 | -1736 | -2547 | -2496 | -3668 | -1942 | -2557 | -3365 | -2590 | -3601 | -2745 | 1872 | -2625 | -2364 | -2796 | -1269 | 2286 | -2528 | -3861 | -3523 | 132 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9364 | | | | | | | | | | | | |
| 133(P) | 2199 | -1920 | -3558 | -3810 | -4266 | -2163 | -3478 | -4045 | -3859 | -4314 | -3481 | -2754 | 3455 | -3500 | -3727 | -1576 | -1785 | -2985 | -4394 | -4324 | 133 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9362 | | | | | | | | | | | | |
| 134(E) | -2302 | -4193 | 1609 | 3106 | -4369 | -2263 | -1582 | -4283 | -1777 | -4150 | -3462 | -851 | -2781 | 1870 | -2594 | -1969 | -2359 | -3762 | -4338 | -3341 | 134 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9360 | | | | | | | | | | | | |
| 135(T) | -1509 | -1748 | -4032 | -3964 | -2803 | -2637 | -3374 | -581 | -3680 | -2093 | -1801 | -3053 | -3237 | -3460 | -3596 | -1989 | 3160 | 2274 | -3655 | -3308 | 135 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9358 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 136(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 136 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9355 | | | | | | | | | | | | |
| 137(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 137 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9353 | | | | | | | | | | | | |
| 138(S) | 1402 | -1678 | -3661 | -3893 | -4185 | -1940 | -3408 | -3979 | -3851 | -4254 | -3335 | -2598 | -2733 | -3421 | -3678 | 3267 | -1525 | -2799 | -4407 | -4277 | 138 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9351 | | | | | | | | | | | | |
| 139(I) | -2917 | -2413 | -5393 | -4971 | -1597 | -5119 | -4331 | 3518 | -4766 | 1140 | -403 | -4828 | -4654 | -4126 | -4574 | -4483 | -2863 | -105 | -3287 | -3176 | 139 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9349 | | | | | | | | | | | | |
| 140(H) | -2691 | -3511 | -1351 | -1619 | -2597 | -2858 | 4977 | -4322 | -2002 | -4099 | -3606 | 1623 | -3363 | -2027 | -2266 | -2576 | -2835 | -3872 | -2991 | -2056 | 140 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9347 | | | | | | | | | | | | |
| 141(E) | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 141 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9344 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 142(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 142 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9342 | | | | | | | | | | | | |
| 143(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 143 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9340 | | | | | | | | | | | | |
| 144(E) | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 144 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9338 | | | | | | | | | | | | |
| 145(L) | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 145 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9335 | | | | | | | | | | | | |
| 146(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 146 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9335 | | | | | | | | | | | | |
| 147(Y) | -4791 | -3935 | -4914 | -5231 | -815 | -4530 | -2178 | -4537 | -5024 | -3745 | -3807 | -4206 | -4772 | -4328 | -4584 | -4677 | -4837 | -4435 | -1477 | 4857 | 147 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9331 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 148(C) | -2078 | 2882 | -3724 | -3518 | -2695 | -2001 | -2704 | -2106 | -3218 | -2589 | -1876 | -2467 | -2661 | -2861 | -3107 | 1882 | -1336 | 1253 | -3116 | -2838 | 148 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9329 | | | | | | | | | | | | |
| 149(L) | -4119 | -3542 | -5839 | -5357 | -2027 | -4767 | -4358 | -1609 | -5118 | 3293 | -979 | -5230 | -4771 | -4474 | -4724 | -5069 | -4106 | -2331 | -3412 | -3400 | 149 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9326 | | | | | | | | | | | | |
| 150(S) | 1113 | -1682 | -3645 | -3884 | -4190 | -1942 | -3410 | -3986 | -3853 | -4261 | -3343 | -2598 | -2736 | -3423 | -3680 | 3340 | -1530 | -2804 | -4411 | -4280 | 150 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9324 | | | | | | | | | | | | |
| 151(H) | -2323 | -2561 | -3097 | -3086 | -1647 | -3098 | 4888 | -2143 | -2537 | -2630 | -2333 | -2801 | -3547 | -2728 | -2559 | -2581 | -2516 | 1445 | -2255 | -1333 | 151 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9322 | | | | | | | | | | | | |
| 152(A) | 2928 | -1667 | -3720 | -3939 | -4168 | -1934 | -3412 | -3952 | -3863 | -4230 | -3311 | -2605 | -2728 | -3429 | -3681 | 2146 | -1516 | -2782 | -4394 | -4269 | 152 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9320 | | | | | | | | | | | | |
| 153(Y) | -3656 | -3073 | -4655 | -4705 | 2072 | -4415 | -1160 | -2834 | -4311 | -2480 | -2370 | -3332 | -4386 | -3385 | -3897 | -3630 | 1330 | -2897 | -449 | 4200 | 153 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9317 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 154(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 154 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9315 | | | | | | | | | | | | |
| 155(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 155 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9313 | | | | | | | | | | | | |
| 156(I) | 1599 | -1799 | -4782 | -4398 | -2369 | -4319 | -3996 | 2490 | -4241 | -1351 | -1186 | -4067 | -4263 | -4075 | -4278 | -3599 | -2201 | 2395 | -3673 | -3229 | 156 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9311 | | | | | | | | | | | | |
| 157(F) | -3470 | -2920 | -5747 | -5177 | 3140 | -5423 | -3794 | -632 | -4917 | 2061 | 2648 | -5046 | -4645 | -3788 | -4437 | -4711 | -3319 | -1432 | -2615 | -2450 | 157 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9308 | | | | | | | | | | | | |
| 158(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 158 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9306 | | | | | | | | | | | | |
| 159(N) | -2152 | -3226 | -1659 | -1246 | -3822 | -2724 | -1126 | -3401 | -63 | -3176 | -2432 | 3327 | -2852 | 1866 | 1828 | -2010 | -2006 | -3064 | -3127 | -2771 | 159 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9304 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 160(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 160 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9301 | | | | | | | | | | | | |
| 161(D) | -2185 | -4023 | 2971 | 1468 | -4227 | -2230 | -1509 | -4119 | -1656 | -4000 | -3274 | 1608 | -2722 | -1160 | -2448 | 972 | -2231 | -3604 | -4191 | -3227 | 161 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9299 | | | | | | | | | | | | |
| 162(L) | -3047 | -2911 | -3749 | -3527 | -1475 | -4117 | -2954 | -1124 | -2671 | 2926 | -473 | -3500 | -4084 | 1801 | -2645 | -3601 | -3002 | -1759 | -2782 | -2505 | 162 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9297 | | | | | | | | | | | | |
| 163(I) | -2388 | -1937 | -4948 | -4533 | 1635 | -4599 | -3887 | 3268 | -4365 | -905 | -875 | -4243 | -4379 | -4047 | -4325 | -3869 | -2360 | 1592 | -3319 | -2869 | 163 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9295 | | | | | | | | | | | | |
| 164(V) | 1092 | -1556 | -3968 | -3774 | -2577 | -2468 | -3041 | -599 | -3503 | -2045 | -1609 | -2850 | -3046 | -3196 | -3407 | -1780 | 1216 | 3071 | -3285 | -2961 | 164 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9292 | | | | | | | | | | | | |
| 165(F) | 1547 | -939 | -2765 | -2207 | 1594 | -2286 | -1398 | -514 | -1927 | -906 | -256 | -1896 | 1121 | -1657 | -1937 | -1398 | 1348 | 1100 | -1513 | -1155 | 165 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9290 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 166(C) | 1272 | 5052 | -4189 | -4423 | -4093 | 1091 | -3532 | -3812 | -4117 | -4134 | -3233 | -2716 | -2738 | -3626 | -3808 | -1304 | -1508 | -2711 | -4345 | -4265 | 166 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9288 | | | | | | | | | | | | |
| 167(V) | -2483 | -1992 | -5115 | -4742 | -2252 | -4880 | -4534 | 1808 | -4643 | 723 | -1005 | -4536 | -4599 | -4405 | -4684 | -4208 | -2462 | 3131 | -3865 | -3512 | 167 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9285 | | | | | | | | | | | | |
| 168(V) | 699 | -1835 | -4861 | -4496 | -2442 | -4434 | -4193 | 1822 | -4360 | -1374 | -1231 | -4183 | -4356 | -4220 | -4421 | -3732 | -2257 | 3136 | -3831 | -3371 | 168 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9283 | | | | | | | | | | | | |
| 169(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 169 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9281 | | | | | | | | | | | | |
| 170(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 170 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9278 | | | | | | | | | | | | |
| 171(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 171 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9276 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 172(E) | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 172 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9274 | | | | | | | | | | | | |
| 173(A) | 3289 | -1671 | -3729 | -3971 | -4173 | -1939 | -3433 | -3954 | -3901 | -4239 | -3324 | -2617 | -2734 | -3460 | -3704 | 1119 | -1523 | -2786 | -4402 | -4279 | 173 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9271 | | | | | | | | | | | | |
| 174(E) | -4205 | -4417 | -2343 | 3901 | -5349 | -3698 | -3534 | -4837 | -3838 | -5561 | -5237 | -3039 | -4218 | -3453 | -4201 | -4072 | -4352 | -5409 | -4640 | -4860 | 174 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9269 | | | | | | | | | | | | |
| 175(T) | -2430 | -2823 | -4179 | -4462 | -4591 | -3027 | -4037 | -4454 | -4406 | -4707 | -4191 | -3664 | -3724 | -4237 | -4215 | -2689 | 4010 | -3747 | -4431 | -4588 | 175 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9267 | | | | | | | | | | | | |
| 176(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 176 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9264 | | | | | | | | | | | | |
| 177(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 177 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9262 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 178(L) | -2381 | -2370 | -4412 | -4172 | -1521 | -3608 | -3357 | -845 | -3741 | 2871 | -437 | -3695 | -3832 | -3365 | -3575 | -2971 | 1469 | -1264 | -2889 | -2744 | 178 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9260 | | | | | | | | | | | | |
| 179(A) | 3191 | -1777 | -3712 | -3682 | -2796 | -2273 | -3050 | -2040 | -3349 | -2216 | 2634 | -2731 | -2945 | -3125 | -3255 | -1630 | -1688 | -1822 | -3467 | -3179 | 179 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9257 | | | | | | | | | | | | |
| 180(T) | 1105 | -1691 | -3751 | -3950 | -4036 | -1980 | -3391 | -3579 | -3788 | -4004 | -3179 | -2639 | -2764 | -3418 | -3611 | -1351 | 3649 | -2631 | -4299 | -4165 | 180 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9255 | | | | | | | | | | | | |
| 181(S) | 1115 | -1654 | -3622 | -3791 | -4192 | 1188 | -3347 | -3991 | -3762 | -4236 | -3295 | -2550 | -2702 | -3327 | -3634 | 3032 | -1489 | -2786 | -4402 | -4277 | 181 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9253 | | | | | | | | | | | | |
| 182( ) | -5598 | -4432 | -5385 | -5722 | -3380 | -4524 | -4140 | -5941 | -5643 | -5318 | -5354 | -5427 | -4938 | -5474 | -5178 | -5909 | -5751 | -5890 | 6275 | -2993 | 182 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9250 | | | | | | | | | | | | |
| 183(H) | -2817 | -3584 | -1743 | -1758 | -2728 | -3054 | 4625 | -4009 | -1063 | -3728 | -3189 | -1926 | -3378 | 2752 | -1170 | -2680 | -2782 | -3708 | -2912 | -2121 | 183 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9248 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 184(S) | 2113 | -1671 | -3691 | -3909 | -4175 | -1935 | -3404 | -3963 | -3845 | -4238 | -3318 | -2599 | -2728 | -3415 | -3673 | 2974 | -1518 | -2788 | -4398 | -4270 | 184 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9246 | | | | | | | | | | | | |
| 185(N) | -1667 | -2295 | -1303 | -1206 | -1708 | -2454 | 2688 | 1228 | -1127 | -2276 | -1659 | 3307 | -2730 | -1191 | -1399 | -1726 | -1677 | -1853 | -2144 | -1341 | 185 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9243 | | | | | | | | | | | | |
| 186(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 186 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9241 | | | | | | | | | | | | |
| 187(F) | -3793 | -3163 | -5295 | -5191 | 4063 | -5003 | -2160 | -1329 | -4845 | 1075 | -704 | -4205 | -4663 | -3781 | -4356 | -4376 | -3689 | -1985 | -1339 | -323 | 187 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9238 | | | | | | | | | | | | |
| 188(I) | -2691 | -2201 | -5254 | -4813 | -1747 | -4966 | -4275 | 2399 | -4658 | 2193 | -527 | -4632 | -4563 | -4118 | -4528 | -4270 | -2643 | 1553 | -3385 | -3255 | 188 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9236 | | | | | | | | | | | | |
| 189(N) | -2608 | -4311 | 1902 | -698 | -4665 | -2423 | -1924 | -4776 | -2319 | -4628 | -4060 | 3855 | -3013 | -1633 | -3242 | -2275 | -2738 | -4189 | -4662 | -3683 | 189 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9234 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 190(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 190 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9231 | | | | | | | | | | | | |
| 191(A) | 1597 | -1385 | -1621 | -1030 | -1453 | -2189 | -892 | 994 | 1158 | -1265 | -571 | -1153 | -2261 | -699 | 1188 | -1186 | -908 | 900 | -1781 | -1350 | 191 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9229 | | | | | | | | | | | | |
| 192(R) | -1138 | -2535 | -738 | 1346 | -2893 | -1985 | -675 | -2612 | -163 | -2551 | -1669 | 1495 | -2128 | -235 | 2008 | -1012 | 1851 | -2189 | -2703 | -2067 | 192 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9226 | | | | | | | | | | | | |
| 193(D) | -2243 | -3522 | 3665 | -856 | -4525 | -2330 | -2015 | -4560 | -2391 | -4501 | -3857 | -1194 | -2947 | -1733 | -3224 | 1260 | -2461 | -3845 | -4571 | -3690 | 193 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9224 | | | | | | | | | | | | |
| 194(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 194 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9222 | | | | | | | | | | | | |
| 195(A) | 3150 | -1781 | -3954 | -3897 | -2697 | -2590 | -3290 | 1498 | -3639 | -1978 | -1734 | -3003 | -3197 | -3386 | -3549 | -1945 | -1810 | -689 | -3544 | -3207 | 195 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9219 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 196(V) | -2448 | -1959 | -5109 | -4794 | -2563 | -4877 | -4851 | 1886 | -4730 | -1341 | -1284 | -4579 | -4666 | -4653 | -4865 | -4248 | -2447 | 3388 | -4252 | -3753 | 196 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9217 | | | | | | | | | | | | |
| 197(L) | -3405 | -2846 | -5779 | -5255 | -1228 | -5518 | -4333 | 1719 | -5019 | 2902 | -18 | -5245 | -4745 | -3976 | -4603 | -4888 | -3285 | -936 | -3002 | -3110 | 197 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9214 | | | | | | | | | | | | |
| 198(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 198 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9212 | | | | | | | | | | | | |
| 199(I) | -2459 | -1963 | -5126 | -4808 | -2568 | -4914 | -4889 | 3247 | -4751 | -1338 | -1283 | -4603 | -4685 | -4676 | -4891 | -4286 | -2455 | 2426 | -4274 | -3777 | 199 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9209 | | | | | | | | | | | | |
| 200(L) | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 200 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9207 | | | | | | | | | | | | |
| 201(H) | -2395 | -4306 | 1759 | 1612 | -4428 | -2292 | 4419 | -4404 | -1894 | -4265 | -3611 | -881 | -2831 | -1320 | -2741 | -2046 | -2464 | -3880 | -4428 | -3405 | 201 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9205 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 202(L) | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 202 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9202 | | | | | | | | | | | | |
| 203(N) | -3642 | -3838 | -3004 | -3356 | -4743 | -3612 | -3773 | -5643 | -4099 | -5460 | -5060 | 4378 | -4185 | -3865 | -4225 | -3744 | -3950 | -5002 | -4391 | -4381 | 203 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9200 | | | | | | | | | | | | |
| 204(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -4461 | 204 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9197 | | | | | | | | | | | | |
| 205(Y) | -4606 | -3570 | -5022 | -5359 | 2254 | -4894 | -1139 | -3493 | -4923 | -2816 | -2906 | -3546 | -1765 | -3679 | -4305 | -4161 | -4469 | -3657 | -387 | 4510 | 205 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9195 | | | | | | | | | | | | |
| 206(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 206 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9192 | | | | | | | | | | | | |
| 207(I) | -3202 | -2787 | -5004 | -4996 | -2836 | -4384 | -4440 | 3937 | -4838 | -1815 | -1871 | -4704 | -4600 | -4683 | -4704 | -4353 | -3280 | -603 | -3938 | -3661 | 207 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9190 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 208(S) | 1943 | -1773 | -2482 | -2503 | -3907 | -1935 | -2647 | -3686 | -2717 | -3870 | -2975 | 1555 | -2640 | -2445 | -2934 | 2632 | -1475 | -2699 | -4064 | -3728 | 208 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9187 | | | | | | | | | | | | |
| 209(N) | -2546 | -4182 | -358 | 1608 | -4553 | -2427 | -1858 | -4587 | -2065 | -4451 | -3846 | 3842 | -2989 | -1553 | -2799 | -2233 | -2653 | -4040 | -4492 | -3586 | 209 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9185 | | | | | | | | | | | | |
| 210(P) | -3075 | -3411 | -3652 | -3377 | -4713 | -3421 | -2871 | -4754 | -1885 | -4551 | -3970 | -3201 | 3874 | -2637 | 1884 | -3201 | -3246 | -4233 | -4063 | -4155 | 210 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9182 | | | | | | | | | | | | |
| 211(T) | -1093 | -1706 | -3487 | -3693 | -4074 | -1966 | -3302 | -3842 | -3638 | -4134 | -3253 | -2558 | -2748 | -3296 | -3520 | 1110 | 3646 | -2760 | -4304 | -4125 | 211 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9180 | | | | | | | | | | | | |
| 212(I) | -2500 | -2007 | -5132 | -4756 | -2220 | -4898 | -4538 | 2959 | -4657 | 869 | -973 | -4554 | -4605 | -4399 | -4689 | -4227 | -2477 | 2250 | -3844 | -3510 | 212 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9177 | | | | | | | | | | | | |
| 213(Y) | -3774 | -3094 | -5016 | -5007 | 2147 | -4760 | -1471 | -1948 | -4610 | 2513 | -1319 | -3670 | -4532 | -3545 | -4108 | -3980 | -3652 | -2427 | -717 | 2621 | 213 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9175 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 214(A) | 2561 | -1647 | -3667 | -3813 | -4167 | 1400 | -3339 | -3961 | -3748 | -4207 | -3269 | -2554 | -2698 | -3319 | -3621 | 1972 | -1482 | -2770 | -4380 | -4254 | 214 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9172 | | | | | | | | | | | | |
| 215(R) | -2761 | 3372 | -4411 | -3701 | -4318 | -3291 | -2762 | -4186 | -1690 | -4160 | -3592 | -3256 | -3742 | -2538 | 3812 | -2949 | -2961 | -3734 | -3870 | -3866 | 215 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9170 | | | | | | | | | | | | |
| 216(I) | -1976 | -1690 | -4334 | -3831 | -1599 | -3763 | -2958 | 3100 | -3513 | -670 | 2664 | -3459 | -3733 | -3184 | -3413 | -2951 | 1215 | 192 | -2661 | -2363 | 216 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9167 | | | | | | | | | | | | |
| 217(S) | -1740 | -2857 | 1757 | -890 | -4083 | -2148 | -1822 | -3944 | -1950 | -3947 | -3166 | -1164 | 2282 | -1503 | -2599 | 2462 | -1955 | -3236 | -4123 | -3368 | 217 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9165 | | | | | | | | | | | | |
| 218(D) | -1796 | -3465 | 2956 | 1278 | -3721 | -2140 | 2354 | -3541 | 1157 | -3446 | -2631 | -742 | -2513 | -824 | -1706 | -1558 | -1793 | -3064 | -3617 | -2792 | 218 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9162 | | | | | | | | | | | | |
| 219(D) | -1468 | -2962 | 2158 | 2010 | -3256 | -2035 | -1014 | -3010 | -825 | -2993 | -2150 | -673 | -2334 | -612 | -1413 | 1100 | -1455 | 908 | -3204 | -2451 | 219 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9160 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 220(E) | -2636 | -4572 | 1783 | 3438 | -4760 | -2391 | -1842 | -4773 | -2236 | -4607 | -4040 | -996 | -2973 | -1538 | -3199 | -2254 | -2736 | -4219 | -4732 | -3692 | 220 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9157 | | | | | | | | | | | | |
| 221(L) | -3421 | -2860 | -5790 | -5264 | -1219 | -5529 | -4333 | 1589 | -5025 | 2937 | -9 | -5258 | -4748 | -3973 | -4603 | -4902 | -3300 | -965 | -2995 | -3106 | 221 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9155 | | | | | | | | | | | | |
| 222(H) | -1434 | -2670 | -1420 | 1033 | -3099 | -2316 | 2338 | -2728 | 1395 | 511 | -1776 | -966 | -2367 | -301 | 2245 | -1323 | -1317 | -2360 | -2690 | -2208 | 222 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9152 | | | | | | | | | | | | |
| 223(K) | 1469 | -2443 | 1279 | -267 | -2862 | -1879 | -707 | -2612 | 1960 | -2574 | -1677 | -575 | -2071 | -271 | -856 | 1040 | -1018 | -2154 | -2755 | -2069 | 223 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9150 | | | | | | | | | | | | |
| 224(F) | -3694 | -3088 | -5579 | -5263 | 3299 | -5296 | -2867 | -919 | -4969 | 2350 | -235 | -4680 | -4707 | -3837 | -4468 | -4661 | -3559 | -1683 | -1918 | -1128 | 224 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9147 | | | | | | | | | | | | |
| 225(F) | -4720 | -3927 | -5139 | -5263 | 4513 | -4504 | -2520 | -3938 | -5326 | -3307 | -3429 | -4469 | -4782 | -4575 | -4818 | -4787 | -4810 | -4172 | -1812 | -736 | 225 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9145 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 226(E) | 688 | -2344 | -716 | 2314 | -2761 | -1878 | -641 | -2492 | -210 | -2459 | -1564 | -580 | -2036 | -201 | 1256 | 1020 | -948 | -2051 | -2637 | -1982 | 226 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9142 | | | | | | | | | | | | |
| 227(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 227 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9140 | | | | | | | | | | | | |
| 228(Y) | -1597 | -1396 | -3573 | -3051 | 2007 | -3040 | -1283 | -840 | -2686 | 801 | 2421 | 1263 | -3058 | -2245 | -2516 | -2133 | -1532 | -823 | -882 | 2863 | 228 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9137 | | | | | | | | | | | | |
| 229(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 229 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9134 | | | | | | | | | | | | |
| 230(Y) | -4620 | -3593 | -5015 | -5337 | 280 | -4863 | -1187 | -3570 | -4864 | -2899 | -2980 | -3577 | -4762 | -3702 | -4279 | -4188 | -4490 | -3719 | 3436 | 4551 | 230 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9132 | | | | | | | | | | | | |
| 231(H) | -862 | -2311 | -632 | 1878 | -2629 | -1803 | 2148 | -2371 | 1173 | -2322 | -1409 | -442 | -1911 | -24 | -537 | 854 | 933 | -1933 | -2493 | -1820 | 231 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9129 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 232(P) | -1820 | -2216 | -3792 | -3938 | -3452 | -2669 | -3505 | -2107 | -3787 | -3057 | -2729 | -3136 | 3804 | -3614 | -3691 | -2143 | -2196 | 1506 | -3938 | -3681 | 232 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9127 | | | | | | | | | | | | |
| 233(Y) | 996 | -1294 | -2366 | -1763 | -954 | -2474 | -1131 | -841 | -1179 | 533 | -479 | -1680 | -2552 | -1243 | 1281 | -1538 | -1120 | 749 | -1438 | 3229 | 233 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9124 | | | | | | | | | | | | |
| 234(F) | -1969 | -1770 | -3543 | 966 | 3139 | -3305 | -1223 | 1499 | -2815 | -1359 | -912 | -2576 | -3319 | -2375 | -2708 | -2407 | -1903 | -1180 | -760 | 2316 | 234 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9122 | | | | | | | | | | | | |
| 235(V) | -2342 | -1893 | -4914 | -4505 | 1622 | -4568 | -3913 | 1826 | -4342 | -1030 | -963 | -4213 | -4369 | -4072 | -4326 | -3838 | -2317 | 3076 | -3397 | -2930 | 235 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9119 | | | | | | | | | | | | |
| 236(E) | 722 | -2323 | -653 | 2387 | -2684 | -1948 | -848 | -2315 | -559 | -2434 | -1603 | 1662 | -2171 | -449 | -1065 | -1048 | -1111 | 813 | -2716 | -2073 | 236 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8986 | -894 | -1115 | -701 | -1378 | -9818 | -9116 | | | | | | | | | | | | |
| 237(G) | 917 | -3198 | 1792 | -603 | -3972 | 2355 | -1545 | -3811 | -1605 | -3767 | -2983 | 1737 | -2642 | -1194 | -2291 | -1663 | -1944 | -3223 | -3965 | -3136 | 237 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1266 | -7944 | -790 | -894 | -1115 | -701 | -1378 | -9818 | -9114 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 238(D) | -1223 | -2437 | 2763 | 82 | -3208 | 2150 | -912 | -3128 | -1082 | -3109 | -2410 | -254 | -1932 | -608 | -1769 | -1060 | -1365 | -2572 | -3146 | -2456 | 238 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -649 | -1491 | -7744 | -157 | -3277 | -2587 | -263 | -9818 | -9111 | | | | | | | | | | | | |
| 239(D) | -2102 | -2902 | 3872 | -571 | -3494 | -1911 | -1556 | -3716 | -1893 | -3662 | -3195 | -920 | -2449 | -1361 | -2516 | -1915 | -2242 | -3285 | -3201 | -2890 | 240 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -23 | -6702 | -7744 | -894 | -1115 | -2587 | -263 | -9818 | -9109 | | | | | | | | | | | | |
| 240(N) | -694 | -999 | -1141 | -940 | -1064 | -1767 | -919 | 2282 | -849 | -787 | -349 | 2352 | -2038 | -817 | -1093 | -1000 | -743 | 143 | -1624 | -1073 | 241 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -23 | -6702 | -7744 | -894 | -1115 | -562 | -1632 | -9818 | -9106 | | | | | | | | | | | | |
| 241(H) | -1431 | -2871 | -230 | 2243 | -3163 | -1925 | 3560 | -3017 | -719 | -2971 | -2155 | -593 | -2261 | -564 | -1242 | 1041 | -1433 | -2572 | -3114 | -2362 | 242 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7670 | -8713 | -894 | -1115 | -1555 | -600 | -9818 | -9103 | | | | | | | | | | | | |
| 242(D) | -2381 | -4329 | 3618 | 1594 | -4505 | -2138 | -1588 | -4512 | -1982 | -4352 | -3784 | -740 | -2721 | -1283 | -2949 | -1999 | -2481 | -3960 | -4490 | -3437 | 243 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7670 | -8713 | -894 | -1115 | -345 | -2232 | -9818 | -9101 | | | | | | | | | | | | |
| 243(P) | -1293 | -1824 | -1648 | -1248 | -1123 | -2332 | 2376 | -1662 | -1068 | -1836 | -1165 | -1350 | 2605 | -1031 | -1373 | -1420 | 1364 | -1468 | -1606 | 2015 | 244 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9098 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 244(M) | 683 | -1426 | -1284 | 1643 | -1482 | -2033 | -782 | -1054 | -631 | 424 | 2181 | -936 | 1207 | -541 | -1010 | -1010 | -810 | -892 | -1806 | -1337 | 245 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9095 | | | | | | | | | | | | |
| 245(S) | 861 | -1834 | 1340 | -516 | -2191 | -1877 | -758 | -1838 | -462 | 203 | -1169 | -752 | -2056 | -387 | -921 | 1571 | 1006 | -1523 | -2319 | -1756 | 246 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9093 | | | | | | | | | | | | |
| 246(M) | -1263 | -1161 | -3038 | -2448 | -745 | -2739 | -1453 | 1314 | -2054 | -532 | 3663 | -2170 | -2762 | 1690 | -2026 | -1815 | -1199 | -464 | -1382 | 1937 | 247 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9090 | | | | | | | | | | | | |
| 247(H) | -2671 | -3516 | -1308 | -1575 | -2624 | -2837 | 4896 | -4310 | -1982 | -4092 | -3590 | 1952 | -3342 | -1994 | -2257 | -2551 | -2812 | -3859 | -3012 | -2078 | 248 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9087 | | | | | | | | | | | | |
| 248(R) | -2804 | -3490 | -3516 | -2098 | -4381 | -3320 | -1175 | -3662 | 2379 | -3289 | -2620 | -1979 | -3242 | 2620 | 2657 | -2671 | -2465 | -3437 | -3117 | -3033 | 249 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9085 | | | | | | | | | | | | |
| 249(R) | 732 | -1128 | -2794 | -2187 | -1101 | -2570 | -1459 | -356 | -1683 | 1417 | -262 | -1988 | -2651 | -1613 | 1995 | -1657 | -1104 | 1378 | -1647 | -1297 | 250 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9082 | | | | | | | | | | | | |

TABLE 7-continued

| | | | | | | | | | | | | | | | | | | | | |
|---|---|---|---|---|---|---|---|---|---|---|---|---|---|---|---|---|---|---|---|---|
| 250(M) | 923 | -1665 | -3899 | -3427 | 1737 | -3128 | -2177 | -660 | -3081 | -421 | 4324 | -2915 | -3268 | -2649 | -2926 | -2316 | -1774 | -849 | -1851 | -1321 | 251 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9079 | | | | | | | | | | | | |
| 251(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 252 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9077 | | | | | | | | | | | | |
| 252(E) | 1863 | -2261 | -1000 | 2576 | -3283 | -2007 | -1447 | -2956 | -1252 | -3072 | -2244 | -1127 | -2442 | -1087 | -1727 | -1275 | 1155 | -2422 | -3329 | -2724 | 253 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9074 | | | | | | | | | | | | |
| 253(T) | -1822 | -1611 | -4151 | -3676 | -1688 | -3491 | -2844 | 186 | -3366 | 815 | -670 | -3264 | -3577 | -3075 | -3294 | -2693 | 2637 | 2187 | -2655 | -2324 | 254 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9071 | | | | | | | | | | | | |
| 254(M) | -3494 | -2937 | -5788 | -5208 | 2737 | -5472 | -3898 | -624 | -4954 | 2288 | 2851 | -5116 | -4665 | -3807 | -4466 | -4768 | -3340 | -1435 | -2676 | -2586 | 255 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9069 | | | | | | | | | | | | |
| 255(D) | -2671 | -4634 | 3718 | 1448 | -4812 | -2395 | -1863 | -4839 | -2290 | -4667 | -4121 | -999 | -2987 | -1563 | -3285 | -2280 | -2777 | -4278 | -4793 | -3731 | 256 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9066 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 256( ) | -807 | -1865 | 984 | -295 | -2038 | -1850 | 2023 | 698 | 1219 | -1817 | -996 | -567 | -1940 | -139 | -647 | -780 | 1016 | -1409 | 2991 | -1556 | 257 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9063 | | | | | | | | | | | | |
| 257(C) | 2301 | 2673 | -4116 | -3625 | -1761 | -3338 | -2704 | 1666 | -3330 | -1177 | -798 | -3141 | -3451 | -3036 | -3235 | -2529 | -1663 | 1516 | -2564 | -2191 | 258 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9069 | | | | | | | | | | | | |
| 258(F) | -1716 | -1417 | -4136 | -3595 | 2444 | -3534 | -2588 | 1707 | -3287 | -928 | -598 | -3178 | -3504 | -2965 | -3167 | -2682 | 1032 | 2265 | -2368 | -1993 | 259 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9058 | | | | | | | | | | | | |
| 259(E) | -2313 | -4187 | 2435 | 2792 | -4402 | -2263 | -1610 | -4323 | -1844 | -4194 | -3514 | -860 | -2792 | -1276 | -2693 | 882 | -2382 | -3790 | -4388 | -3377 | 260 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9055 | | | | | | | | | | | | |
| 260(E) | -1939 | -3595 | 1643 | 2581 | -3872 | -2212 | -1304 | -3690 | -1146 | -3580 | -2792 | -818 | -2607 | -925 | 2340 | -1689 | -1941 | -3216 | -3731 | -2921 | 261 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9053 | | | | | | | | | | | | |
| 261(I) | -3202 | -2787 | 5004 | -4996 | -2836 | -4384 | -4440 | 3937 | -4838 | -1815 | -1871 | -4704 | -4600 | -4683 | -4704 | -4353 | -3280 | -603 | -3938 | -3661 | 262 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9050 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 262(H) | -1017 | 2728 | -2493 | -1992 | -1270 | -2240 | 3922 | -987 | -1659 | 529 | -639 | -1791 | -2500 | -1540 | -1744 | 784 | -1071 | -839 | -1737 | -1261 | 263 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9047 | | | | | | | | | | | | |
| 263(O) | 741 | -3277 | 2434 | -357 | -3577 | -2095 | -1155 | -3386 | -1029 | -3313 | -2481 | 1522 | -2449 | 2598 | -1654 | -1458 | -1671 | -2910 | -3496 | -2688 | 264 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9044 | | | | | | | | | | | | |
| 264(I) | -3202 | -2787 | -5004 | -4996 | -2836 | -4384 | -4440 | 3937 | -4838 | -1815 | -1871 | -4704 | -4600 | -4683 | -4704 | -4353 | -3280 | -603 | -3938 | -3661 | 265 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9042 | | | | | | | | | | | | |
| 265(O) | -2715 | -3506 | -2454 | -1838 | -4264 | -3140 | -1326 | -3747 | 2319 | -3422 | -2758 | -1861 | -3215 | 3713 | -73 | -2577 | -2482 | -3480 | -3261 | -3082 | 266 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9039 | | | | | | | | | | | | |
| 266(H) | 766 | -2665 | -1250 | -679 | -3083 | -2257 | 3314 | -2378 | 2115 | -2633 | -1790 | -913 | -2340 | 1628 | -214 | -1286 | -129 | -2357 | -2720 | -2207 | 267 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9039 | | | | | | | | | | | | |
| 267(A) | 1483 | -2554 | 1329 | 1148 | -2853 | -1866 | -632 | -2614 | -278 | -2555 | -1651 | 1353 | -2033 | -189 | 1407 | -900 | -994 | -2162 | -2727 | -2019 | 268 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7944 | -8987 | -894 | -1115 | -701 | -1378 | -9818 | -9033 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 268(A) | 3609 | -2508 | -4184 | -4493 | -4592 | -2739 | -3989 | -4421 | -4496 | -4701 | -4051 | -3440 | -3474 | -4171 | -4253 | -2294 | -2487 | -3536 | -4484 | -4643 | 269 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -149 | -500 | 233 | -894 | -1115 | -701 | -1378 | -9818 | -9031 | | | | | | | | | | | | |
| 269(R) | -2965 | -3547 | -3408 | -2282 | -4379 | -3379 | -1388 | -3839 | 12 | -3467 | -2835 | -2157 | -3384 | 1874 | 3734 | -2857 | -2671 | -3611 | -3250 | -3161 | 270 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1308 | -7945 | -761 | -894 | -1115 | -701 | -1378 | -9818 | -9028 | | | | | | | | | | | | |
| 270(N) | -1039 | -2562 | 586 | 2367 | -2858 | -1300 | -470 | -2699 | 385 | -2652 | -1895 | 2515 | -1724 | -111 | -973 | -813 | -1067 | -2247 | -2807 | -2007 | 271 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -714 | -1382 | -7703 | -151 | -3331 | -2609 | -258 | -9818 | -9025 | | | | | | | | | | | | |
| 271(N) | -622 | -1477 | -200 | -357 | -2707 | 2601 | -999 | -2606 | -952 | -2696 | -1925 | 2838 | -1767 | -722 | -1374 | -664 | -868 | -1957 | -2760 | -2210 | 273 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -24 | -6661 | -7703 | -894 | -1115 | -156 | -3286 | -9818 | -9022 | | | | | | | | | | | | |
| 272(S) | -828 | -2001 | -805 | 1032 | -2258 | -1836 | -533 | -1931 | -149 | -2007 | -1158 | -547 | -1941 | -119 | 1234 | 1440 | 1026 | 880 | -2282 | -1677 | 274 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -9020 | | | | | | | | | | | | |
| 273(N) | -1190 | -2573 | 1355 | -283 | -2861 | 654 | -809 | -2615 | -530 | -2616 | -1754 | 2375 | -2165 | -395 | -1071 | -1062 | 1012 | -2205 | -2829 | 1781 | 275 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -9017 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 274(O) | 645 | -2328 | 1160 | -107 | -2646 | 495 | -476 | -2397 | -72 | -2344 | -1425 | 1283 | -1901 | 1657 | 1361 | -730 | -798 | -1950 | -2514 | -1827 | 276 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -9014 | | | | | | | | | | | | |
| 275(M) | -816 | -2072 | 1026 | 1269 | -2307 | -1806 | -491 | 649 | -121 | -2050 | 1968 | 1387 | -1908 | -67 | -614 | -740 | 927 | -1644 | -2309 | -1678 | 277 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -9011 | | | | | | | | | | | | |
| 276(C) | 897 | 2636 | -1616 | 1312 | -2623 | 1770 | -1334 | -2281 | -1102 | -2451 | -1631 | -1244 | -2278 | -1004 | -1507 | -1024 | 1250 | -1839 | -2782 | -2281 | 278 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -242 | -7945 | -2754 | -894 | -1115 | -701 | -1378 | -9818 | -9008 | | | | | | | | | | | | |
| 277(S) | -911 | -1183 | -1682 | 1126 | -1300 | -2191 | -1054 | 1565 | -1062 | -1045 | -424 | -1278 | -2298 | -937 | -1360 | 1632 | -874 | 1229 | -1746 | -1317 | 279 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7716 | -8758 | -894 | -1115 | -374 | -2130 | -9818 | -9006 | | | | | | | | | | | | |
| 278(R) | -2689 | -3297 | -3482 | -2098 | -4001 | -3278 | -1187 | 1210 | 1825 | -3091 | -2443 | -1979 | -3214 | -777 | 3313 | -2610 | -2385 | -3099 | -3035 | -2916 | 280 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -9003 | | | | | | | | | | | | |
| 279(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 281 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -9000 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 280(R) | 778 | -2256 | -849 | 1049 | 1188 | -1910 | -526 | -2252 | 1217 | -2239 | -1363 | -569 | -1997 | -87 | 2088 | -847 | -872 | -1870 | -2431 | -1819 | 282 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8997 | | | | | | | | | | | | |
| 281( ) | -4593 | -3601 | -4995 | -5696 | 213 | -4817 | -1247 | -3585 | -4805 | -2925 | -3000 | -3610 | -4749 | -3723 | -4255 | -4202 | -4477 | -3731 | 5803 | 2567 | 283 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8994 | | | | | | | | | | | | |
| 282(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 284 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8992 | | | | | | | | | | | | |
| 283(M) | -2922 | -2503 | -5243 | -4802 | -1395 | -4799 | -3922 | 1630 | -4451 | -67 | 4721 | -4580 | -4460 | -3821 | -4212 | -4136 | -2877 | -524 | -2992 | -2887 | 285 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8989 | | | | | | | | | | | | |
| 284(I) | -2495 | -2001 | -5129 | -4756 | -2240 | -4897 | -4552 | 2929 | -4659 | 812 | -991 | -4553 | -4608 | -4412 | -4697 | -4228 | -2473 | 2322 | -3865 | -3522 | 286 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8986 | | | | | | | | | | | | |
| 285(I) | -2456 | -1959 | -5125 | -4808 | -2579 | -4919 | -4900 | 3028 | -4754 | -1349 | -1292 | -4605 | -4688 | -4684 | -4898 | -4291 | -2452 | 2714 | -4288 | -3786 | 287 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8983 | | | | | | | | | | | | |

TABLE 7-continued

| | | | | | | | | | | | | | | | | | | | | |
|---|---|---|---|---|---|---|---|---|---|---|---|---|---|---|---|---|---|---|---|---|
| 286(M) | 848 | -1916 | -4474 | -3859 | 1726 | -3859 | -2665 | -466 | -3512 | 2254 | 2464 | -3496 | -3662 | -2906 | -3258 | -2991 | -2116 | -895 | -2138 | -1962 | 288 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8980 | | | | | | | | | | | | |
| 287(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 289 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8977 | | | | | | | | | | | | |
| 288(T) | -1068 | -1511 | -3017 | -2766 | -2440 | -2076 | -2321 | -1926 | -2515 | 691 | -1630 | -2213 | -2655 | -2340 | -2580 | 984 | 3190 | -1612 | -2890 | -2538 | 290 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8974 | | | | | | | | | | | | |
| 289(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 291 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8972 | | | | | | | | | | | | |
| 290(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 292 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8969 | | | | | | | | | | | | |
| 291(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 293 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8966 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 292( ) | -3761 | -3778 | -4018 | -3442 | -2596 | -3886 | -2358 | -4281 | 1706 | -3948 | -3562 | -3262 | -4095 | -2403 | -1546 | -3781 | -3651 | -4139 | 5825 | -2093 | 294 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8963 | | | | | | | | | | | | |
| 293(T) | -1328 | -1922 | -3470 | -3773 | -4307 | 2277 | -3460 | -4117 | -3841 | -4377 | -3512 | -2726 | -2930 | -3472 | -3723 | -1571 | 3260 | -3014 | -4415 | -4352 | 295 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8960 | | | | | | | | | | | | |
| 294(C) | -1973 | 4291 | -4548 | -4851 | -4702 | 3097 | -4084 | -4671 | -4689 | -4886 | -4115 | -3509 | -3445 | -4310 | -4354 | -2238 | -2433 | -3616 | -4524 | -4782 | 296 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8957 | | | | | | | | | | | | |
| 295(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 297 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8954 | | | | | | | | | | | | |
| 296(K) | -2049 | -3206 | 1214 | -1125 | -3777 | -2660 | -1057 | -3338 | 3118 | -3117 | -2350 | -1305 | -2771 | -635 | 1683 | -1896 | -1900 | -2990 | -3089 | -2711 | 298 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8951 | | | | | | | | | | | | |
| 297(Y) | -3890 | -3319 | -4251 | 999 | 2912 | -4528 | -1135 | -3159 | -4198 | -2674 | -2627 | -3261 | -4474 | -3325 | -3891 | -3769 | -3878 | -3246 | -434 | -3896 | 299 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1892 | -7945 | -465 | -894 | -1115 | -701 | -1378 | -9818 | -8948 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 298(N) | -682 | -1389 | -43 | -192 | -1821 | -1114 | -672 | -2026 | -553 | -2169 | -1573 | 3502 | -1613 | -485 | -863 | -706 | -866 | -1616 | -1943 | -1374 | 300 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -2832 | -218 | -9818 | -8945 | | | | | | | | | | | | |
| 299(D) | -1183 | -2113 | 3476 | 202 | -2259 | -1197 | -709 | -2583 | -900 | -2640 | -2095 | -138 | -1700 | -471 | -1494 | -1021 | -1294 | -2203 | -2437 | -1969 | 301 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -2832 | -218 | -9818 | -8943 | | | | | | | | | | | | |
| 300( | -2006 | -1640 | -2485 | -2452 | 132 | -2122 | -859 | -1689 | -1966 | -1425 | -1295 | -2093 | -2439 | -1935 | -1852 | -2230 | -2075 | -1731 | 5734 | 501 | 302 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -2832 | -218 | -9818 | -8940 | | | | | | | | | | | | |
| 301(S) | 87 | -526 | -885 | -918 | -1797 | -699 | -997 | -1679 | -970 | -1948 | -1267 | -663 | -1335 | -874 | -1147 | 2826 | -252 | -1082 | -2036 | -1577 | 303 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -2832 | -218 | -9818 | -8937 | | | | | | | | | | | | |
| 302(G) | -822 | -1159 | -1384 | -1565 | -2531 | 3361 | -1634 | -2586 | -1803 | -2721 | -2161 | -1396 | -1832 | -1670 | -1866 | -1023 | -1160 | -1997 | -2255 | -2352 | 304 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -2832 | -218 | -9818 | -8934 | | | | | | | | | | | | |
| 303(P) | -1003 | -1278 | -1425 | -1532 | -2259 | -1370 | -1531 | -2247 | -1572 | -2349 | -1911 | -1434 | 3795 | -1555 | -1648 | -1199 | -1287 | -1861 | -2108 | -2096 | 305 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -2832 | -218 | -9818 | -8931 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 304(K) | -1075 | -1727 | -849 | -488 | -2222 | -1560 | -298 | -1928 | 3141 | -1906 | -1299 | -589 | -1788 | 39 | 576 | -1050 | -1018 | -1673 | -1848 | -1572 | 306 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -133 | -3510 | -9818 | -8928 | | | | | | | | | | | | |
| 305(V) | -2351 | -1948 | -4836 | -4325 | 1729 | -4359 | -3437 | 1662 | -4074 | 1144 | -429 | -4011 | -4122 | -3586 | -3910 | -3565 | -2297 | 2576 | -2861 | -2632 | 307 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8925 | | | | | | | | | | | | |
| 306(D) | -2623 | -4424 | 3671 | -647 | -4716 | -2401 | -1896 | -4807 | -2315 | -4650 | -4093 | 1964 | -2996 | -1602 | -3278 | -2267 | -2747 | -4224 | -4722 | -3696 | 308 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8922 | | | | | | | | | | | | |
| 307(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 309 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1892 | -7945 | -465 | -894 | -1115 | -701 | -1378 | -9818 | -8919 | | | | | | | | | | | | |
| 308(K) | -1075 | -1727 | -849 | -488 | -2222 | -1560 | -298 | -1928 | 3141 | -1906 | -1299 | -589 | -1788 | 39 | 576 | -1050 | -1018 | -1673 | -1848 | -1572 | 310 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -2832 | -218 | -9818 | -8916 | | | | | | | | | | | | |
| 309(G) | -822 | -1159 | -1384 | -1565 | -2531 | 3361 | -1634 | -2586 | -1803 | -2721 | -2161 | -1396 | -1832 | -1670 | -1866 | -1023 | -1160 | -1997 | -2255 | -2352 | 311 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -35 | -6088 | -7130 | -894 | -1115 | -133 | -3510 | -9818 | -8913 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 310(M) | -972 | -1126 | -2062 | -1461 | -1092 | -2307 | 2087 | -624 | 1939 | 525 | 2294 | -1457 | -2364 | -1036 | -1244 | -1332 | -906 | 985 | -1529 | -1141 | 312 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8910 | | | | | | | | | | | | |
| 311(K) | -1820 | -2479 | -2019 | -1558 | 1878 | -2659 | -1288 | -2471 | 2648 | -2477 | -1862 | -1639 | 2280 | -1101 | -838 | -1862 | -1798 | -2256 | -2259 | -1515 | 313 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8907 | | | | | | | | | | | | |
| 312(T) | -1151 | -994 | -3207 | -2614 | -1014 | -2726 | -1631 | 1486 | -2292 | 872 | -195 | 1131 | -2765 | -1900 | -2222 | -1813 | 1899 | 1286 | -1587 | -1232 | 314 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8904 | | | | | | | | | | | | |
| 313(E) | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 315 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8901 | | | | | | | | | | | | |
| 314(G) | -2817 | -3261 | -2719 | -3002 | -3965 | 3464 | 2847 | -5005 | -3386 | -4897 | -4328 | -2988 | -3770 | -3306 | -3516 | -2944 | -3148 | -4263 | -3982 | -3566 | 316 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8898 | | | | | | | | | | | | |
| 315(F) | -1106 | -1561 | -3154 | -2946 | 2579 | -2093 | -2290 | -2229 | -2773 | -2503 | -1842 | -2289 | -2698 | -2501 | -2812 | 2488 | 1579 | -1836 | -2597 | -1956 | 317 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8895 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 316( | -4550 | -3570 | -5043 | -5348 | 3560 | -4834 | -1253 | -3407 | -4915 | -2729 | -2820 | -3625 | -4750 | -3739 | -4322 | -4199 | -4435 | -3608 | 4998 | 679 | 318 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8892 | | | | | | | | | | | | |
| 317(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 319 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8889 | | | | | | | | | | | | |
| 318(A) | 3015 | -1667 | -3723 | -3946 | -4169 | -1935 | -3415 | -3952 | -3869 | -4231 | -3312 | -2607 | -2729 | -3434 | -3685 | 1976 | -1516 | -2782 | -4395 | -4270 | 320 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8886 | | | | | | | | | | | | |
| 319(H) | -4836 | -4275 | -4356 | -4629 | -3663 | -4242 | 5422 | -5932 | -4492 | -5436 | -5298 | -4579 | -4696 | -4620 | -4352 | -5005 | -5030 | -5648 | -3750 | -3259 | 321 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8883 | | | | | | | | | | | | |
| 320(Q) | -4207 | -4117 | -3531 | -3731 | -4752 | -3930 | -3721 | -5554 | -3395 | -5179 | -4897 | -3823 | -4399 | 4556 | -3405 | -4301 | -4380 | -5208 | -4301 | -4384 | 322 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8880 | | | | | | | | | | | | |
| 321(V) | -2838 | -2616 | -4834 | -4880 | -3213 | -3955 | -4416 | -610 | -4757 | -2310 | -2253 | -4383 | -4345 | -4643 | -4642 | -3732 | -3007 | 3763 | -4157 | -3886 | 323 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8877 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 322(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 324 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8873 | | | | | | | | | | | | |
| 323(L) | -3647 | -3060 | -5937 | -5371 | -1118 | -5682 | -4332 | -610 | -5087 | 2996 | 2562 | -5429 | -4784 | -3924 | -4592 | -5073 | -3493 | -1434 | -2915 | -3081 | 325 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8870 | | | | | | | | | | | | |
| 324(A) | 1628 | -2000 | -1147 | -671 | -2849 | 708 | -956 | -2576 | -1413 | -2602 | -1707 | -874 | 1246 | -539 | -1044 | 862 | -977 | -2054 | -2809 | -2207 | 326 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8867 | | | | | | | | | | | | |
| 325(G) | -994 | -1140 | -2933 | -2481 | -1432 | 1651 | -1741 | -844 | -2217 | 1593 | -640 | -2068 | -2570 | -1955 | -2226 | 912 | -1096 | 1103 | -1926 | -1575 | 327 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8864 | | | | | | | | | | | | |
| 326(M) | 1630 | -1391 | 944 | -805 | -1486 | -2021 | -819 | -1063 | -696 | 342 | 2038 | -972 | -2133 | -594 | -1070 | 829 | -812 | 889 | -1808 | -1343 | 328 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8861 | | | | | | | | | | | | |
| 327(R) | 741 | -2275 | -1345 | -792 | -2855 | -2120 | 2241 | -2529 | -225 | -2528 | -1693 | -987 | -2298 | -476 | 2769 | 943 | -1193 | -2130 | -2695 | -2176 | 329 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8858 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 328(E) | -921 | -2389 | 1203 | 1772 | -2695 | -1817 | -532 | -2446 | 1276 | -2398 | -1488 | -451 | -1950 | -84 | -661 | -792 | 1210 | -2005 | -2575 | 1454 | 330 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8855 | | | | | | | | | | | | |
| 329(N) | -1665 | -3235 | 1720 | -369 | -3518 | -2098 | 2328 | -3335 | -1031 | -3275 | -2450 | 2949 | -2451 | -767 | -1649 | -1460 | 1173 | -2871 | -3460 | -2660 | 331 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8852 | | | | | | | | | | | | |
| 330(M) | -984 | -1840 | -1021 | 1102 | -2105 | -1976 | -854 | -1713 | -582 | -1892 | 2223 | -850 | 1910 | -518 | -1007 | -1020 | 1988 | -1453 | -2293 | -1758 | 332 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8849 | | | | | | | | | | | | |
| 331(A) | 2196 | -2790 | -511 | 1218 | -3438 | 973 | -1226 | 3215 | -1068 | -3198 | -2356 | 1800 | -2422 | -839 | -1642 | -1356 | -1536 | -2702 | -3401 | -2670 | 333 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8845 | | | | | | | | | | | | |
| 332(H) | -1254 | -2578 | -716 | -424 | -2897 | -2040 | 3715 | -2651 | -343 | -2622 | -1770 | 1388 | -2228 | 1875 | -752 | -1137 | 1164 | -2249 | -2782 | -2139 | 334 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8842 | | | | | | | | | | | | |
| 333(L) | -2624 | -2340 | -4474 | -2875 | 1811 | -4126 | -2401 | -789 | -3050 | 2542 | -178 | -3525 | -3908 | -2863 | 1521 | -3305 | -2528 | -1300 | -1886 | -1260 | 335 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8839 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 334(N) | -994 | -2499 | 1168 | -1208 | -2810 | -1843 | -590 | -2571 | 1159 | -2510 | -1599 | 1604 | 1101 | 1558 | -751 | -854 | -943 | -2117 | -2678 | -1972 | 336 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8836 | | | | | | | | | | | | |
| 335(Q) | -1074 | -1608 | -1378 | 1055 | -1583 | -2212 | -948 | -1034 | -735 | 1334 | -653 | -1095 | -2304 | 2285 | -1076 | -1227 | -1014 | 962 | -1974 | -1519 | 337 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8833 | | | | | | | | | | | | |
| 336(L) | -3687 | -3085 | -5735 | -5323 | 1918 | -5462 | -3361 | -783 | -5056 | 2956 | -82 | -4983 | -4746 | -3886 | -4547 | -4848 | -3542 | -1585 | -2287 | -1717 | 338 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8830 | | | | | | | | | | | | |
| 337(E) | -1470 | -2699 | -964 | 2371 | -3064 | -2232 | -901 | -2597 | 2215 | -2668 | -1868 | -905 | -2396 | -486 | -559 | -1359 | -1400 | 909 | -2856 | -2297 | 339 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8827 | | | | | | | | | | | | |
| 338(E) | 690 | -2696 | 1523 | 1869 | -2999 | 734 | -738 | -2770 | 1285 | -2707 | -1812 | -539 | -2120 | -303 | -973 | -1012 | -1128 | -2313 | -2880 | -2153 | 340 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8823 | | | | | | | | | | | | |
| 339( | -5598 | -4432 | -5385 | -5722 | -3380 | -4524 | -4140 | -5941 | -5643 | -5318 | -5354 | -5427 | -4938 | -5474 | -5178 | -5909 | -5751 | -5890 | 6275 | -2993 | 341 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8820 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 340(M) | -3596 | -3028 | -5873 | -5313 | -1121 | -5593 | -4267 | -607 | -5011 | 2392 | 4057 | -5338 | -4750 | -3897 | -4538 | -4973 | -3450 | -1415 | -2899 | -3039 | 342 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8817 | | | | | | | | | | | | |
| 341(K) | -991 | -2413 | -818 | 1144 | -2767 | -1924 | -530 | -2487 | 1895 | -2410 | -1508 | 1562 | -2015 | -77 | 1221 | -869 | 1088 | -2056 | -2547 | -1918 | 343 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8814 | | | | | | | | | | | | |
| 342(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 344 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8811 | | | | | | | | | | | | |
| 343(Y) | -4791 | -3935 | -4914 | -5231 | -815 | -4530 | -2178 | -4357 | -5024 | -3745 | -3807 | -4206 | -4772 | -4328 | -4584 | -4677 | -4837 | -4435 | -1477 | 4857 | 345 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8807 | | | | | | | | | | | | |
| 344(K) | -2113 | -3150 | -2249 | -1388 | -3797 | -2829 | -992 | -3281 | 2710 | -3026 | -2265 | 1725 | -2831 | 1860 | 1625 | -1985 | -1911 | -2964 | -2962 | -2675 | 346 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8804 | | | | | | | | | | | | |
| 345(P) | -2272 | 3432 | -4625 | -4892 | -4644 | -2928 | -4139 | -4609 | -4669 | -4819 | -4180 | -3725 | 3909 | -4404 | -4368 | -2543 | -2718 | -3748 | -4454 | -4686 | 347 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8801 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 346(E) | -2460 | -4036 | -460 | 3371 | -4348 | -2457 | -1702 | -4275 | -1584 | -4118 | -3462 | -1104 | -2946 | 2051 | -2090 | -2167 | -2503 | -3804 | -4163 | -3385 | 348 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8798 | | | | | | | | | | | | |
| 347(E) | -2181 | -3963 | 1851 | 3002 | -4213 | -2236 | -1529 | -4092 | -1674 | -3990 | -3269 | -843 | -2732 | -1182 | -2455 | -1882 | 1292 | -3581 | -4185 | -3235 | 349 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8794 | | | | | | | | | | | | |
| 348(L) | -3686 | -3084 | -5725 | -5318 | -2066 | -5451 | -3323 | -791 | -1674 | 2922 | -90 | -4961 | -4743 | -3882 | -4541 | -4834 | -3541 | -1590 | -2260 | -1671 | 350 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8791 | | | | | | | | | | | | |
| 349(F) | -3772 | -3147 | -5332 | -5198 | 4004 | -5042 | -2246 | -1256 | -4859 | 1259 | -621 | -4264 | -4667 | -3786 | -4369 | -4411 | -3663 | -1931 | -1412 | -419 | 351 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8788 | | | | | | | | | | | | |
| 350(D) | -2611 | -4416 | 3402 | -640 | -4705 | -2395 | -1885 | -4789 | -2297 | -4633 | -4071 | 2681 | -2988 | -1589 | -3255 | -2256 | -2733 | -4207 | -4711 | -3684 | 352 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8785 | | | | | | | | | | | | |
| 351(E) | 2436 | -2868 | -924 | 2744 | -4080 | -2309 | -2015 | -3815 | -2053 | -3929 | -3209 | -1413 | -2875 | -1718 | -2576 | -1853 | -2106 | -3206 | -4090 | -3471 | 353 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8781 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 352(H) | 692 | -2743 | 2175 | -223 | -3038 | -1936 | 2515 | -2810 | -480 | -2751 | -1863 | 1409 | -2154 | 1594 | -1031 | -1057 | -1179 | -2357 | -2927 | -2196 | 354 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8778 | | | | | | | | | | | | |
| 353(G) | -2929 | -3168 | -3518 | -3782 | -1975 | 3489 | -2803 | -4394 | -4019 | -4184 | -3856 | -3400 | -3940 | -3733 | -3967 | -3094 | -3258 | -3950 | -2519 | 2220 | 355 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8775 | | | | | | | | | | | | |
| 354(S) | 743 | -1505 | -1390 | -843 | -1747 | -1981 | -884 | -1345 | -674 | 588 | -830 | -999 | -2148 | -615 | 1093 | 1645 | 1025 | -1123 | -2016 | -1540 | 356 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8771 | | | | | | | | | | | | |
| 355(P) | -2511 | -2204 | -4688 | -4170 | -1213 | -4215 | -3207 | 1516 | -3824 | 2221 | -98 | -3895 | 2348 | -3271 | -3624 | -3424 | -2456 | -677 | -2586 | -2462 | 357 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8768 | | | | | | | | | | | | |
| 356(K) | -1302 | -1414 | -2419 | -1840 | -1577 | -2693 | -1530 | 1325 | 2435 | -1189 | -660 | -1855 | -2761 | -1446 | -1616 | -1749 | 1313 | 1240 | -2101 | -1697 | 358 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8765 | | | | | | | | | | | | |
| 357(E) | 687 | -2542 | -623 | 1957 | -2905 | -1944 | -710 | -2641 | 1433 | -2592 | -1707 | -604 | 1914 | -274 | -748 | -998 | -1082 | -2205 | -2761 | -2094 | 359 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8762 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 358(E) | -2040 | -3771 | 1647 | 2163 | -4056 | 1964 | -1435 | -3921 | -1508 | -3821 | -3060 | -809 | -2658 | -1075 | -2248 | 864 | -2081 | -3410 | -4011 | -3098 | 360 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8758 | | | | | | | | | | | | |
| 359(I) | -2526 | -2113 | -4983 | -4447 | 1598 | -4503 | -3494 | 2404 | -4186 | 1749 | -242 | -4162 | -4188 | -3576 | -3962 | -3711 | -2456 | 1420 | -2790 | -2649 | 361 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8755 | | | | | | | | | | | | |
| 360(R) | -1519 | -2765 | -1433 | 1043 | -3230 | -2362 | -786 | -2853 | 1407 | -2712 | -1878 | -1010 | -2424 | -346 | 2271 | -1399 | 2090 | -2477 | -2766 | -2295 | 362 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8752 | | | | | | | | | | | | |
| 361(A) | 2266 | -3817 | 1712 | 2253 | -4133 | -2221 | -1507 | -3996 | -1626 | -3910 | -3174 | -845 | -2706 | -1158 | -2386 | -1834 | -2166 | -3485 | -4107 | -3184 | 363 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8748 | | | | | | | | | | | | |
| 362(F) | -1042 | -885 | -3196 | -2582 | 2439 | -2571 | 2436 | 1238 | -2213 | 706 | 10 | -2148 | -2609 | -1856 | -2072 | -1653 | 1024 | -245 | -1243 | -832 | 364 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8745 | | | | | | | | | | | | |
| 363(M) | 2115 | -1084 | -3069 | -2501 | -1009 | -2553 | -1611 | -411 | -2186 | 950 | 2374 | -2167 | -2680 | -1891 | -2150 | -1666 | 1057 | -397 | -1620 | -1292 | 365 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8741 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 364(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 366 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8738 | | | | | | | | | | | | |
| 365(K) | -1362 | -2752 | -891 | 1110 | -3142 | -2149 | -769 | -2837 | 2560 | -2727 | -1865 | -782 | 1373 | 1618 | -441 | -1221 | -1281 | -2420 | -2829 | -2241 | 367 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8735 | | | | | | | | | | | | |
| 366(G) | 1022 | -1909 | -2732 | -2555 | -3858 | 2953 | -2403 | -3572 | -1903 | -3702 | -2863 | -2142 | -2736 | -2152 | 1711 | -1431 | -1592 | -2728 | -3841 | -3572 | 368 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8731 | | | | | | | | | | | | |
| 367(E) | -1926 | -3649 | 1536 | 2753 | -3890 | -2165 | -1327 | -3735 | -1325 | -3640 | -2851 | 1567 | -2586 | -953 | -2024 | -1665 | 1092 | -3244 | -3826 | -2947 | 369 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8728 | | | | | | | | | | | | |
| 368(K) | -2153 | -2373 | -3052 | -2232 | -1767 | -3262 | -1649 | -1215 | 3030 | 859 | 2514 | -2219 | -3217 | -1370 | -831 | -2425 | -2024 | -1487 | -2493 | -2241 | 370 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8725 | | | | | | | | | | | | |
| 369(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 371 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8721 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 370(M) | -3269 | -2747 | -5652 | -5079 | -1177 | -5325 | -4102 | 1525 | -4829 | 1255 | 4460 | -5012 | -4616 | -3829 | -4428 | -4616 | -3145 | -974 | -2895 | -3004 | 372 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8718 | | | | | | | | | | | | |
| 371(G) | 2030 | -1651 | -3665 | -3855 | -4195 | 2704 | -3377 | -3993 | -3822 | -4242 | -3302 | -2568 | -2705 | -3371 | -3670 | 1117 | -1491 | -2786 | -4410 | -4294 | 373 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8714 | | | | | | | | | | | | |
| 372(A) | 2364 | -1861 | -1953 | -1763 | -3466 | -1952 | -1976 | -3199 | -1760 | -3331 | -2471 | -1666 | -2522 | 1987 | -2080 | 1936 | -1374 | -2468 | -3555 | -3102 | 374 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8711 | | | | | | | | | | | | |
| 373(N) | -1618 | -2562 | -1583 | -1250 | -3475 | -2356 | -1296 | -3134 | -474 | -3082 | -2296 | 3378 | -2657 | -908 | 1726 | -1605 | 1129 | -2676 | -3159 | -2725 | 375 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8707 | | | | | | | | | | | | |
| 374(P) | -1913 | -2274 | -2279 | -2086 | -1517 | -2783 | 2782 | -2081 | -1589 | 560 | -1612 | -2058 | 3317 | -1785 | -1716 | -2097 | -1976 | -2000 | -2063 | -1260 | 376 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8704 | | | | | | | | | | | | |
| 375(H) | -929 | -2010 | -791 | 1272 | -2044 | -1913 | 2963 | -1853 | -298 | -1959 | -1145 | 1363 | -2029 | -239 | -766 | -888 | -872 | 799 | -2186 | 1512 | 377 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8700 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 376(A) | 2877 | -1669 | -3800 | -3976 | -4022 | -1962 | -3382 | -3596 | -3795 | -3999 | -3156 | -2631 | -2746 | -3409 | -3616 | -1328 | 2512 | -2627 | -4284 | -4151 | 378 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8697 | | | | | | | | | | | | |
| 377(N) | -3122 | -3352 | -2328 | -2577 | -596 | -3446 | -1619 | -3701 | -2981 | -3309 | -3133 | 3888 | -3831 | -2693 | -3130 | -3026 | -3247 | -3561 | -1270 | 2585 | 379 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8693 | | | | | | | | | | | | |
| 378(G) | -2018 | -2692 | -1922 | -2271 | -4544 | 3363 | -2969 | -4678 | -3249 | -4731 | -3990 | 1984 | -3232 | -2825 | -3564 | -2140 | -2400 | -3690 | -4460 | -4184 | 380 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8690 | | | | | | | | | | | | |
| 379(G) | -1257 | -1874 | -3207 | -3523 | -4341 | 3341 | -3408 | -4248 | -3853 | -4463 | -3557 | -2605 | -2866 | -3402 | -3760 | 1410 | -1718 | -3031 | -4475 | -4358 | 381 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8687 | | | | | | | | | | | | |
| 380(Y) | -1236 | -1100 | -3220 | -2594 | -757 | -2737 | -1473 | -388 | -2061 | 1865 | -99 | -2233 | -2760 | -1870 | 1132 | -1823 | -1172 | 1244 | -1376 | 2076 | 382 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8683 | | | | | | | | | | | | |
| 381(L) | -2379 | -2141 | 1254 | -3407 | -1292 | -3975 | -2923 | 1518 | -3405 | 2543 | -203 | -3359 | -3842 | -2943 | -3392 | -3194 | -2319 | -538 | -2579 | -2378 | 383 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -9818 | -8679 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 382(R) | -1224 | -1996 | -1644 | -1058 | -2408 | -2207 | -1005 | -2002 | -378 | 315 | -1393 | -1189 | 1416 | -662 | 2668 | 937 | -1215 | -1747 | -2459 | -2006 | 384 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -288 | -7945 | -2519 | -894 | -1115 | -701 | -1378 | -9818 | -8676 | | | | | | | | | | | | |
| 383(R) | -1347 | -2597 | -872 | 1389 | -3097 | -2078 | -754 | -2768 | -37 | -2671 | -1846 | -784 | -2259 | -333 | 2876 | 1137 | -1287 | -2364 | -2765 | -2230 | 385 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7671 | -8713 | -894 | -1115 | -1555 | -600 | -9818 | -8672 | | | | | | | | | | | | |
| 384(N) | -1422 | -3052 | 1734 | 1461 | -3326 | 980 | -901 | -3136 | -759 | -3056 | -2213 | 1864 | -2210 | -500 | -1385 | 1028 | -1413 | -2660 | -3236 | -2429 | 386 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7671 | -8713 | -894 | -1115 | -1555 | -2232 | -9818 | -8669 | | | | | | | | | | | | |
| 385(L) | -4119 | -3542 | -5839 | -5357 | -2027 | -4767 | -4358 | -1609 | -5118 | 3293 | -979 | -5230 | -4771 | -4474 | -4724 | -5069 | -4106 | -2331 | -3412 | -3400 | 387 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8665 | | | | | | | | | | | | |
| 386(K) | -1622 | -2790 | -1624 | 1030 | -3260 | -2461 | -828 | -2846 | 2708 | -2716 | -1905 | -1116 | -2506 | -393 | 1496 | -1511 | -1487 | 892 | -2768 | -2339 | 388 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8662 | | | | | | | | | | | | |
| 387(M) | -1888 | -1623 | -4198 | -3600 | -1092 | -3572 | -2482 | -158 | -3255 | 2140 | 2397 | -3210 | -3470 | -2776 | -3059 | -2699 | 1034 | 1479 | -2114 | -1890 | 389 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8658 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 388(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 390 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8655 | | | | | | | | | | | | |
| 389(D) | -2522 | -4504 | 3422 | 1446 | -4683 | 938 | -1750 | -4661 | -2127 | -4504 | -3910 | -909 | -2894 | -1438 | -3092 | -2147 | -2619 | -4102 | -4695 | -3603 | 391 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8651 | | | | | | | | | | | | |
| 390( ) | -3715 | -3061 | -5054 | -5000 | 2784 | -4779 | -1574 | -1778 | -4602 | 1668 | -1132 | -3738 | -4524 | -3553 | -4110 | -4005 | -3593 | -2304 | 4571 | 289 | 392 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8647 | | | | | | | | | | | | |
| 391(H) | -1137 | -2529 | 1169 | -405 | -2911 | -2042 | 2148 | -2611 | 1514 | -2512 | -1626 | -678 | -2128 | 1722 | 2034 | -1013 | -1053 | -2189 | -2623 | -2031 | 393 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8644 | | | | | | | | | | | | |
| 392(O) | -1523 | -3117 | 2166 | 1365 | -3403 | -2057 | -1004 | -3194 | 1438 | -3110 | -2253 | -667 | -2351 | 2526 | -1325 | -1325 | -1499 | -2728 | -3276 | -2509 | 394 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8640 | | | | | | | | | | | | |
| 393(Y) | -4598 | -3559 | -5006 | -5329 | 2257 | -4898 | 2594 | -3515 | -4887 | -2848 | -2926 | -3523 | -4759 | -3654 | -4280 | -4143 | -4453 | -3662 | -366 | 4237 | 395 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8637 | | | | | | | | | | | | |

TABLE 7-continued

| | | | | | | | | | | | | | | | | | | | | | |
|---|---|---|---|---|---|---|---|---|---|---|---|---|---|---|---|---|---|---|---|---|---|
| 394(A) | 2380 | -2381 | -1061 | 1282 | -3846 | 2045 | -1941 | -3614 | -1958 | -3704 | -2890 | -1385 | -2665 | -1636 | -2457 | -1509 | -1729 | -2895 | -3915 | -3319 | 396 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8633 | | | | | | | | | | | | |
| 395(V) | -2097 | -1741 | -4406 | -4026 | -2222 | -4103 | -3555 | 2399 | -3840 | -1319 | -1108 | 1444 | -4071 | -3681 | -3882 | -3349 | -2094 | -2762 | -3366 | -2920 | 397 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -1555 | -1378 | -9818 | -8629 | | | | | | | | | | | | |
| 396(D) | -928 | -2371 | 1886 | -165 | -2715 | -1822 | -563 | -2464 | 1387 | -2421 | -1512 | -478 | 1080 | -116 | -692 | 750 | 1043 | -2018 | -2599 | -1913 | 398 |
| - | * | * | * | * | * | * | * | * | * | * | * | * | * | * | * | * | * | * | * | * | |
| - | * | * | * | * | * | * | * | -9818 | 0 | | | | | | | | | | | | |

TABLE 8

HMMER2.0 [2.3.2]
NAME XFP
ACC PF03894.6
DESC D-xylulose 5-phosphate/D-fructose 6-phosphate phosphoketolase
LENG 187
ALPH Amino
RF no
CS no
MAP yes
COM hmmbuild -f -F HMM fs.ann SEED.ann
COM hmmcalibrate --seed 0 HMM fs.ann
NSEQ 6
DATE Sun Apr 29 15:58:33 2007
CKSUM 8559
GA 15.5 15.5
TC 18.2 15.7
NC 13.6 14.2
XT -8455 -4 -1000 -1000 -8455 -4 -8455 -4
NULT -4 -8455
NULE 595 -1558 85 338 -294 453 -1158 197 249 902 -1085 -142 -21 -313 45 531 201 384 -1998 -644
EVD -10.339054 0.664450

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | -222 | * | -2807 | | | | | | | | | | | | | | | | | | |
| 1(M) | -919 | -1308 | -2565 | -2222 | -1930 | -1975 | -1841 | -1394 | -1946 | -1641 | 3218 | -1876 | 1316 | -1826 | -2064 | -1219 | 2730 | -1183 | -2403 | -2047 | 1 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7717 | -8760 | -894 | -1115 | -701 | -1378 | -1222 | -8539 | | | | | | | | | | | | |
| 2(R) | 691 | -1720 | -837 | -294 | -1975 | -1756 | -501 | 573 | -144 | -1751 | -937 | 1196 | -1878 | -121 | 1881 | 951 | -681 | -1325 | -2078 | -1516 | 2 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7717 | -8760 | -894 | -1115 | -701 | -1378 | -8762 | -8535 | | | | | | | | | | | | |
| 3(V) | -885 | -1621 | -999 | 990 | -1982 | -1862 | -915 | -1514 | -733 | -1796 | -1048 | -873 | 1044 | -622 | -1147 | 858 | -916 | 2279 | -2227 | -1717 | 3 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7717 | -8760 | -894 | -1115 | -701 | -1378 | -8762 | -8531 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 4(L) | -2842 | -2379 | -5209 | -4634 | -994 | -4802 | -3633 | -174 | -4364 | 2574 | 2538 | -4478 | -4252 | -3491 | -4019 | -4045 | -2735 | 1455 | -2614 | -2661 | 4 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7717 | -8760 | -894 | -1115 | -701 | -1378 | -8762 | -8527 | | | | | | | | | | | | |
| 5(G) | -1046 | -1667 | -2864 | -3162 | 4077 | 3372 | -3114 | -3979 | -3511 | -4193 | -3299 | -2337 | -2643 | -3089 | -3461 | 1104 | -1501 | -2797 | -4216 | -4066 | 5 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7717 | -8760 | -894 | -1115 | -701 | -1378 | -8762 | -8524 | | | | | | | | | | | | |
| 6(K) | 696 | -1959 | -661 | -115 | -2242 | -1707 | -387 | -1932 | 1754 | -1971 | -1104 | -400 | -1809 | 1727 | -429 | 726 | -657 | 544 | -2214 | -1595 | 6 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7717 | -8760 | -894 | -1115 | -701 | -1378 | -8762 | -8520 | | | | | | | | | | | | |
| 7(Y) | -4363 | -3343 | -4802 | -5127 | 2939 | -4674 | -927 | -3251 | -4692 | -2586 | -2669 | -3329 | -4545 | -3458 | -4081 | -3935 | -4227 | -3413 | -177 | 4223 | 7 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7717 | -8760 | -894 | -1115 | -701 | -1378 | -8762 | -8516 | | | | | | | | | | | | |
| 8(C) | -1627 | 2687 | -3970 | -3367 | 1521 | -3283 | -2148 | -37 | -3007 | 2149 | 118 | -2930 | -3201 | -2520 | -2790 | -2405 | -1562 | 1206 | -1785 | -1498 | 8 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8512 | | | | | | | | | | | | |
| 9(R) | 737 | -2550 | 1594 | -497 | -3149 | -1980 | -968 | -2870 | -526 | -2846 | -2019 | -774 | -2281 | -570 | 3052 | -1221 | -1340 | -2417 | -3004 | -2383 | 9 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8508 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 10(D) | -2399 | -4358 | 3324 | 2308 | -4527 | -2166 | -1608 | -4527 | -1994 | -4367 | -3790 | -765 | -2746 | -1301 | -2956 | -2018 | -2496 | -3976 | -4515 | -3456 | 10 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8504 | | | | | | | | | | | | |
| 11(V) | -2284 | -1804 | -4895 | -4504 | -1990 | -4629 | -4189 | 2412 | -4382 | 1011 | -761 | -4283 | -4358 | -4111 | -4394 | -3938 | -2259 | 2686 | -3549 | -3219 | 11 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8500 | | | | | | | | | | | | |
| 12(M) | -2278 | -1867 | -4746 | -4224 | -1303 | -4284 | -3343 | 1656 | -3973 | 1240 | 3304 | -3939 | -3999 | -3423 | -3784 | -3494 | -2217 | 2073 | -2691 | -2538 | 12 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8496 | | | | | | | | | | | | |
| 13(K) | 693 | -2202 | -1423 | -749 | -2553 | -2182 | -674 | -2107 | 2480 | -2170 | -1388 | -928 | -2252 | -275 | 1432 | -1210 | -1146 | 1012 | -2378 | -1932 | 13 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8492 | | | | | | | | | | | | |
| 14(N) | -1049 | -1434 | -1773 | -1500 | -1636 | -2109 | -1397 | -1127 | -1366 | 1815 | -824 | 2287 | -2427 | -1298 | -1590 | -1307 | 1405 | -1004 | -2112 | -1674 | 14 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8488 | | | | | | | | | | | | |
| 15(N) | -3232 | -3514 | -2565 | -2905 | -4358 | -3267 | -3364 | -5192 | -3627 | -5059 | -4632 | 4348 | -3843 | -3410 | -3792 | -3319 | -3533 | -4568 | -4087 | -3976 | 15 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -867 | -7718 | -1171 | -894 | -1115 | -701 | -1378 | -8762 | -8484 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 16(E) | -1220 | -2441 | 99 | 2757 | -2966 | -1568 | -808 | -2774 | -675 | -2772 | -2036 | -363 | 2075 | -466 | -1190 | -1070 | -1278 | -2337 | -2879 | -2244 | 16 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -22 | -6873 | -7915 | -894 | -1115 | -2169 | -363 | -8762 | -8480 | | | | | | | | | | | | |
| 17(D) | -1004 | -1749 | 2891 | -305 | -2104 | -1632 | -964 | -886 | -981 | -1762 | -1266 | -575 | -2040 | -692 | -1495 | -1057 | -1089 | 1706 | -2499 | -1874 | 17 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -460 | -6873 | -1933 | -894 | -1115 | -216 | -2846 | -8762 | -8476 | | | | | | | | | | | | |
| 18(M) | 823 | -1578 | 1383 | -173 | -1837 | -1620 | -411 | -1480 | -107 | -1624 | 2041 | -425 | 938 | -38 | -569 | -595 | 1047 | -1187 | -1968 | -1402 | 18 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7493 | -8536 | -894 | -1115 | -1355 | -715 | -8762 | -8472 | | | | | | | | | | | | |
| 19(T) | -897 | -2121 | -888 | -291 | -2541 | -1825 | -413 | -2206 | 1465 | -2164 | -1310 | -532 | -1923 | 20 | 1428 | 1124 | 1894 | -1823 | -2313 | -1770 | 19 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7493 | -8536 | -894 | -1115 | -1355 | -715 | -8762 | -8468 | | | | | | | | | | | | |
| 20(N) | -867 | -2024 | -881 | -423 | -2654 | -1782 | -693 | -2361 | -230 | -2371 | -1499 | 2664 | -2000 | -273 | 1178 | 870 | 1294 | -1909 | -2569 | -1974 | 20 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8464 | | | | | | | | | | | | |
| 21(F) | -3465 | -2876 | -5057 | -4893 | 3938 | -4762 | -2035 | -1021 | -4547 | -1305 | -409 | -4001 | -4411 | -3532 | -4090 | -4106 | -3362 | -1663 | -1215 | -228 | 21 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8459 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 22(R) | -4070 | -3868 | -4406 | -3890 | -4820 | -3837 | -3026 | -5122 | -1946 | -4739 | -4314 | -3731 | -4155 | -2844 | 4177 | -4178 | -4041 | -4836 | -3949 | -4248 | 22 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8455 | | | | | | | | | | | | |
| 23(I) | -2379 | -1901 | -4955 | -4531 | -1728 | -4662 | -4059 | 2900 | -4381 | 1570 | -512 | -4321 | -4336 | -3965 | -4313 | -3959 | -2342 | 1650 | -3306 | -3087 | 23 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8451 | | | | | | | | | | | | |
| 24(F) | -2676 | -2354 | -4538 | -4394 | 3992 | -3956 | -1878 | -728 | -4074 | -869 | -929 | -3497 | -4006 | -3383 | -3780 | -3277 | -2708 | 1235 | -1189 | -154 | 24 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8447 | | | | | | | | | | | | |
| 25(G) | -1031 | -1653 | -2874 | -3165 | -4069 | 3287 | -3106 | -3964 | -3500 | -4180 | -3282 | -2329 | -2632 | -3078 | -3451 | 1430 | -1486 | -2782 | -4212 | -4060 | 25 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8443 | | | | | | | | | | | | |
| 26(P) | -4077 | -3791 | -4518 | -4858 | -5206 | -3818 | -4460 | -5898 | -5053 | -5602 | -5343 | -4628 | 4289 | -4938 | -4749 | -4364 | -4429 | -5313 | -4385 | -5119 | 26 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8439 | | | | | | | | | | | | |
| 27(D) | -3832 | -4189 | 4132 | -2236 | -5073 | -3341 | -3194 | -4633 | -3716 | -5365 | -5035 | -2584 | -3886 | -3102 | -4252 | -3662 | -4000 | -5151 | -4434 | -4544 | 27 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8435 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 28(E) | -3777 | -4125 | -1925 | 3871 | -4984 | -3355 | -3125 | -5379 | -3371 | -5156 | -4796 | -2611 | -3875 | -3007 | -3762 | -3630 | -3916 | -4960 | -4357 | -4463 | 28 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8430 | | | | | | | | | | | | |
| 29(T) | -1009 | -1466 | -1761 | -1492 | -1840 | -2028 | -1429 | -1343 | -1350 | 766 | -1045 | 1393 | -2396 | -1299 | -1587 | -1239 | 2910 | -1154 | -2256 | -1801 | 29 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8426 | | | | | | | | | | | | |
| 30(M) | 1499 | -1643 | -917 | 1243 | -1962 | -1786 | -691 | -1586 | -425 | -1763 | 2853 | -693 | -1975 | -349 | -862 | 779 | -773 | -1304 | -2139 | -1601 | 30 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8422 | | | | | | | | | | | | |
| 31(S) | -1644 | -2173 | -3321 | -3615 | -4077 | -2357 | -3411 | -4307 | -3792 | -4459 | -3725 | -2859 | -3095 | -3512 | -3692 | 3619 | -2088 | -3285 | -4091 | -3959 | 31 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8418 | | | | | | | | | | | | |
| 32(N) | -3232 | -3514 | -2565 | -2905 | -4358 | -3267 | -3364 | -5192 | -3627 | -5059 | -4632 | 4348 | -3843 | -3410 | -3792 | -3319 | -3533 | -4568 | -4087 | -3976 | 32 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8414 | | | | | | | | | | | | |
| 33(R) | -2793 | -3369 | -3662 | -2108 | -4312 | -3237 | -1071 | -3580 | 2493 | -3189 | -2545 | -1934 | -3162 | -654 | 3328 | -2667 | -2432 | -3373 | -2988 | -2947 | 33 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7718 | -8760 | -894 | -1115 | -701 | -1378 | -8762 | -8409 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 34(L) | -3410 | -2836 | -5465 | -5039 | 1728 | -5176 | -3154 | -570 | -4762 | 2953 | 115 | -4708 | -4504 | -3649 | -4284 | -4539 | -3272 | -1347 | -2103 | -1550 | 34 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8406 | | | | | | | | | | | | |
| 35(W) | -901 | -2337 | 1407 | -65 | -2541 | -1747 | 2100 | -2368 | -133 | -2334 | -1447 | 1385 | -1904 | 1561 | -644 | -770 | -849 | -1946 | 3634 | -1773 | 35 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8401 | | | | | | | | | | | | |
| 36(A) | 2155 | -3109 | 1523 | 1273 | -3479 | 1112 | -1076 | -3288 | -1004 | -3231 | -2417 | -592 | -2329 | -693 | -1651 | -1350 | -1580 | -2804 | -3429 | -2615 | 36 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8397 | | | | | | | | | | | | |
| 37(V) | 1023 | -958 | -3146 | -2600 | -1103 | -2513 | -1686 | 63 | -2290 | -801 | 2200 | -2204 | -2668 | -2000 | -2237 | -1650 | 1119 | 2408 | -1689 | -1335 | 37 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8392 | | | | | | | | | | | | |
| 38(F) | -3852 | -3057 | -4741 | -4884 | 3355 | -4537 | -1011 | -2489 | -4461 | 957 | -1921 | -3313 | -4388 | -3349 | -3926 | -3759 | -3730 | -2762 | -269 | 3290 | 38 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8388 | | | | | | | | | | | | |
| 39(E) | -2083 | -3395 | -722 | 2943 | -3878 | -2383 | -1214 | -3575 | 2285 | -3395 | -2666 | -1041 | -2696 | -830 | -750 | -1870 | -2023 | -3182 | -3392 | -2873 | 39 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8384 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 40(V) | -1086 | -1419 | -2113 | -1929 | -1724 | 796 | 2671 | -1274 | -1766 | -1761 | -1123 | -1760 | -2533 | -1690 | -1904 | -1385 | -1234 | 2825 | -2172 | -1669 | 40 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8379 | | | | | | | | | | | | |
| 41(T) | -869 | -1487 | -3137 | -3257 | -3760 | -1746 | -2945 | -3506 | -3200 | -3791 | -2920 | -2268 | -2512 | -2898 | -3156 | 2152 | 3197 | -2486 | -3990 | -3777 | 41 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8375 | | | | | | | | | | | | |
| 42(K) | -1040 | -2442 | -581 | 1137 | -2735 | -1868 | -548 | -2490 | 2386 | -2427 | -1554 | 1311 | -2012 | -114 | -440 | -908 | -975 | -2076 | -2562 | 1837 | 42 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8371 | | | | | | | | | | | | |
| 43(R) | -2795 | -3370 | -3663 | -2111 | -4313 | -3239 | -1074 | -3582 | 2384 | -3191 | -2548 | -1936 | -3164 | -657 | 3395 | -2670 | -2434 | -3375 | -2990 | -2949 | 43 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -291 | -7718 | -2514 | -894 | -1115 | -701 | -1378 | -8762 | -8366 | | | | | | | | | | | | |
| 44(O) | -1085 | -1755 | -1145 | -887 | 1733 | 985 | -888 | -1755 | -814 | -1851 | -1208 | -1026 | -2253 | 3209 | -1142 | -1159 | -1127 | -1521 | -1673 | -859 | 44 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7443 | -8485 | -894 | -1115 | -1459 | -652 | -8762 | -8362 | | | | | | | | | | | | |
| 45(W) | -4735 | -3754 | -4703 | -4993 | -2377 | -3915 | -3273 | -4870 | -4782 | -4319 | -4338 | -4620 | -4317 | -4639 | -4390 | -4998 | -4881 | -4870 | 6237 | -1984 | 45 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7443 | -8486 | -894 | -1115 | -372 | -2136 | -8762 | -8358 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 46(M) | -914 | -874 | 871 | -1922 | -783 | -2384 | -1220 | 1249 | -1670 | 662 | 3001 | -1756 | -2427 | -1420 | -1731 | -1438 | 1257 | -98 | -1343 | -990 | 46 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8353 | | | | | | | | | | | | |
| 47(M) | 641 | -2071 | -521 | 1084 | -2362 | -1649 | -321 | -2091 | 82 | -2076 | 2071 | 1285 | -1749 | 1468 | -420 | 684 | -616 | -1678 | -2276 | -1612 | 47 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8349 | | | | | | | | | | | | |
| 48(O) | -757 | -2178 | -529 | 1705 | -2487 | 519 | -368 | -2219 | 1195 | -2182 | -1278 | -340 | -1806 | 1749 | -411 | -642 | -696 | 453 | -2362 | -1699 | 48 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8344 | | | | | | | | | | | | |
| 49(Y) | -1288 | -1144 | -3267 | -2757 | -710 | -2784 | -1561 | 2546 | -2393 | -763 | -315 | -2345 | -2866 | -2105 | -2314 | -1913 | 1335 | -38 | -1365 | 2756 | 49 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8340 | | | | | | | | | | | | |
| 50(K) | -1352 | -2460 | 1542 | -473 | -2590 | -2065 | -876 | -2234 | 1932 | 1737 | -1566 | -761 | -2285 | -505 | -815 | -1266 | -1304 | -1990 | -2658 | -2071 | 50 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8335 | | | | | | | | | | | | |
| 51(P) | -1299 | -2774 | -236 | 1949 | -3178 | -1870 | -886 | -2961 | -678 | -2912 | -2058 | 1447 | 2218 | -481 | -1251 | 890 | -1302 | -2487 | -3099 | -2347 | 51 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -291 | -7718 | -2514 | -894 | -1115 | -701 | -1378 | -8762 | -8331 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 52(P) | 1084 | -2190 | -341 | 2185 | -2933 | -1688 | -929 | -2655 | -732 | -2706 | -1884 | -590 | 2271 | -556 | -1245 | -978 | -1128 | -2169 | -2938 | -2278 | 52 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7443 | -8486 | -894 | -1115 | -1459 | -652 | -8762 | -8326 | | | | | | | | | | | | |
| 53(N) | -1418 | -2809 | 2479 | -106 | -2949 | -1799 | -926 | -2766 | -883 | 578 | -2068 | 2542 | -2188 | -576 | -1502 | -1234 | -1435 | -2399 | -3048 | -2264 | 53 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -283 | -7443 | -2563 | -894 | -1115 | -1459 | -652 | -8762 | -8322 | | | | | | | | | | | | |
| 54(D) | -888 | -2124 | 2400 | 66 | -2357 | -1565 | -509 | -1956 | -285 | -2113 | -1336 | -255 | -1834 | 1955 | -808 | -781 | -871 | 1155 | -2428 | -1753 | 54 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -7180 | -8222 | -894 | -1115 | -1865 | -463 | -8762 | -8317 | | | | | | | | | | | | |
| 55(D) | -1805 | -3680 | 2903 | 2554 | -3868 | -1689 | -1066 | -3813 | -1341 | -3684 | -3041 | -289 | -2233 | -743 | -2210 | -1458 | -1880 | -3289 | -3847 | -2846 | 55 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1334 | -7180 | -753 | -894 | -1115 | -1865 | -463 | -8762 | -8313 | | | | | | | | | | | | |
| 56(G) | -515 | -887 | -1038 | -1187 | -2183 | 3187 | -1282 | -2175 | -1398 | -2342 | -1770 | -1048 | -1555 | -1281 | -1496 | -708 | -838 | -1625 | -1974 | -1993 | 56 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -41 | -5887 | -6930 | -894 | -1115 | -2652 | -250 | -8762 | -8308 | | | | | | | | | | | | |
| 57(G) | -515 | -887 | -1038 | -1187 | -2183 | 3187 | -1282 | -2175 | -1398 | -2342 | -1770 | -1048 | -1555 | -1281 | -1496 | -708 | -838 | -1625 | -1974 | -1993 | 57 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -41 | -5887 | -6930 | -894 | -1115 | -151 | -3329 | -8762 | -8304 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 58(E) | -1346 | -1562 | -1816 | 2436 | 2337 | -2525 | -1279 | -603 | -1533 | -1038 | -631 | -1602 | -2663 | -1361 | -1800 | -1658 | -1319 | 1113 | -1614 | -909 | 58 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8299 | | | | | | | | | | | | |
| 59(H) | -933 | -961 | -2242 | -1707 | -764 | -2320 | 2094 | 1132 | -1393 | 1839 | -65 | 1195 | -2382 | -1248 | -1495 | -1381 | -874 | -319 | -1292 | -847 | 59 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8295 | | | | | | | | | | | | |
| 60(M) | -1293 | -1342 | -2996 | -2500 | -1038 | -2617 | -1796 | -510 | -2162 | 890 | 3410 | -2240 | -2790 | -1938 | -2186 | 2108 | -1323 | -630 | -1840 | -1502 | 60 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8290 | | | | | | | | | | | | |
| 61(P) | 2028 | -1663 | -1726 | -1624 | -3398 | 998 | -1915 | -3145 | -1828 | -3283 | -2409 | 1487 | 2266 | -1625 | -2185 | -1038 | -1207 | -2349 | -3511 | -3060 | 61 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8285 | | | | | | | | | | | | |
| 62(D) | -752 | -2203 | 1771 | 1070 | -2520 | -1688 | -359 | -2261 | 1383 | -2210 | -1298 | -324 | -1796 | 94 | 1124 | -630 | -691 | 543 | -2379 | -1707 | 62 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -231 | -7718 | -2838 | -894 | -1115 | -701 | -1378 | -8762 | -8281 | | | | | | | | | | | | |
| 63(R) | -796 | -2105 | -516 | 1238 | -2496 | 1498 | -421 | -2206 | 49 | -2188 | -1314 | -382 | -1834 | 11 | 1567 | -698 | 1155 | -1794 | -2375 | -1748 | 63 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7504 | -8546 | -894 | -1115 | -412 | -2011 | -8762 | -8276 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 64(G) | -2419 | -2885 | -3067 | -2886 | -4406 | 3143 | -2559 | -4353 | -1679 | -4234 | -3572 | -2708 | -3407 | -2316 | 2444 | -2556 | -2650 | -3716 | -3837 | -3878 | 64 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8271 | | | | | | | | | | | | |
| 65(R) | -1920 | -2516 | -2433 | -1527 | -2802 | -2746 | -961 | 1879 | 176 | -2261 | -1647 | -1532 | -2759 | 1746 | 2935 | -1945 | -1744 | -2067 | -2537 | -2247 | 65 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8267 | | | | | | | | | | | | |
| 66(V) | -2252 | -1773 | -4891 | -4567 | -2335 | -4633 | -4538 | 1812 | -4482 | -1132 | -1073 | -4339 | -4440 | -4385 | -4597 | -3992 | -2250 | 3374 | -3973 | -3489 | 66 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8262 | | | | | | | | | | | | |
| 67(M) | -849 | -923 | 1670 | -1529 | -893 | -2248 | -1067 | -233 | -1327 | 600 | 2147 | -1485 | -2308 | -1135 | -1498 | -1282 | 1243 | 1140 | -1394 | -1015 | 67 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8257 | | | | | | | | | | | | |
| 68(E) | -1776 | -3015 | -373 | 3097 | -3872 | -2071 | -1546 | -3755 | -1570 | -3731 | -2992 | -934 | -2595 | -1219 | -2164 | 1764 | -1926 | -3163 | -3855 | -3091 | 68 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8253 | | | | | | | | | | | | |
| 69(M) | -1335 | -1165 | -3272 | -2688 | -1002 | -2941 | -1834 | 1451 | -2360 | -376 | 3121 | -2427 | -2930 | 2286 | -2331 | -2034 | -1279 | 1529 | -1766 | -1445 | 69 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8248 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 70(L) | -3777 | -3243 | -5089 | -5032 | -1735 | -4514 | -4040 | -1299 | -4754 | 3261 | -696 | -4891 | -4508 | -4152 | -4395 | -4705 | -3767 | -1993 | -3125 | -3069 | 70 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8243 | | | | | | | | | | | | |
| 71(S) | -1644 | -2173 | -3321 | -3615 | -4077 | -2357 | -3411 | -4307 | -3792 | -4459 | -3725 | -2859 | -3095 | -3512 | -3692 | 3619 | -2088 | -3285 | -4091 | -3959 | 71 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8238 | | | | | | | | | | | | |
| 72(E) | -3777 | -4125 | -1925 | 3871 | -4984 | -3355 | -3125 | -5379 | -3371 | -5156 | -4796 | -2611 | -3875 | -3007 | -3762 | -3630 | -3916 | -4960 | -4357 | -4463 | 72 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8234 | | | | | | | | | | | | |
| 73(H) | -4406 | -3961 | -3921 | -4171 | -3231 | -3926 | 5401 | -5468 | -3992 | -5013 | -4849 | -4130 | -4378 | -4151 | -3893 | -4548 | -4592 | -5195 | -3383 | -2818 | 73 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8229 | | | | | | | | | | | | |
| 74(O) | -1172 | -1561 | -1803 | -1343 | -1477 | -2292 | -1190 | -991 | -908 | 1463 | -565 | -1415 | -2454 | 2378 | -1119 | -1403 | 1904 | -979 | -1998 | -1592 | 74 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8760 | -894 | -1115 | -701 | -1378 | -8762 | -8224 | | | | | | | | | | | | |
| 75(C) | 943 | 4854 | -3669 | -3391 | -1886 | -2164 | -2449 | -992 | -3000 | 676 | -1025 | -2492 | -2705 | -2686 | -2861 | -1458 | -1303 | -805 | -2559 | -2442 | 75 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8761 | -894 | -1115 | -701 | -1378 | -8762 | -8219 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 76(E) | -2096 | -3637 | -282 | 2979 | -3947 | -2215 | -1377 | -3824 | -1173 | -3688 | -2987 | -859 | -2659 | 2792 | -1646 | -1832 | -2117 | -3370 | -3761 | -3011 | 76 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8761 | -894 | -1115 | -701 | -1378 | -8762 | -8214 | | | | | | | | | | | | |
| 77(G) | -3681 | -3593 | -4389 | -4747 | -5281 | 3812 | -4419 | -5908 | -5071 | -5671 | -5288 | -4417 | -4223 | -4850 | -4766 | -3952 | -4069 | -5125 | -4424 | -5214 | 77 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8761 | -894 | -1115 | -701 | -1378 | -8762 | -8209 | | | | | | | | | | | | |
| 78(W) | -4254 | -3318 | -4804 | -5081 | 3098 | -4588 | -1050 | -3111 | -4645 | -2453 | -2534 | -3403 | -4509 | -3506 | -4073 | -3950 | -4146 | -3314 | 5352 | 877 | 78 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8761 | -894 | -1115 | -701 | -1378 | -8762 | -8205 | | | | | | | | | | | | |
| 79(L) | -3375 | -2814 | -5645 | -5079 | -928 | -5372 | -4042 | -409 | -4777 | 2894 | 2856 | -5098 | -4540 | -3683 | -4317 | -4734 | -3229 | -1208 | -2698 | -2837 | 79 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8761 | -894 | -1115 | -701 | -1378 | -8762 | -8200 | | | | | | | | | | | | |
| 80(E) | -2150 | -3708 | -263 | 3290 | -4011 | -2224 | -1421 | -3906 | -1260 | -3766 | -3081 | -868 | -2687 | 2032 | -1753 | -1875 | -2180 | -3447 | -3837 | -3070 | 80 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8761 | -894 | -1115 | -701 | -1378 | -8762 | -8195 | | | | | | | | | | | | |
| 81(G) | 2022 | -1618 | -3291 | -3557 | -4069 | 3053 | -3239 | -3867 | -3682 | -4133 | -3245 | -2462 | -2643 | -3254 | -3542 | -1260 | -1474 | -2727 | -4214 | -4140 | 81 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7718 | -8761 | -894 | -1115 | -701 | -1378 | -8762 | -8190 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 82(Y) | -444 | -3646 | -4593 | -4892 | -509 | -4268 | -1873 | -3993 | -4663 | -3407 | -3460 | -3884 | -4503 | -3998 | -4255 | -4336 | -4491 | -4072 | -1177 | 4829 | 82 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8185 | | | | | | | | | | | | |
| 83(L) | -1931 | -1973 | -3870 | -3595 | -1374 | -3144 | -2842 | -646 | -3171 | 2519 | -338 | -3150 | -3415 | -2899 | -3072 | -2469 | 2215 | -950 | -2583 | -2364 | 83 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8180 | | | | | | | | | | | | |
| 84(L) | -3777 | -3243 | -5089 | -5032 | -1735 | -4514 | -4040 | -1299 | -4754 | 3261 | -696 | -4891 | -4508 | -4152 | -4395 | -4705 | -3767 | -1993 | -3125 | -3069 | 84 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8175 | | | | | | | | | | | | |
| 85(T) | -2081 | -2497 | -3792 | -4048 | -4206 | -2712 | -3671 | -3972 | -3974 | -4274 | -3765 | -3291 | -3408 | -3829 | -3824 | -2338 | 3976 | -3321 | -4129 | -4203 | 85 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8170 | | | | | | | | | | | | |
| 86(G) | -3681 | -3593 | -4389 | -4747 | -5281 | 3812 | -4419 | -5908 | -5071 | -5671 | -5288 | -4417 | -4223 | -4850 | -4766 | -3952 | -4069 | -5125 | -4424 | -5214 | 86 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8165 | | | | | | | | | | | | |
| 87(R) | -4070 | -3868 | -4406 | -3890 | -4820 | -3837 | -3026 | -5122 | -1946 | -4739 | -4314 | -3731 | -4155 | -2844 | 4177 | -4178 | -4041 | -4836 | -3949 | -4248 | 87 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8160 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 88(H) | -1602 | -2202 | -2033 | -2051 | -2524 | -2310 | 4500 | -3130 | -1754 | -3221 | -2593 | -1952 | -2860 | -1941 | -1889 | -1744 | 2351 | -2641 | -2857 | -2142 | 88 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8155 | | | | | | | | | | | | |
| 89(G) | 1424 | -1648 | -3527 | -3538 | -4097 | 3299 | -3253 | -3902 | -3697 | -4166 | -3283 | -2476 | -2666 | -3269 | -3560 | -1290 | -1506 | -2760 | -4228 | -4161 | 89 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8150 | | | | | | | | | | | | |
| 90(F) | 653 | -1307 | -3869 | -3274 | 2383 | -3222 | -2101 | 2307 | -2923 | 979 | 54 | -2851 | -3158 | -2477 | -2735 | -2341 | -1496 | -62 | -1785 | -1478 | 90 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8145 | | | | | | | | | | | | |
| 91(F) | -4268 | -3318 | -4807 | -5092 | 4134 | -4606 | -1026 | -3118 | -4656 | -2457 | -2538 | -3389 | -4515 | -3495 | -4075 | -3946 | -4154 | -3320 | 3520 | 904 | 91 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8140 | | | | | | | | | | | | |
| 92(A) | 2436 | -1450 | -3080 | -3062 | -3722 | -1707 | -2801 | -3478 | -3005 | -3713 | -2813 | -2174 | 1760 | -2697 | -3044 | 2014 | -1242 | -2447 | -3930 | -3709 | 92 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8134 | | | | | | | | | | | | |
| 93(S) | -797 | 2971 | -3664 | -3672 | -3546 | -1712 | -2998 | -3220 | -3388 | -3539 | -2685 | -2356 | -2477 | -3023 | -3254 | 2975 | 1394 | -2305 | -3830 | -3649 | 93 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8129 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 94(Y) | -4444 | -3646 | -4593 | -4892 | -509 | -4268 | -1873 | -3993 | -4663 | -3407 | -3460 | -3884 | -4503 | -3998 | -4255 | -4336 | -4491 | -4072 | -1177 | 4829 | 94 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8124 | | | | | | | | | | | | |
| 95(E) | -3777 | -4125 | -1925 | 3871 | -4984 | -3355 | -3125 | -5379 | -3371 | -5156 | -4796 | -2611 | -3875 | -3007 | -3762 | -3630 | -3916 | -4960 | -4357 | -4463 | 95 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8119 | | | | | | | | | | | | |
| 96(A) | 2588 | -1457 | -3368 | -3530 | -3881 | -1722 | -3095 | -3647 | -3472 | -3926 | -3021 | -2338 | -2505 | -3081 | -3355 | 2536 | -1295 | -2531 | -4108 | -3950 | 96 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8114 | | | | | | | | | | | | |
| 97(F) | -4350 | -3618 | -4843 | -5137 | 4483 | -4245 | -2206 | -3493 | -4990 | -2887 | -3007 | -4147 | -4512 | -4243 | -4506 | -4433 | -4439 | -3737 | -1500 | -417 | 97 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8109 | | | | | | | | | | | | |
| 98(M) | 706 | -1201 | -3821 | -3231 | -1007 | -3165 | -2103 | 1510 | -2884 | 1469 | 2600 | -2801 | -3121 | -2481 | -2711 | -2285 | -1405 | 1421 | -1846 | -1550 | 98 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7719 | -8761 | -894 | -1115 | -701 | -1378 | -8762 | -8103 | | | | | | | | | | | | |
| 99(H) | -1732 | -2580 | -1961 | -1265 | -3039 | -2507 | 3869 | -2740 | 117 | -2656 | -1919 | -1338 | -2617 | -548 | 2281 | -1696 | 1373 | -2439 | -2662 | -2280 | 99 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8098 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 100(I) | -2262 | -1772 | -4916 | -4590 | -2360 | -4692 | -4608 | 2948 | -4520 | -1146 | -1086 | -4377 | -4472 | -4432 | -4647 | -4052 | -2257 | 2744 | -4024 | -3536 | 100 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8093 | | | | | | | | | | | | |
| 101(V) | -2259 | -1770 | -4911 | -4585 | -2361 | -4682 | -4599 | 2472 | -4513 | -1151 | -1088 | -4370 | -4467 | -4427 | -4640 | -443 | -2254 | 3105 | -4021 | -3531 | 101 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8087 | | | | | | | | | | | | |
| 102(D) | -1281 | -2033 | 3087 | -908 | -2698 | -2028 | -1475 | -1596 | -1454 | -2381 | -1758 | -1118 | -2459 | -1191 | -1938 | -1365 | 1158 | 1286 | -3025 | -2452 | 102 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8082 | | | | | | | | | | | | |
| 103(S) | -1644 | -2173 | -3321 | -3615 | -4077 | -2357 | -3411 | -4307 | -3792 | -4459 | -3725 | -2859 | -3095 | -3512 | -3692 | 3619 | -2088 | -3285 | -4091 | -3959 | 103 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8077 | | | | | | | | | | | | |
| 104(M) | -3457 | -3250 | -4578 | -4682 | -2595 | -3839 | -3833 | -2264 | -4294 | -1708 | 5248 | -4331 | -4225 | -4184 | -4072 | -3938 | -3655 | -2653 | -3435 | -3236 | 104 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8071 | | | | | | | | | | | | |
| 105(L) | -2433 | -2031 | -4839 | -4270 | 1637 | -4331 | -3217 | 1476 | -3985 | 2288 | 96 | -3990 | -3978 | -3290 | -3710 | -3525 | -2348 | 1287 | -2465 | -2367 | 105 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8066 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 106(N) | -952 | -1482 | -1959 | -1737 | -2360 | -1930 | -1748 | -1480 | -1701 | -2148 | -1486 | 2935 | -2420 | -1580 | -1960 | -1182 | 2024 | 1339 | -2731 | -2304 | 106 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8061 | | | | | | | | | | | | |
| 107(Q) | -3758 | -3792 | -3072 | -3245 | -4342 | -3586 | -3274 | -5053 | -2880 | -4719 | -4410 | -3349 | -4049 | 4526 | -2916 | -3829 | -3917 | -4726 | -3973 | -3953 | 107 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8055 | | | | | | | | | | | | |
| 108(H) | -3941 | -3303 | -3939 | -4079 | 336 | -4266 | 4844 | -3317 | -3580 | -2730 | -2734 | -3097 | -4295 | -3109 | -3362 | -3663 | -3868 | -3403 | -373 | 2757 | 108 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8050 | | | | | | | | | | | | |
| 109(A) | 2381 | -1319 | -2661 | -2353 | 1521 | 924 | -2061 | -2159 | -2216 | -2443 | -1684 | -1875 | -2365 | -1993 | -2375 | 1314 | -1085 | -1685 | -2481 | -2472 | 109 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8044 | | | | | | | | | | | | |
| 110(K) | -3709 | -3782 | -3592 | -3179 | -4734 | -3639 | -2561 | -4748 | 3938 | -4426 | -3926 | -3130 | -3916 | -2292 | -1410 | -3723 | -3624 | -4465 | -3818 | -3998 | 110 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8039 | | | | | | | | | | | | |
| 111(W) | -4239 | -3322 | -4800 | -5070 | 2397 | -4565 | -1086 | -3101 | -4634 | -2445 | -2527 | -3425 | -4503 | -3523 | -4074 | -3959 | -4140 | -3310 | 5693 | 837 | 111 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8033 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 112(L) | -3174 | -2633 | -5520 | -4994 | -1029 | -5242 | -4053 | 1453 | -4737 | 2932 | 174 | -4959 | -4514 | -3738 | -4340 | -4596 | -3057 | -761 | -2778 | -2863 | 112 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8028 | | | | | | | | | | | | |
| 113(K) | -1073 | -2547 | 1983 | 1205 | -2885 | -1851 | -580 | -2624 | 2040 | -2541 | -1656 | -477 | -2021 | -141 | 1183 | -924 | -1014 | -2183 | -2682 | -2014 | 113 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8022 | | | | | | | | | | | | |
| 114(M) | 1488 | -784 | -2685 | -2089 | -758 | -2378 | -1239 | 1284 | -1794 | -540 | 2454 | -1834 | -2427 | 1221 | -1791 | -1444 | -817 | 1168 | -1289 | -933 | 114 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8017 | | | | | | | | | | | | |
| 115(C) | 1116 | 3924 | -3654 | -3615 | -3360 | 1383 | -2916 | -3025 | -3341 | -3335 | -2502 | -2336 | -2465 | -2960 | -3214 | -1051 | 2263 | -2200 | -3668 | -3472 | 115 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1842 | -7719 | -489 | -894 | -1115 | -701 | -1378 | -8762 | -8011 | | | | | | | | | | | | |
| 116(V) | -588 | -579 | -2160 | -1946 | -759 | -1834 | -1555 | 1143 | -1670 | -9 | 123 | -1684 | -2156 | -1608 | -1741 | -1222 | -711 | 2811 | -1682 | -1223 | 116 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -42 | -5919 | -6961 | -894 | -1115 | -152 | -3320 | -8762 | -8006 | | | | | | | | | | | | |
| 117(R) | 740 | -1533 | -1479 | -915 | -1874 | -1953 | -873 | -1460 | -464 | 601 | -933 | -1028 | -2151 | -588 | 2555 | 747 | -902 | -1223 | -2081 | -1631 | 117 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -8000 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 118(E) | -1519 | -3167 | 1458 | 2619 | -3424 | -1929 | 2323 | -3240 | -838 | -3155 | -2323 | -534 | -2279 | 1614 | -1462 | -1295 | -1511 | -2766 | -3331 | -2516 | 118 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7994 | | | | | | | | | | | | |
| 119(I) | -1108 | -1022 | -2831 | -2246 | -840 | -2607 | -1460 | 2037 | -1908 | 1407 | 36 | -2034 | -2633 | 1279 | -1920 | -1682 | 1280 | -126 | -1499 | -1169 | 119 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7989 | | | | | | | | | | | | |
| 120(P) | -1226 | -2486 | -581 | -427 | -3101 | 1037 | -903 | -2834 | 1189 | -2796 | -1949 | 1466 | 2619 | -497 | -899 | -1126 | -1246 | -2362 | -2960 | -2322 | 120 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7983 | | | | | | | | | | | | |
| 121(W) | -5218 | -4132 | -5085 | -5404 | -2925 | -4252 | -3753 | -5470 | -5268 | -4877 | -4907 | -5071 | -4661 | -5108 | -4833 | -5506 | -5369 | -5443 | 6261 | -2535 | 121 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7977 | | | | | | | | | | | | |
| 122(R) | -2786 | -3324 | -3159 | -2158 | -3444 | -3203 | 2835 | -3646 | 19 | -3307 | -2690 | -2048 | -3245 | -942 | 3648 | -2697 | -2534 | -3415 | -2888 | -2551 | 122 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7972 | | | | | | | | | | | | |
| 123(H) | 661 | -2311 | -894 | -302 | -2686 | 811 | 2065 | -2371 | 1951 | -2300 | -1425 | -565 | -1991 | -22 | 1309 | -873 | -899 | -1971 | -2431 | -1856 | 123 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7966 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 124(D) | -1783 | -3362 | 2774 | -330 | -3711 | -2050 | -1197 | -3534 | 1468 | -3445 | -2669 | -689 | 2225 | -827 | -1652 | -1548 | -1805 | -3056 | -3598 | -2798 | 124 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7960 | | | | | | | | | | | | |
| 125(I) | -2784 | -2321 | -4408 | -4214 | 2256 | -4011 | -1193 | 3098 | -3823 | -1290 | -1179 | -3131 | -3919 | -3037 | -3465 | -3182 | -2704 | -1420 | -513 | 2319 | 125 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8761 | -894 | -1115 | -701 | -1378 | -8762 | -7954 | | | | | | | | | | | | |
| 126(S) | 1918 | -1460 | -2882 | -2748 | -3664 | 1367 | -2596 | -3426 | -2688 | -3630 | -2719 | -2048 | 1372 | -2426 | -2827 | 1999 | -1206 | -2419 | -3840 | -3573 | 126 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8762 | -894 | -1115 | -701 | -1378 | -8762 | -7948 | | | | | | | | | | | | |
| 127(S) | -1644 | -2173 | -3321 | -3615 | -4077 | -2357 | -3411 | -4307 | -3792 | -4459 | -3725 | -2859 | -3095 | -3512 | -3692 | 3619 | -2088 | -3285 | -4091 | -3959 | 127 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8762 | -894 | -1115 | -701 | -1378 | -8762 | -7943 | | | | | | | | | | | | |
| 128(L) | -2843 | -2399 | -5187 | -4720 | -1139 | -4765 | -3832 | -83 | -4437 | 2876 | 38 | -4542 | -4330 | -3660 | -4145 | -4094 | -2781 | 1324 | -2793 | -2769 | 128 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8762 | -894 | -1115 | -701 | -1378 | -8762 | -7937 | | | | | | | | | | | | |
| 129(N) | -3232 | -3514 | -2565 | -2905 | -4358 | -3267 | -3364 | -5192 | -3627 | -5059 | -4632 | 4348 | -3843 | -3410 | -3792 | -3319 | -3533 | -4568 | -4087 | -3976 | 129 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8762 | -894 | -1115 | -701 | -1378 | -8762 | -7931 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 130(Y) | -1616 | -1344 | -3951 | -3366 | -912 | -3313 | -2164 | 1486 | -3018 | 1578 | -20 | -2936 | -3238 | -2574 | -2829 | -2438 | -1554 | 1298 | -1825 | 2867 | 130 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7719 | -8762 | -894 | -1115 | -701 | -1378 | -8762 | -7925 | | | | | | | | | | | | |
| 131(I) | -2438 | -1963 | -4986 | -4538 | -1573 | -4670 | -3957 | 2309 | -4369 | 2112 | -365 | -4331 | -4311 | -3863 | -4246 | -3955 | -2391 | 1749 | -3152 | -2992 | 131 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7919 | | | | | | | | | | | | |
| 132(M) | 694 | -667 | -2636 | -2033 | -642 | -2235 | -1106 | -145 | -1725 | 645 | 2178 | -1733 | -2301 | -1435 | -1691 | 561 | 1254 | 1172 | -1134 | -779 | 132 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7913 | | | | | | | | | | | | |
| 133(T) | -866 | -1487 | -3132 | -3246 | -3768 | -1744 | -2940 | -3519 | -3190 | -3799 | -2925 | -2263 | -2509 | -2888 | -3152 | 2652 | 2778 | -2491 | -3995 | -3782 | 133 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7907 | | | | | | | | | | | | |
| 134(S) | -1644 | -2173 | -3321 | -3615 | -4077 | -2357 | -3411 | -4307 | -3792 | -4459 | -3725 | -2859 | -3095 | -3512 | -3692 | 3619 | -2088 | -3285 | -4091 | -3959 | 134 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7901 | | | | | | | | | | | | |
| 135(H) | -1254 | -2216 | -843 | -755 | -2687 | -1970 | 3314 | -2636 | -839 | -2710 | -1932 | 1437 | -2343 | -837 | -1206 | -1244 | 2636 | -2214 | -2810 | -2158 | 135 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7895 | | | | | | | | | | | | |

TABLE 8-continued

| | | | | | | | | | | | | | | | | | | | | |
|---|---|---|---|---|---|---|---|---|---|---|---|---|---|---|---|---|---|---|---|---|
| 136(W) | -2217 | -1998 | -4211 | -3930 | -1050 | -3517 | -2291 | -446 | -3456 | -1314 | -1150 | -3322 | -3697 | -3202 | -3309 | -2906 | -2265 | 3288 | 3612 | -961 | 136 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7889 | | | | | | | | | | | | |
| 137(W) | 1105 | -2160 | -3856 | -3730 | 1959 | -3434 | -1130 | -1795 | -3348 | -1692 | -1411 | -2810 | -3571 | -2764 | -3122 | -2642 | -2381 | -1804 | 5259 | 566 | 137 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7883 | | | | | | | | | | | | |
| 138(R) | -2269 | -3123 | -2497 | -1540 | -3728 | -2880 | 2414 | -3259 | 347 | -2971 | -2265 | -1547 | -2868 | 2539 | 3022 | -2145 | -2019 | -2993 | -2838 | -2604 | 138 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7877 | | | | | | | | | | | | |
| 139(O) | -3758 | -3792 | -3072 | -3245 | -4342 | -3586 | -3274 | -5053 | -2880 | -4719 | -4410 | -3349 | -4049 | 4526 | -2916 | -3829 | -3917 | -4726 | -3973 | -3953 | 139 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7870 | | | | | | | | | | | | |
| 140(D) | -2399 | -4357 | 3309 | 2333 | -4526 | -2166 | -1607 | -4526 | -1993 | -4365 | -3789 | -765 | -2745 | -1300 | -2954 | -2017 | -2495 | -3974 | -4514 | -3455 | 140 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7864 | | | | | | | | | | | | |
| 141(H) | -4406 | -3961 | -3921 | -4171 | -3231 | -3926 | 5401 | -5468 | -3992 | -5013 | -4849 | -4130 | -4378 | -4151 | -3893 | -4548 | -4592 | -5195 | -3383 | -2818 | 141 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7858 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 142(N) | -3232 | -3514 | -2565 | -2905 | -4358 | -3267 | -3364 | -5192 | -3627 | -5059 | -4632 | 4348 | -3843 | -3410 | -3792 | -3319 | -3533 | -4568 | -4087 | -3976 | 142 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7720 | -8762 | -894 | -1115 | -701 | -1378 | -8762 | -7852 | | | | | | | | | | | | |
| 143(G) | -3681 | -3593 | -4389 | -4747 | -5281 | 3812 | -4419 | -5908 | -5071 | -5671 | -5288 | -4417 | -4223 | -4850 | -4766 | -3952 | -4069 | -5125 | -4424 | -5214 | 143 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7845 | | | | | | | | | | | | |
| 144(F) | -4352 | -3337 | -4799 | -5121 | 3888 | -4670 | -928 | -3235 | -4686 | -2571 | -2654 | -3328 | -4541 | -3456 | -4078 | -3931 | -4217 | -3400 | -178 | 3260 | 144 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7839 | | | | | | | | | | | | |
| 145(T) | -866 | -1487 | -3132 | -3246 | -3768 | -1744 | -2940 | -3519 | -3190 | -3799 | -2925 | -2263 | -2509 | -2888 | -3152 | 2652 | 2778 | -2491 | -3995 | -3782 | 145 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7833 | | | | | | | | | | | | |
| 146(H) | -4406 | -3961 | -3921 | -4171 | -3231 | -3926 | 5401 | -5468 | -3992 | -5013 | -4849 | -4130 | -4378 | -4151 | -3893 | -4548 | -4592 | -5195 | -3383 | -2818 | 146 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7827 | | | | | | | | | | | | |
| 147(O) | -3758 | -3792 | -3072 | -3245 | -4342 | -3586 | -3274 | -5053 | -2880 | -4719 | -4410 | -3349 | -4049 | 4526 | -2916 | -3829 | -3917 | -4726 | -3973 | -3953 | 147 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7820 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 148(D) | -2001 | -3292 | 3601 | -626 | -4238 | -2111 | -1759 | -4246 | -2092 | -4199 | -3539 | -963 | -2715 | -1470 | -2900 | 1255 | -2206 | -3561 | -4288 | -3412 | 148 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7814 | | | | | | | | | | | | |
| 149(P) | -4077 | -3791 | -4518 | -4858 | -5206 | -3818 | -4460 | -5898 | -5053 | -5602 | -5343 | -4628 | 4289 | -4938 | -4749 | -4364 | -4429 | -5313 | -4385 | -5119 | 149 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7807 | | | | | | | | | | | | |
| 150(G) | -2415 | -2868 | -3074 | -2972 | -4434 | 3359 | -2704 | -4428 | -1915 | -4330 | -3670 | -2780 | -3430 | -2492 | 1875 | -2564 | -2676 | -3754 | -3904 | -3964 | 150 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7801 | | | | | | | | | | | | |
| 151(F) | -2339 | -1986 | -4665 | -4064 | 3176 | -4095 | -2859 | -229 | -3739 | 1224 | 2452 | -3737 | -3789 | -3040 | -3446 | -3256 | -2245 | 1216 | -2175 | -2011 | 151 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7794 | | | | | | | | | | | | |
| 152(I) | -2056 | -1731 | -4386 | -3851 | -1203 | -3873 | -2916 | 2392 | -3540 | 2065 | -105 | -3529 | -3714 | -3075 | -3381 | -3054 | 1098 | 51 | -2437 | -2237 | 152 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7788 | | | | | | | | | | | | |
| 153(D) | -1118 | -2211 | 2195 | -621 | -3243 | 803 | -1223 | -3009 | -1065 | -3036 | -2177 | -857 | -2246 | -848 | -1597 | 985 | 2152 | -2413 | -3246 | -2588 | 153 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7781 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 154(H) | -1003 | -1199 | -2356 | -1954 | -1388 | -2206 | 3132 | -636 | -1619 | -1264 | -667 | -1770 | -2496 | -1555 | -1734 | -1385 | 1395 | 2407 | -1879 | -1430 | 154 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7775 | | | | | | | | | | | | |
| 155(M) | 695 | -1534 | -4131 | -3535 | -944 | -3528 | -2430 | 2154 | -3199 | 1674 | 2687 | -3161 | -3396 | -2699 | -2998 | -2660 | -1749 | -182 | -2022 | -1814 | 155 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7768 | | | | | | | | | | | | |
| 156(L) | 682 | -1592 | -4101 | -3606 | -1242 | -3407 | -2684 | 95 | -3291 | 2495 | -186 | -3196 | -3443 | -2879 | -3157 | -2606 | -1799 | 1329 | -2351 | -2114 | 156 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7762 | | | | | | | | | | | | |
| 157(N) | -1782 | -3518 | 1546 | 1312 | -3758 | -1994 | -1175 | -3610 | -1194 | -3512 | -2730 | 2977 | -2426 | -804 | -1905 | 1148 | -1804 | -3115 | -3698 | -2808 | 157 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7755 | | | | | | | | | | | | |
| 158(K) | -2459 | -2938 | -2880 | -2055 | -2893 | -3094 | -1378 | -2442 | 3407 | 840 | -1882 | -2005 | -3159 | -1028 | -200 | -2490 | -2293 | -2474 | -2837 | -2553 | 158 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7748 | | | | | | | | | | | | |
| 159(K) | -1148 | -2117 | -1407 | -950 | -3066 | -1999 | -1021 | -2720 | 2980 | -2713 | -1884 | -1076 | -2295 | -623 | -548 | 886 | 1179 | -2234 | -2851 | -2379 | 159 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7741 | | | | | | | | | | | | |

TABLE 8-continued

| | | | | | | | | | | | | | | | | | | | | |
|---|---|---|---|---|---|---|---|---|---|---|---|---|---|---|---|---|---|---|---|---|
| 160(P) | 1034 | -1295 | -2486 | -2150 | 1616 | -1809 | -1863 | -1877 | -2017 | -2165 | -1435 | -1781 | 2897 | -1813 | -2195 | 966 | -1055 | -1493 | -2567 | -2152 | 160 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8762 | -894 | -1115 | -701 | -1378 | -8762 | -7735 | | | | | | | | | | | | |
| 161(D) | -2104 | -3998 | 2881 | 1352 | -4180 | 1216 | -1393 | -4095 | -1610 | -3965 | -3275 | 1701 | -2586 | -1055 | -2452 | -1771 | -2164 | -3570 | -4160 | -3154 | 161 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1843 | -7720 | -490 | -894 | -1115 | -701 | -1378 | -8762 | -7728 | | | | | | | | | | | | |
| 162(N) | -498 | -1221 | 110 | -15 | -1620 | -964 | -477 | -1773 | -335 | -1934 | -1330 | 3292 | -1450 | -280 | -647 | -522 | -670 | -1383 | -1763 | -1178 | 162 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -43 | -5920 | -6962 | -894 | -1115 | -2643 | -252 | -8762 | -7721 | | | | | | | | | | | | |
| 163(D) | -961 | -1901 | 3312 | 369 | -2315 | -1032 | -511 | -2292 | -663 | -2377 | -1817 | 34 | -1523 | -264 | -1242 | -811 | -1065 | -1927 | -2232 | -1739 | 163 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -43 | -5920 | -6962 | -894 | -1115 | -2643 | -252 | -8762 | -7714 | | | | | | | | | | | | |
| 164(H) | -997 | -1393 | -635 | -583 | -386 | -1411 | 4407 | -1664 | -259 | -1594 | -1144 | -676 | -1756 | -466 | -415 | -1034 | -1055 | -1464 | -790 | 42 | 164 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -43 | -5920 | -6962 | -894 | -1115 | -152 | -3320 | -8762 | -7707 | | | | | | | | | | | | |
| 165(V) | -2121 | -1684 | -4679 | -4254 | 1449 | -4310 | -3633 | 2372 | -4076 | -839 | -756 | -3954 | -4126 | -3800 | -4049 | -3566 | -2094 | 2791 | -3155 | -2717 | 165 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7720 | -8763 | -894 | -1115 | -701 | -1378 | -8762 | -7700 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 166(V) | -1172 | -1063 | -3285 | -2755 | -1280 | -2703 | -1906 | 1464 | -2465 | -907 | -407 | -2383 | -2845 | -2193 | -2434 | 949 | 1115 | 2471 | -1913 | -1547 | 166 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7693 | | | | | | | | | | | | |
| 167(R) | -2428 | -3137 | -2310 | -1828 | -3921 | -2880 | -1372 | -3657 | -155 | -3392 | -2732 | 1602 | -3079 | -997 | 3685 | -2367 | -2329 | -3316 | -3168 | -2942 | 167 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7687 | | | | | | | | | | | | |
| 168(I) | 673 | -1102 | -3159 | -2611 | -1247 | -2870 | -1866 | 2195 | -2325 | -820 | -354 | -2364 | -2914 | 1287 | -2345 | -1977 | -1221 | 2181 | -1906 | -1534 | 168 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7679 | | | | | | | | | | | | |
| 169(Y) | -4444 | -3646 | -4593 | -4892 | -509 | -4268 | -1873 | -3993 | -4663 | -3407 | -3460 | -3884 | -4503 | -3998 | -4255 | -4336 | -4491 | -4072 | -1177 | 4829 | 169 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7672 | | | | | | | | | | | | |
| 170(F) | -3400 | -2827 | -5361 | -4990 | 2846 | -5067 | -2816 | -651 | -4697 | 2592 | 25 | -4506 | -4471 | -3608 | -4224 | -4409 | -3268 | -1403 | -1851 | -1138 | 170 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7665 | | | | | | | | | | | | |
| 171(P) | 1191 | -1755 | -3163 | -3402 | -3998 | -1985 | -3182 | -3756 | -3492 | -4031 | -3233 | -2502 | 3818 | -3181 | -3412 | -1407 | -1613 | -2766 | -4124 | -4023 | 171 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7658 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 172(P) | 1902 | -1437 | -3147 | -3131 | -3577 | -1724 | -2798 | -3245 | -3019 | -3540 | -2684 | -2204 | 3083 | -2726 | -3028 | -1065 | 1432 | -2336 | -3823 | -3602 | 172 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7651 | | | | | | | | | | | | |
| 173(D) | -3832 | -4189 | 4132 | -2236 | -5073 | -3341 | -3194 | -5633 | -3716 | -5365 | -5035 | -2584 | -3886 | -3102 | -4252 | -3662 | -4000 | -5151 | -4434 | -4544 | 173 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7721 | -8763 | -894 | -1115 | -701 | -1378 | -8762 | -7644 | | | | | | | | | | | | |
| 174(A) | 2913 | -1375 | -3389 | -3354 | -3146 | 1014 | -2798 | -2432 | -3176 | -3025 | -2284 | -2297 | -2499 | -2833 | -3104 | -1111 | -1235 | 1120 | -3514 | -3272 | 174 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7722 | -8764 | -894 | -1115 | -701 | -1378 | -8762 | -7638 | | | | | | | | | | | | |
| 175(N) | -3232 | -3514 | -2565 | -2905 | -4358 | -3267 | -3364 | -5192 | -3627 | -5059 | -4632 | 4348 | -3843 | -3410 | -3792 | -3319 | -3533 | -4568 | -4087 | -3976 | 175 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7629 | | | | | | | | | | | | |
| 176(C) | -775 | 3036 | -2850 | -2408 | -1588 | -1919 | -1731 | -1110 | -2133 | -1469 | 2376 | -1909 | -2363 | -1881 | -2164 | 925 | 2536 | -890 | -2035 | -1692 | 176 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7622 | | | | | | | | | | | | |
| 177(L) | -3406 | -2832 | -5440 | -5026 | 2063 | -5151 | -3069 | -587 | -4746 | 2880 | 97 | -4659 | -4495 | -3638 | -4269 | -4506 | -3269 | -1359 | -2041 | -1444 | 177 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7615 | | | | | | | | | | | | |

TABLE 8-continued

| | | | | | | | | | | | | | | | | | | | | | |
|---|---|---|---|---|---|---|---|---|---|---|---|---|---|---|---|---|---|---|---|---|---|
| 178(L) | -3777 | -3243 | -5089 | -5032 | -1735 | -4514 | -4040 | -1299 | -4754 | 3261 | -696 | -4891 | -4508 | -4152 | -4395 | -4705 | -3767 | -1993 | -3125 | -3069 | 178 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7607 | | | | | | | | | | | | |
| 179(C) | 2942 | 2982 | -3827 | -3914 | -3641 | -1706 | -3124 | -3330 | -3613 | -3649 | -2779 | -2414 | -2485 | -3185 | -3403 | 1168 | -1242 | -2356 | -3925 | -3779 | 179 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7600 | | | | | | | | | | | | |
| 180(V) | -2004 | -1608 | -4544 | -4142 | -2135 | -4125 | -3700 | 1840 | -3967 | -1140 | -967 | -3830 | -4052 | -3798 | -4000 | -3390 | 1338 | 2999 | -3399 | -2963 | 180 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7592 | | | | | | | | | | | | |
| 181(F) | 1588 | -850 | -2996 | -2447 | 2261 | -2299 | -1475 | -182 | -2129 | -756 | -166 | -2019 | -2485 | -1821 | -2060 | -1435 | 1085 | 1429 | -1479 | -1117 | 181 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7585 | | | | | | | | | | | | |
| 182(D) | 1088 | -3814 | 3226 | 1427 | -4086 | -2058 | -1384 | -3970 | -1570 | -3872 | -3169 | -670 | -2570 | -1045 | -2378 | -1733 | -2102 | -3453 | -4073 | -3107 | 182 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7577 | | | | | | | | | | | | |
| 183(H) | -2540 | -3259 | -3155 | -1838 | -4078 | -3083 | 3373 | -3420 | 2334 | -3069 | -2392 | -1745 | -3017 | -555 | 2597 | -2412 | -2222 | -3187 | -2907 | -2791 | 183 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7570 | | | | | | | | | | | | |

TABLE 8-continued

| | | | | | | | | | | | | | | | | | | | | |
|---|---|---|---|---|---|---|---|---|---|---|---|---|---|---|---|---|---|---|---|---|
| 184(C) | 998 | 4910 | -3920 | -3803 | -2550 | -2066 | -2898 | -917 | -3459 | -2125 | -1635 | -2602 | -2717 | -3092 | -3274 | -1392 | -1333 | 1279 | -3175 | -2885 | 184 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7562 | | | | | | | | | | | | |
| 185(M) | -3195 | -2670 | -5480 | -4897 | 2597 | -5129 | -3599 | -426 | -4630 | 2310 | 2844 | -4767 | -4399 | -3550 | -4175 | -4399 | -3050 | -1206 | -2449 | -2343 | 185 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7555 | | | | | | | | | | | | |
| 186(O) | -1978 | -3010 | -1873 | -1184 | -3573 | -2640 | 2315 | -3132 | 2388 | -2890 | -2142 | -1292 | -2679 | 3064 | 193 | -1845 | -1787 | -2819 | -2820 | -2501 | 186 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -18 | -7721 | -8763 | -894 | -1115 | -701 | -1378 | -8762 | -7547 | | | | | | | | | | | | |
| 187(S) | -1150 | -2122 | 1356 | -858 | -3376 | -1832 | -1484 | -3135 | -1404 | -3212 | -2374 | -1042 | -2342 | -1143 | -1916 | 2458 | 2054 | -2488 | -3434 | -1812 | 187 |
| - | * | * | * | * | * | * | * | * | * | * | * | * | * | * | * | * | * | * | * | * | |
| - | * | * | * | * | * | * | * | -8762 | 0 | | | | | | | | | | | | |

TABLE 9

HMMER2.0 [2.3.2]
NAME XFP C
ACC PF09363.1
DESC XFP C-terminal domain
LENG 212
ALPH Amino
RF no
CS no
MAP yes
COM hmmbuild -f -F HMM fs.ann SEED.ann
COM hmmcalibrate --seed 0 HMM fs.ann
NSEQ 6
DATE Thu May 3 17:57:02 2007
CKSUM 5491
GA 25.0 25.0
TC 47.0 29.4
NC 15.7 15.7
XT -8455 -4 -1000 -1000 -8455 -4 -8455 -4
NULT -4 -8455
NULE 595 -1558 85 338 -294 453 -1158 197 249 902 -1085 -142 -21 -313 45 531 201 384 -1998 -644
EVD -10.483098 0.640397

| HMM | A | C | D | E | F | G | H | I | K | L | M | N | P | Q | R | S | T | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | -193 | * | -2999 | | | | | | | | | | | | | | | | | | |
| 1(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 1 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -1193 | -8721 | | | | | | | | | | | | |
| 2(O) | -1392 | -2802 | -618 | -424 | -3105 | -2084 | 2223 | -2893 | -446 | -2828 | -1977 | 1616 | 1057 | 3114 | -866 | -1245 | -1350 | -2468 | -2957 | -2283 | 2 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8718 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 3(P) | 1097 | -2000 | -3515 | -3791 | -4319 | -2230 | -3513 | -4117 | -3884 | -4378 | -3565 | -2801 | 3889 | -3540 | -3757 | -1661 | -1871 | -3066 | -4416 | -4363 | 3 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8714 | | | | | | | | | | | | |
| 4(H) | 829 | -2314 | -845 | -285 | -2656 | -1910 | 2103 | -2366 | 0 | -2324 | -1434 | -569 | -2003 | 1714 | 2028 | 709 | -889 | -1956 | -2490 | -1870 | 4 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8711 | | | | | | | | | | | | |
| 5(W) | 872 | -1301 | -1524 | -969 | -1324 | -2103 | -863 | -924 | -771 | 407 | -486 | -1096 | 1119 | 2314 | -1087 | -1098 | -883 | -778 | 2741 | -1233 | 5 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8707 | | | | | | | | | | | | |
| 6(O) | 1139 | -1910 | -1850 | -1613 | -3267 | -2003 | -1790 | -2923 | -1462 | -3080 | -2266 | -1578 | -2518 | 3569 | -1755 | -1258 | 1437 | -2329 | -3351 | -2895 | 6 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8704 | | | | | | | | | | | | |
| 7(W) | -4606 | -3595 | -5007 | -5318 | 253 | -4844 | -1211 | -3574 | -4838 | -2908 | -2986 | -3590 | -4756 | -3710 | -4268 | -4192 | -4482 | -3721 | 5473 | 3368 | 7 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8700 | | | | | | | | | | | | |
| 8(L) | -2343 | -2040 | -4542 | -3937 | 1831 | -4019 | -2749 | 1548 | -3592 | 2218 | 65 | -3613 | -3780 | 1482 | -3353 | -3156 | -2252 | -936 | -2180 | -1956 | 8 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8697 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 9(T) | -1385 | -2322 | 1417 | -1149 | -3726 | -2036 | -1831 | -3500 | -1823 | -3585 | -2754 | -1314 | -2593 | -1510 | -2340 | 1921 | 2800 | -2796 | -3801 | -3184 | 9 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8693 | | | | | | | | | | | | |
| 10(M) | -1554 | -1399 | -3470 | -2849 | -1043 | -3109 | -1939 | -255 | 1071 | 1028 | 3713 | -2584 | -3080 | -2156 | -2304 | -2204 | -1488 | 1337 | -1856 | -1572 | 10 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8690 | | | | | | | | | | | | |
| 11(D) | -2255 | -4080 | 2935 | 2308 | -4312 | -2253 | -1576 | -4208 | -1768 | -4097 | -3398 | -854 | -2767 | -1236 | -2584 | -1939 | 1141 | -3689 | -4293 | -3313 | 11 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8687 | | | | | | | | | | | | |
| 12(E) | -1169 | -2634 | -621 | 2512 | -2971 | -1972 | -696 | -2711 | 1193 | -2634 | -1746 | -602 | -2134 | 1564 | -675 | 777 | -1111 | -2271 | -2782 | -2114 | 12 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8683 | | | | | | | | | | | | |
| 13(A) | 3176 | -1703 | -4006 | -4070 | -3246 | -2260 | -3401 | -1441 | -3823 | -2722 | -2304 | -2855 | -2973 | -3487 | -3663 | -1620 | -1659 | 1420 | -3901 | -3631 | 13 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8679 | | | | | | | | | | | | |
| 14(I) | -1158 | -1549 | -1727 | 1889 | -1669 | -2385 | -1107 | 1890 | -836 | -1344 | -736 | -1323 | -2456 | -885 | 1317 | -1399 | -1097 | 1018 | -2055 | -1611 | 14 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8676 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 15(H) | 848 | -2322 | -1179 | -560 | -2630 | -2119 | 2363 | -2275 | 2038 | -2278 | -1446 | -801 | -2188 | -233 | 1325 | -1089 | -1073 | 627 | -2469 | -1939 | 15 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8672 | | | | | | | | | | | | |
| 16(H) | -1354 | -2628 | -576 | 1333 | -2749 | -2068 | 3770 | -2560 | -570 | 422 | -1777 | 1432 | -2292 | -513 | -1032 | -1235 | -1312 | -2213 | -2778 | -2099 | 16 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8669 | | | | | | | | | | | | |
| 17(C) | 647 | 4245 | -3771 | -3246 | -1380 | -2866 | -2176 | -26 | -2899 | 843 | -500 | -2705 | -3040 | -2556 | -2758 | -2038 | -1382 | 1326 | -2062 | -1723 | 17 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8665 | | | | | | | | | | | | |
| 18(T) | -1296 | -2623 | -1140 | 1900 | -3034 | -2174 | -690 | -2702 | 1486 | -2593 | -1730 | -817 | -2254 | -245 | 1344 | -1174 | 1932 | -2302 | -2686 | -2143 | 18 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8662 | | | | | | | | | | | | |
| 19(A) | 2122 | -2640 | 1402 | -254 | -2963 | -1940 | -736 | -2715 | 1187 | -2660 | -1774 | -577 | -2132 | 1562 | -869 | -1024 | -1125 | -2273 | -2833 | -2136 | 19 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8658 | | | | | | | | | | | | |
| 20(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 20 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8655 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 21(I) | 1832 | -1779 | -4707 | -4321 | -2320 | -4169 | -3857 | 2857 | -4145 | -1329 | -1156 | -3958 | -4165 | -3960 | -4165 | -3443 | -2157 | 1658 | -3571 | -3143 | 21 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8651 | | | | | | | | | | | | |
| 22(A) | 1979 | -2132 | 1358 | -1230 | -3624 | 895 | -1764 | -3399 | -1659 | -3464 | -2589 | -1343 | -2501 | -1420 | -2138 | 1914 | -1456 | -2656 | -3665 | -3086 | 22 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8647 | | | | | | | | | | | | |
| 23(I) | -1613 | -1432 | -3370 | 991 | -1684 | -3301 | -2327 | 2219 | -2660 | -1128 | -723 | -2715 | -3318 | -2464 | -2756 | -2418 | 1220 | 2185 | -2433 | -2038 | 23 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8644 | | | | | | | | | | | | |
| 24(W) | -3333 | -2943 | -4821 | -4705 | -865 | -4258 | -2319 | 1550 | -4105 | -1483 | -1550 | -3928 | -4360 | -3731 | -3856 | -3853 | -3350 | -1751 | 5765 | -662 | 24 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8640 | | | | | | | | | | | | |
| 25(D) | -2155 | -3941 | 2895 | 1331 | -4165 | -2244 | -1467 | -4031 | 2266 | -3906 | -3170 | -838 | -2712 | -1110 | -2170 | -1857 | -2186 | -3532 | -4076 | -3168 | 25 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8988 | -894 | -1115 | -701 | -1378 | -8914 | -8637 | | | | | | | | | | | | |
| 26(W) | -4535 | -3580 | -5043 | -5339 | 2264 | -4800 | -1315 | -3404 | -4909 | -2727 | -2820 | -3667 | -4744 | -3774 | -4331 | -4221 | -4434 | -3613 | 5781 | 611 | 26 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8633 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 27(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 27 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8629 | | | | | | | | | | | | |
| 28(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 28 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8626 | | | | | | | | | | | | |
| 29(N) | -1462 | -2164 | -1894 | -2122 | -3935 | -2171 | -2578 | -3801 | -2603 | -4009 | -3230 | 3172 | -2856 | -2392 | -2846 | -1616 | 2907 | -2960 | -4077 | -3633 | 29 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8622 | | | | | | | | | | | | |
| 30(D) | 2036 | -3092 | 3356 | -1144 | -4437 | -2344 | -2201 | -4300 | -2537 | -4380 | -3702 | -1420 | -2974 | -1935 | -3248 | -2004 | -2335 | -3577 | -4473 | -3774 | 30 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8988 | -894 | -1115 | -701 | -1378 | -8914 | -8618 | | | | | | | | | | | | |
| 31(K) | 719 | -2804 | 1286 | -282 | -3133 | -1980 | -846 | -2900 | 2557 | -2836 | -1958 | 1613 | -2216 | -421 | -1059 | -1135 | -1263 | -2444 | -3007 | -2283 | 31 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8987 | -894 | -1115 | -701 | -1378 | -8914 | -8615 | | | | | | | | | | | | |
| 32(G) | -1795 | -2851 | 1703 | -1000 | -4330 | 2898 | -2022 | -4220 | -2294 | -4229 | -3471 | -1259 | -2791 | -1732 | -2991 | 1182 | -2066 | -3405 | -4399 | -3633 | 32 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1206 | -7945 | -837 | -894 | -1115 | -701 | -1378 | -8914 | -8611 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 33(N) | -713 | -1555 | -300 | -476 | -2841 | 2208 | -1131 | -2756 | -1105 | -2843 | -2074 | 2836 | -1863 | -861 | -1525 | -760 | -971 | -2081 | -2888 | -2349 | 33 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -24 | -6764 | -7806 | -894 | -1115 | -162 | -3231 | -8914 | -8607 | | | | | | | | | | | | |
| 34(E) | 652 | -2550 | 1383 | 2004 | -2857 | -1868 | -643 | -2618 | -298 | -2563 | -1660 | -497 | -2040 | 1542 | -832 | -908 | 985 | -2168 | -2738 | -2028 | 34 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8988 | -894 | -1115 | -701 | -1378 | -8914 | -8604 | | | | | | | | | | | | |
| 35(E) | 978 | -3351 | -336 | 2983 | -3871 | -2170 | -1425 | -3692 | -1401 | -3640 | -2859 | 1765 | -2619 | -1063 | -2043 | -1667 | -1932 | -3175 | -3830 | -3006 | 35 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8988 | -894 | -1115 | -701 | -1378 | -8914 | -8600 | | | | | | | | | | | | |
| 36(P) | -1823 | -2153 | -3843 | -3947 | -3271 | -2734 | -3495 | -1581 | -3785 | -2766 | -2465 | -3169 | 3446 | -3607 | -3696 | -2195 | -2168 | 2328 | -3859 | -3579 | 36 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8988 | -894 | -1115 | -701 | -1378 | -8914 | -8596 | | | | | | | | | | | | |
| 37(D) | -2642 | -4390 | 3693 | -696 | -4628 | -2447 | -1891 | -4714 | -2203 | -4552 | -3980 | -1088 | -3019 | 1971 | -3045 | -2293 | -2745 | -4173 | -4588 | -3642 | 37 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8988 | -894 | -1115 | -701 | -1378 | -8914 | -8592 | | | | | | | | | | | | |
| 38(V) | -2557 | -2122 | -5071 | -4711 | -1962 | -4673 | -4220 | 320 | -4512 | 984 | -791 | -4445 | -4483 | -4165 | -4454 | -4020 | -2550 | 3348 | -3513 | -3210 | 38 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7945 | -8988 | -894 | -1115 | -701 | -1378 | -8914 | -8589 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 39(V) | -2838 | -2616 | -4834 | -4880 | -3213 | -3955 | -4166 | -610 | -4757 | -2310 | -2253 | -4383 | -4345 | -4643 | -4642 | -3732 | -3007 | 3763 | -4157 | -3886 | 39 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7946 | -8988 | -894 | -1115 | -701 | -1378 | -8914 | -8585 | | | | | | | | | | | | |
| 40(M) | -3038 | -2583 | -5400 | -4796 | 1866 | -4936 | -3671 | 2288 | -4513 | 1389 | 3379 | -4610 | -4379 | -3590 | -4127 | -4157 | -2917 | -1104 | -2668 | -2694 | 40 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -12 | -7946 | -8988 | -894 | -1115 | -701 | -1378 | -8914 | -8581 | | | | | | | | | | | | |
| 41(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 41 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8577 | | | | | | | | | | | | |
| 42(C) | 2065 | 2925 | -3988 | -4043 | -3973 | 1287 | -3331 | -3726 | -3772 | -3993 | -3088 | -2601 | -2687 | -3352 | -3601 | 2060 | -1451 | -2653 | -4224 | -4091 | 42 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8574 | | | | | | | | | | | | |
| 43(A) | 2866 | 2846 | -4109 | -4001 | -2791 | -2206 | -3077 | -1268 | -3662 | -2419 | -1888 | -2761 | -2871 | -3275 | -3465 | -1533 | -1500 | 1398 | -3377 | -3097 | 43 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8570 | | | | | | | | | | | | |
| 44(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 44 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8566 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 45(D) | 1008 | -3741 | 3309 | -578 | -4350 | -2242 | -1698 | -4254 | -1941 | -4177 | -3484 | 1820 | -2795 | -1375 | -2757 | -1930 | -2306 | -3665 | -4371 | -3418 | 45 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8562 | | | | | | | | | | | | |
| 46(V) | -1488 | -1444 | -2805 | 1912 | -1672 | -3036 | -1995 | 1499 | -2149 | -1163 | -719 | -2290 | -3083 | -1996 | -2352 | -2120 | 998 | 2130 | -2347 | -1936 | 46 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8558 | | | | | | | | | | | | |
| 47(P) | -2288 | -2497 | -3856 | -3931 | -2960 | -3134 | -3483 | 1588 | -3705 | -2343 | -2229 | -3416 | 3829 | -3629 | -3645 | -2690 | -2575 | -1605 | -3649 | -3323 | 47 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8555 | | | | | | | | | | | | |
| 48(T) | -1494 | -1874 | -3613 | -3499 | -2448 | -2472 | -2890 | -1675 | -3034 | -1763 | 2674 | -2770 | -3069 | -2947 | -2983 | -1828 | 3524 | -1602 | -3212 | -2888 | 48 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8551 | | | | | | | | | | | | |
| 49(F) | -1077 | -1060 | -2607 | -2006 | 1617 | -2517 | -1308 | 1338 | 853 | 1327 | -74 | -1856 | -2554 | 1561 | -1724 | -1568 | -1013 | -416 | -1457 | -1095 | 49 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8547 | | | | | | | | | | | | |
| 50(E) | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 50 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8543 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 51(T) | 1578 | -1365 | -3818 | -3310 | -1660 | -3164 | -2456 | 1709 | -3026 | -1148 | -726 | -2898 | -3288 | -2750 | -2975 | -2334 | 2031 | 1609 | -2396 | -2024 | 51 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8539 | | | | | | | | | | | | |
| 52(M) | -3164 | -2670 | -5546 | -4970 | -1172 | -5167 | -3972 | -395 | -4712 | 2611 | 2735 | -4857 | -4533 | -3759 | -4329 | -4434 | -3047 | 1340 | -2847 | -2936 | 52 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8535 | | | | | | | | | | | | |
| 53(A) | 3164 | -2290 | -2449 | -2301 | -3900 | -2380 | -2191 | -2516 | 1483 | -3644 | -2906 | -2112 | -2939 | -1904 | -1531 | -1776 | -1904 | -2880 | -3730 | -3462 | 53 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8531 | | | | | | | | | | | | |
| 54(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 54 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8527 | | | | | | | | | | | | |
| 55(V) | 950 | -941 | -2811 | -2248 | -1031 | -2327 | -1422 | -440 | -1962 | 740 | -250 | -1933 | -2494 | -1690 | -1964 | 896 | 1079 | 1807 | -1521 | -1165 | 55 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8524 | | | | | | | | | | | | |
| 56(H) | 659 | -2340 | 1265 | 1241 | -2654 | -1788 | 2240 | -2406 | -89 | -2353 | -1435 | -421 | -1907 | 1509 | -604 | -738 | 910 | -1959 | -2525 | -1836 | 56 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8520 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 57(M) | 905 | -1698 | -4314 | -3724 | -1143 | -3706 | -2623 | 2145 | -3388 | 1126 | 3388 | -3345 | -3578 | -2895 | -3189 | -2841 | -1918 | -295 | -2218 | -2005 | 57 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8516 | | | | | | | | | | | | |
| 58(L) | -3094 | -2629 | -5472 | -5009 | -1335 | -5054 | -4133 | -266 | -4744 | 2900 | -148 | -4850 | -4577 | -3917 | -4430 | -4403 | -3029 | 1404 | -3024 | -3024 | 58 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8512 | | | | | | | | | | | | |
| 59(N) | -1718 | -2924 | -1536 | -943 | -3401 | -2491 | 2272 | -3022 | 67 | -2851 | -2042 | 2480 | -2560 | 1853 | 2240 | -1589 | -1584 | -2659 | -2864 | -2426 | 59 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8508 | | | | | | | | | | | | |
| 60(O) | -1303 | -2782 | -604 | 1957 | -3121 | -2037 | -786 | -2861 | 1397 | -2771 | -1895 | 1587 | -2225 | 2403 | -741 | -1147 | -1246 | -2420 | -2908 | -2240 | 60 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8504 | | | | | | | | | | | | |
| 61(M) | -836 | -1314 | 1097 | -815 | 1234 | -2045 | 2007 | -937 | -682 | -1198 | 2233 | -976 | -2124 | 1369 | -1042 | -1018 | -776 | 996 | -1675 | -1208 | 61 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8500 | | | | | | | | | | | | |
| 62(F) | -1264 | -1055 | -3592 | -2980 | 2448 | 801 | -1770 | 1523 | -2606 | 732 | -96 | -2510 | -2888 | -2223 | -2496 | -1975 | -1207 | 1242 | -1588 | -1251 | 62 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -267 | -7946 | -2622 | -894 | -1115 | -701 | -1378 | -8914 | -8496 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 63(P) | -4031 | -3755 | -4476 | -4814 | -5166 | -3783 | -4422 | -5849 | -5008 | -5560 | -5299 | -4583 | 4287 | -4894 | -4709 | -4316 | -4383 | -5266 | -4354 | -5078 | 63 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7693 | -8735 | -894 | -1115 | -1509 | -624 | -8914 | -8492 | | | | | | | | | | | | |
| 64(E) | -1699 | -3425 | 1700 | 2340 | -3660 | -1960 | -1101 | -3504 | -1077 | -3405 | -2608 | 1773 | -2370 | 2059 | -1764 | -1441 | -1711 | -3013 | -3587 | -2715 | 64 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7693 | -8735 | -894 | -1115 | -358 | -2187 | -8914 | -8488 | | | | | | | | | | | | |
| 65(L) | 891 | -2044 | -4713 | -4184 | -1318 | -4146 | -3223 | 1658 | -3880 | 2504 | -198 | -3858 | -3970 | -3332 | -3681 | -3346 | -2320 | -337 | -2643 | -2499 | 65 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8484 | | | | | | | | | | | | |
| 66(R) | -3030 | -3584 | -3982 | -2344 | -4551 | -3458 | -1269 | -3800 | 2924 | -3397 | -2757 | -2153 | -3376 | -852 | 3034 | -2903 | -2656 | -3598 | -3188 | -3160 | 66 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8480 | | | | | | | | | | | | |
| 67(F) | -2326 | -1891 | -4869 | -4440 | 2685 | -4485 | -3701 | 2340 | -4251 | -921 | -863 | -4124 | -4292 | -3931 | -4198 | -3737 | -2296 | 2290 | -3181 | -2708 | 67 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8476 | | | | | | | | | | | | |
| 68(R) | -3054 | -3592 | -3980 | -2373 | -4560 | -3469 | -1297 | -3823 | 1781 | -3421 | -2785 | -2179 | -3395 | -881 | 3702 | -2930 | -2684 | -3621 | -3206 | -3181 | 68 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8472 | | | | | | | | | | | | |

TABLE 9-continued

| | | | | | | | | | | | | | | | | | | | | |
|---|---|---|---|---|---|---|---|---|---|---|---|---|---|---|---|---|---|---|---|---|
| 69(F) | -3145 | -2644 | -4628 | -4516 | 2787 | -4252 | -1269 | -1824 | -4116 | -1928 | -1754 | -3303 | -4186 | -3281 | -3729 | -3432 | -3069 | 2671 | -580 | 2537 | 69 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8468 | | | | | | | | | | | | |
| 70(V) | -2450 | -1960 | -5111 | -4795 | -2565 | -4880 | -4855 | 1914 | -4732 | -1343 | -1286 | -4581 | -4668 | -4656 | -4868 | -4252 | -2448 | 3379 | -4256 | -3756 | 70 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8464 | | | | | | | | | | | | |
| 71(N) | -1525 | -2287 | -1522 | -1828 | -4053 | -2153 | -2507 | -4149 | -2667 | -4251 | -3455 | 3942 | -2849 | -2311 | -3012 | 1045 | -1898 | -3178 | -4209 | -3651 | 71 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8459 | | | | | | | | | | | | |
| 72(V) | -2838 | -2616 | -4834 | -4880 | -3213 | -3955 | -4416 | -610 | -4757 | -2310 | -2253 | -4383 | -4345 | -4643 | -4642 | -3732 | -3007 | 3763 | -4157 | -3886 | 72 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8455 | | | | | | | | | | | | |
| 73(V) | -2243 | -1824 | -4833 | -4454 | -2402 | -4433 | -4113 | 1762 | -4305 | -1350 | -1201 | -4152 | -4338 | -4160 | -4358 | -3722 | 1258 | 3104 | -3760 | -3307 | 73 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8451 | | | | | | | | | | | | |
| 74(D) | -2668 | -4634 | 3697 | 1529 | -4809 | -2393 | -1860 | -4835 | -2286 | -4663 | -4116 | -996 | -2985 | -1560 | -3281 | -2276 | -2774 | -4274 | -4791 | -3728 | 74 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8447 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 75(L) | -3647 | -3060 | -5937 | -5371 | -1118 | -5682 | -4333 | -610 | -5087 | 3001 | 2533 | -5429 | -4784 | -3925 | -4592 | -5073 | -3493 | -1435 | -2916 | -3081 | 75 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8443 | | | | | | | | | | | | |
| 76(M) | -1722 | -1497 | -3954 | -3355 | -1014 | 848 | -2243 | 1549 | -2997 | 978 | 3830 | -2966 | -3285 | -2560 | -2824 | -2460 | -1661 | -398 | -1947 | -1696 | 76 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8439 | | | | | | | | | | | | |
| 77(K) | -1675 | -2604 | -1914 | -1147 | -3023 | -2553 | -912 | -2542 | 2655 | -2539 | -1775 | -1279 | -2595 | -506 | 1666 | -1628 | 1008 | 985 | -2674 | -2295 | 77 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8435 | | | | | | | | | | | | |
| 78(L) | -4119 | -3542 | -5389 | -5357 | -2027 | -4767 | -4358 | -1609 | -5118 | 3293 | -979 | -5230 | -4771 | -4474 | -4724 | -5069 | -4106 | -2331 | -3412 | -3400 | 78 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8430 | | | | | | | | | | | | |
| 79(O) | -1357 | -2106 | -1510 | -1196 | -2392 | -2243 | -1288 | -2153 | -824 | 371 | -1573 | -1327 | -2535 | 3535 | -1081 | 1033 | -1413 | -1913 | -2627 | -2087 | 79 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8426 | | | | | | | | | | | | |
| 80(P) | -1393 | -2284 | -1577 | -1362 | -3557 | -2164 | -1558 | -3266 | 1432 | -3269 | -2444 | -1443 | 2774 | -1192 | -1186 | 2003 | -1560 | -2262 | -3389 | -2924 | 80 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8422 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 81(K) | -1010 | -2349 | -767 | 1764 | -2657 | -1927 | -589 | -2362 | 1961 | 301 | -1468 | -584 | -2042 | -153 | -523 | 917 | -946 | -1969 | -2533 | -1906 | 81 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8418 | | | | | | | | | | | | |
| 82(H) | -956 | -2424 | -615 | 1087 | -2749 | -1853 | 2292 | -2494 | 2040 | -2432 | -1522 | 1288 | -1978 | -92 | -585 | 753 | -897 | -2050 | -2592 | -1916 | 82 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1873 | -7946 | -474 | -894 | -1115 | -701 | -1378 | -8914 | -8414 | | | | | | | | | | | | |
| 83(G) | -853 | -1186 | -1419 | -1603 | -2565 | 3376 | -1668 | -2627 | -1844 | -2759 | -2200 | -1431 | -1859 | -1709 | -1902 | -1054 | -1192 | -2034 | -2282 | -2387 | 83 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -36 | -6109 | -7151 | -894 | -1115 | -2826 | -219 | -8914 | -8409 | | | | | | | | | | | | |
| 84(A) | 2862 | -488 | -1346 | -1349 | -1807 | -785 | -1257 | -1119 | -1298 | -1627 | -1088 | -934 | -1428 | -1183 | -1403 | -201 | -309 | -714 | -2107 | -1798 | 84 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -36 | -6109 | -7151 | -894 | -1115 | -2826 | -219 | -8914 | -8405 | | | | | | | | | | | | |
| 85(L) | -1446 | -1261 | -2639 | -2396 | -166 | -2529 | -1687 | 443 | -1969 | 2652 | 716 | -2264 | -2607 | -1810 | -1925 | -2083 | -1460 | 71 | -1338 | -963 | 85 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -36 | -6109 | -7151 | -894 | -1115 | -431 | -1952 | -8914 | -8401 | | | | | | | | | | | | |
| 86(E) | -1620 | -3077 | -205 | 2781 | -2713 | -2016 | -1027 | -3107 | -935 | -3054 | -2295 | 1905 | -2376 | -703 | -1502 | -1416 | -1618 | -2704 | -2909 | 1972 | 86 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7696 | -8738 | -894 | -1115 | -1502 | -628 | -8914 | -8397 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 87(H) | -1687 | -3020 | -524 | -508 | -3027 | -2149 | 4043 | -3137 | -478 | -3027 | -2263 | 1907 | -2446 | 2055 | -794 | -1508 | -1649 | -2742 | -2951 | -2237 | 87 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7696 | -8738 | -894 | -1115 | -360 | -2179 | -8914 | -8392 | | | | | | | | | | | | |
| 88(P) | -2450 | -4345 | 1816 | 1516 | -4562 | -2311 | -1714 | -4514 | -2022 | -4375 | -3745 | -914 | 3318 | -1394 | -2920 | -2098 | -2536 | -3971 | -4556 | -3521 | 88 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8388 | | | | | | | | | | | | |
| 89(H) | -2178 | -3297 | -1451 | 1311 | -3729 | -2695 | 4349 | -3419 | -165 | -3210 | -2472 | -1349 | -2852 | -755 | 1705 | -2018 | -2038 | -3087 | -3149 | -2733 | 89 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8384 | | | | | | | | | | | | |
| 90(G) | 1135 | -2508 | -960 | 1390 | -3988 | 2880 | -1982 | -3774 | -2052 | -3851 | -3054 | -1368 | -2715 | -1683 | -2580 | -1591 | -1835 | -3036 | -4050 | -3424 | 90 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8379 | | | | | | | | | | | | |
| 91(M) | -3620 | -3042 | -5906 | -5341 | -1118 | -5639 | -4298 | -608 | -5051 | 2656 | 3645 | -5383 | -4766 | -3909 | -4566 | -5021 | -3469 | -1425 | -2906 | -3062 | 91 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8375 | | | | | | | | | | | | |
| 92(S) | -1385 | -2104 | -1840 | -2115 | -4039 | -2094 | -2642 | -4072 | -2802 | -4207 | -3375 | 1808 | -2809 | -2466 | -3073 | 3255 | -1780 | -3055 | -4205 | -3726 | 92 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8371 | | | | | | | | | | | | |

TABLE 9-continued

| | | | | | | | | | | | | | | | | | | | | |
|---|---|---|---|---|---|---|---|---|---|---|---|---|---|---|---|---|---|---|---|---|
| 93(D) | -2954 | -4081 | 3777 | -1338 | -4930 | -2812 | -2481 | -5106 | -2896 | -4959 | -4423 | -1697 | 1695 | -2236 | -3689 | -2728 | -3134 | -4489 | -4667 | -4137 | 93 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8366 | | | | | | | | | | | | |
| 94(R) | 847 | -2632 | -1132 | 2003 | -3046 | -2175 | -695 | -2716 | 1321 | -2604 | -1741 | -819 | -2258 | -250 | 2101 | -1179 | -1206 | -2313 | -2696 | -2152 | 94 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8362 | | | | | | | | | | | | |
| 95(D) | -2629 | -4604 | 3009 | 2799 | -4770 | -2374 | -1828 | -4782 | -2234 | -4614 | -4051 | -973 | -2960 | -1523 | -3216 | -2241 | -2730 | -4224 | -4757 | -3689 | 95 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8358 | | | | | | | | | | | | |
| 96(F) | -4587 | -3562 | -5019 | -5350 | 4191 | -4887 | -1144 | -3464 | -4916 | -2789 | -2878 | -3547 | -4760 | -3678 | -4301 | -4156 | -4453 | -3634 | -393 | 2478 | 96 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8353 | | | | | | | | | | | | |
| 97(D) | 988 | -3875 | 2907 | 1483 | -4100 | -2208 | -1447 | -3972 | -1539 | -3865 | -3114 | 1567 | -2675 | -1089 | -2294 | -1800 | -2126 | -3467 | -4055 | -3126 | 97 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8349 | | | | | | | | | | | | |
| 98(S) | 1458 | -2457 | 1399 | -292 | -2897 | -1890 | -750 | -2648 | 1311 | -2615 | -1722 | -599 | -2098 | -317 | -922 | 1668 | -1053 | -2187 | -2800 | -2113 | 98 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8344 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 99(L) | -3562 | -3022 | -4998 | -4839 | -384 | -4758 | -2089 | -1358 | -4382 | 2908 | -731 | -3989 | -4502 | -3590 | -4015 | -4103 | -3467 | -1964 | -1321 | 2369 | 99 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8340 | | | | | | | | | | | | |
| 100(F) | -4720 | -3927 | -5139 | -5454 | 4513 | -4504 | -2520 | -3938 | -5326 | -3307 | -3429 | -4469 | -4782 | -4575 | -4818 | -4787 | -4810 | -4172 | -1812 | -736 | 100 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8335 | | | | | | | | | | | | |
| 101(T) | -1345 | -1936 | -3485 | -3748 | -4307 | 1297 | -3469 | -4115 | -3845 | -4377 | -3519 | -2741 | -2493 | -3484 | -3725 | -1588 | 3638 | -3022 | -4411 | -4351 | 101 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8331 | | | | | | | | | | | | |
| 102(P) | 1040 | -1933 | -1444 | -985 | -2825 | -1942 | -1172 | -2498 | 1349 | -2593 | -1749 | -1119 | 2171 | -794 | -1131 | -1051 | 1955 | -2025 | -2847 | -2320 | 102 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7646 | -8988 | -894 | -1115 | -701 | -1378 | -8914 | -8326 | | | | | | | | | | | | |
| 103(D) | -2253 | -3538 | 3694 | -855 | -4532 | -2334 | -2017 | -4570 | -2397 | -4510 | -3869 | -1194 | -2951 | -1736 | -3233 | 1140 | -2471 | -3857 | -4578 | -3695 | 103 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1873 | -7946 | -474 | -894 | -1115 | -701 | -1378 | -8914 | -8322 | | | | | | | | | | | | |
| 104(G) | -853 | -1186 | -1419 | -1603 | -2565 | 3376 | -1668 | -2627 | -1844 | -2759 | -2200 | -1431 | -1859 | -1709 | -1902 | -1054 | -1192 | -2034 | -2282 | -2387 | 104 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -36 | -6109 | -7151 | -894 | -1115 | -133 | -3504 | -8914 | -8317 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 105(K) | -2513 | -3301 | -3024 | -1871 | -4114 | -3126 | -1139 | -3484 | 3142 | -3184 | -2485 | -1825 | -3101 | -717 | 1860 | -2405 | 1288 | -3220 | -3066 | -2911 | 105 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8313 | | | | | | | | | | | | |
| 106(P) | -3125 | -3472 | -2885 | -3107 | -3559 | -3370 | 2901 | -4916 | -3129 | -4732 | -4256 | -3117 | 3925 | -3250 | -3218 | -3230 | -3395 | -4360 | -3686 | -3131 | 106 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8308 | | | | | | | | | | | | |
| 107(V) | -2449 | -1961 | -5107 | -4792 | -2559 | -4869 | -4842 | 1787 | -4726 | -1338 | -1282 | -4575 | -4662 | -4648 | -4859 | -4241 | -2447 | 3416 | -4245 | -3747 | 107 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8304 | | | | | | | | | | | | |
| 108(I) | -2038 | -1784 | -4073 | -3538 | -1026 | -3659 | 2506 | 3064 | -3042 | 1092 | -254 | -3185 | -3570 | -2750 | -2918 | -2809 | -1976 | -421 | -2001 | -1514 | 108 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8299 | | | | | | | | | | | | |
| 109(F) | -4720 | -3927 | -5139 | -5454 | 4513 | -4504 | -2520 | -3938 | -5326 | -3307 | -3429 | -4469 | -4782 | -4575 | -4818 | -4787 | -4810 | -4172 | -1812 | -736 | 109 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8295 | | | | | | | | | | | | |
| 110(N) | 2479 | -1867 | -2193 | -2351 | -4027 | 1237 | -2680 | -3819 | -2833 | -4000 | -3118 | 2632 | -2690 | -2487 | -3076 | -1354 | -1567 | -2811 | -4182 | -3832 | 110 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8290 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 111(Y) | -4612 | -3570 | -5027 | -5365 | 3457 | -4900 | -1135 | -3495 | -4928 | -2816 | -2906 | -3544 | -4767 | -3678 | -4307 | -4162 | -4473 | -3659 | -383 | 3895 | 111 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8988 | -894 | -1115 | -701 | -1378 | -8914 | -8285 | | | | | | | | | | | | |
| 112(H) | -4836 | -4275 | -4356 | -4629 | -3663 | -4242 | 5422 | -5932 | -4492 | -5436 | -5298 | -4579 | -4696 | -4620 | -4352 | -5005 | -5030 | -5648 | -3750 | -3259 | 112 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8281 | | | | | | | | | | | | |
| 113(G) | 1132 | -1656 | -3630 | -3843 | -4215 | 3045 | -3388 | -4017 | -3845 | -4265 | -3324 | -2567 | -2709 | -3385 | -3688 | 1328 | -1497 | -2799 | -4429 | -4315 | 113 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8276 | | | | | | | | | | | | |
| 114(Y) | -4604 | -3569 | -5020 | -5357 | 2093 | -4892 | -1140 | -3492 | -4921 | -2815 | -2905 | -3546 | -4764 | -3679 | -4305 | -4160 | -4468 | -3656 | -389 | 4550 | 114 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8271 | | | | | | | | | | | | |
| 115(P) | 1686 | -1775 | -1257 | 1192 | -2259 | -1996 | -1137 | -1747 | -939 | -2059 | -1306 | -1082 | 2013 | -833 | -1354 | -1109 | -1078 | 1053 | -2490 | -1979 | 115 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8267 | | | | | | | | | | | | |
| 116(W) | -911 | -1979 | 1204 | -354 | -1971 | -1917 | 2044 | -1821 | -260 | -1921 | 2147 | -627 | -2020 | 1682 | -714 | -875 | -851 | -1531 | 3682 | -1476 | 116 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8262 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 117(D) | -1595 | -2205 | 2386 | -1132 | -2251 | -2360 | -1616 | -1668 | -1672 | 1961 | -1361 | -1358 | -2717 | -1399 | -2106 | -1703 | 1087 | -1603 | -2785 | -2280 | 117 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8257 | | | | | | | | | | | | |
| 118(I) | -2533 | -2040 | -5154 | -4770 | -2133 | -4913 | -4501 | 3201 | -4662 | 936 | -891 | -4572 | -4602 | -4354 | -4667 | -4240 | -2507 | 1754 | -3764 | -3470 | 118 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8253 | | | | | | | | | | | | |
| 119(H) | -1221 | -2591 | -1040 | 1217 | -2989 | -2108 | 3064 | -2676 | 1463 | -2566 | -1690 | 1307 | -2192 | -200 | 1508 | -1095 | -1130 | -2261 | -2664 | -2094 | 119 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7946 | -8989 | -894 | -1115 | -701 | -1378 | -8914 | -8248 | | | | | | | | | | | | |
| 120(R) | 862 | -2187 | -859 | -332 | -2662 | 770 | -616 | -2382 | -160 | -2365 | -1469 | -604 | -1998 | 1525 | 1934 | 922 | -871 | -1941 | -2551 | -1920 | 120 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7948 | -8990 | -894 | -1115 | -701 | -1378 | -8914 | -8244 | | | | | | | | | | | | |
| 121(L) | -3417 | -2857 | -5787 | -5262 | -1221 | -5526 | -4333 | 1616 | -5024 | 2930 | -11 | -5255 | -4747 | -3973 | -4603 | -4899 | -3296 | -959 | -2997 | -3107 | 121 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8238 | | | | | | | | | | | | |
| 122(T) | -1746 | -1500 | -4034 | -3432 | 1750 | -3391 | -2252 | 1561 | -3078 | 1096 | -52 | -3017 | -3319 | -2616 | -2884 | -2508 | 2450 | -353 | -1923 | -1630 | 122 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8234 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 123(Y) | -4607 | -3570 | -5022 | -5359 | 2289 | -4894 | -1139 | -3493 | -4923 | -2816 | -2907 | -3546 | -4765 | -3679 | -4305 | -4161 | -4470 | -3658 | -387 | 4501 | 123 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8229 | | | | | | | | | | | | |
| 124(D) | -1348 | -2787 | 2242 | -415 | -3129 | -2090 | 2199 | -2863 | -263 | -2769 | -1903 | -717 | -2264 | 1787 | 2067 | -1197 | -1284 | -2435 | -2889 | -2550 | 124 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8224 | | | | | | | | | | | | |
| 125(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 125 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8219 | | | | | | | | | | | | |
| 126(T) | -900 | -1750 | -1012 | 977 | -1985 | 754 | -770 | 1034 | -516 | -1791 | -1012 | -790 | 1172 | -435 | -956 | -941 | 1779 | -1338 | -2179 | -1644 | 126 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -510 | -7947 | -1783 | -894 | -1115 | -701 | -1378 | -8914 | -8214 | | | | | | | | | | | | |
| 127(N) | -1735 | -2957 | -337 | -503 | -3341 | -2022 | -1191 | -3403 | -833 | -3305 | -2603 | 3506 | -2459 | 2336 | -1181 | -1571 | -1796 | -2939 | -3255 | -2559 | 127 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -17 | -7453 | -8496 | -894 | -1115 | -258 | -2612 | -8914 | -8209 | | | | | | | | | | | | |
| 128(H) | -1956 | -3025 | -776 | -1013 | -3561 | 1155 | 4532 | -2890 | -1721 | -3852 | -3139 | 1561 | -2848 | -1522 | -2169 | -1872 | -2130 | -3302 | -3700 | -2914 | 128 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8205 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 129(D) | -1326 | -2680 | 2762 | -433 | -3190 | 751 | -1003 | -2946 | -718 | -2918 | -2057 | -743 | -2295 | -594 | 1178 | -1205 | 1254 | -2474 | -3108 | -2410 | 129 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8200 | | | | | | | | | | | | |
| 130(N) | -1803 | -2774 | -1319 | -1257 | -3841 | 1092 | -1554 | -3580 | -862 | -3494 | -2719 | 3434 | -2788 | -1187 | 1621 | -1770 | -1905 | -3037 | -3520 | -3054 | 130 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8195 | | | | | | | | | | | | |
| 131(L) | -2659 | -2243 | -5081 | -4521 | 1845 | -4592 | -3494 | 1459 | -4246 | 2227 | -106 | -4254 | -4217 | -3540 | -3970 | -3797 | -2575 | 1425 | -2707 | -2618 | 131 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8190 | | | | | | | | | | | | |
| 132(H) | -1265 | -1465 | -2433 | -2035 | -1445 | -2449 | 3775 | 1372 | -1614 | -1394 | -839 | -1901 | -2701 | -1628 | -1732 | -1623 | 2191 | -807 | -1952 | -1432 | 132 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8185 | | | | | | | | | | | | |
| 133(V) | -2378 | -2013 | -4879 | -4522 | -2020 | -4336 | -3971 | 321 | -4271 | -861 | 2587 | -4174 | -4288 | -3996 | -4221 | -3659 | -2396 | 3344 | -3447 | -3110 | 133 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8180 | | | | | | | | | | | | |
| 134(H) | -1298 | -2431 | -1191 | 1210 | -2723 | -2201 | 3201 | -2373 | -52 | -2378 | -1563 | -884 | -2290 | -333 | 2092 | -1222 | -1207 | 912 | -2555 | -2032 | 134 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8175 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 135(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 135 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8170 | | | | | | | | | | | | |
| 136(Y) | -4791 | -3935 | -4914 | -5231 | -815 | -4530 | -2178 | -4357 | -5024 | -3745 | -3807 | -4206 | -4772 | -4328 | -4584 | -4677 | -4837 | -4435 | -1477 | 4857 | 136 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8165 | | | | | | | | | | | | |
| 137(R) | -2010 | -3025 | -2206 | -1337 | -3603 | -2773 | -965 | -3110 | 2304 | -2910 | 2165 | 1370 | -2777 | -536 | 2519 | -1900 | -1822 | -2804 | -2890 | -2581 | 137 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8160 | | | | | | | | | | | | |
| 138(E) | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 138 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8155 | | | | | | | | | | | | |
| 139(E) | -1541 | -3143 | 1571 | 2510 | -3425 | -2060 | -1020 | -3219 | 1175 | -3136 | -2281 | -669 | -2361 | 1840 | -1368 | -1340 | -1518 | -2751 | -3304 | -2529 | 139 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8150 | | | | | | | | | | | | |
| 140(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 140 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8145 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 141(T) | -1448 | -2786 | 1566 | -494 | -3406 | -2031 | -1186 | -3187 | -1023 | -3164 | -2316 | 1513 | -2396 | -794 | -1603 | 1061 | 2567 | -2675 | -3364 | -2628 | 141 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8140 | | | | | | | | | | | | |
| 142(I) | -1880 | -1845 | -4196 | -3993 | -2337 | -3273 | -3434 | 2845 | -3687 | -1437 | -1287 | -3407 | -3652 | -3527 | -3649 | -2612 | 2766 | 19 | -3410 | -3029 | 142 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8134 | | | | | | | | | | | | |
| 143(T) | -1427 | -2097 | -2121 | -2355 | -3933 | -2165 | -2713 | -3790 | -2759 | -4026 | -3246 | 1603 | -2869 | -2560 | -2943 | -1604 | 3622 | -2931 | -4094 | -3692 | 143 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8129 | | | | | | | | | | | | |
| 144(T) | -2430 | -2823 | -4179 | -4462 | -4591 | -3027 | -4037 | -4454 | -4406 | -4707 | -4191 | -3664 | -3724 | -4237 | -4215 | -2689 | 4010 | -3747 | -4431 | -4588 | 144 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8124 | | | | | | | | | | | | |
| 145(P) | -1505 | -2080 | -3392 | -3633 | -4254 | -2301 | -3425 | -4043 | -3658 | -4296 | -3530 | -2794 | 3850 | -3427 | -3585 | -1744 | 1558 | -3083 | -4340 | -4254 | 145 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8119 | | | | | | | | | | | | |
| 146(F) | -3994 | -3227 | -4915 | -5043 | 3832 | -4698 | -1205 | -2713 | -4616 | -2132 | 2459 | -3492 | -4563 | -3530 | -4094 | -3916 | -3878 | -2950 | -467 | 2613 | 146 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8114 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 147(D) | -2625 | -4424 | 3697 | -649 | -4717 | -2403 | -1898 | -4810 | -2318 | -4653 | -4097 | 1859 | -2997 | -1605 | -3282 | -2269 | -2750 | -4226 | -4723 | -3698 | 147 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8109 | | | | | | | | | | | | |
| 148(M) | -3455 | -2954 | -5636 | -5138 | -1157 | -5278 | -4061 | -621 | -4736 | 1276 | 4790 | -5054 | -4653 | -3832 | -4350 | -4674 | -3346 | -1354 | -2859 | -2873 | 148 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8103 | | | | | | | | | | | | |
| 149(M) | 737 | -1039 | -2128 | -1551 | -1071 | -2251 | -1108 | -553 | -1284 | -925 | 2340 | -1505 | -2347 | -1148 | 1957 | -1292 | 992 | 1190 | -1511 | -1125 | 149 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8098 | | | | | | | | | | | | |
| 150(V) | -1589 | -1340 | -3842 | -3261 | -1369 | -3310 | -2277 | 1533 | -2856 | -783 | 2491 | -2892 | -3292 | -2604 | 1266 | -2434 | -1540 | 2552 | -2138 | -1796 | 150 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8093 | | | | | | | | | | | | |
| 151(C) | -948 | 2699 | -2923 | -2314 | -734 | -2453 | -1287 | -272 | -1969 | 629 | -6 | -1970 | -2503 | 2182 | -1898 | -1524 | -890 | 1281 | -1253 | 1875 | 151 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8087 | | | | | | | | | | | | |
| 152(N) | -1513 | -2274 | -1534 | -1835 | -4051 | -2147 | -2506 | -4137 | -2664 | -4241 | -3442 | 3900 | -2843 | -2309 | -3007 | 1223 | -1886 | -3166 | -4207 | -3653 | 152 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8082 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 153(O) | -1078 | -2597 | 1398 | 1298 | -2904 | 570 | -660 | -2670 | 1137 | -2607 | -1702 | 1544 | -2056 | 1583 | -856 | -929 | -1031 | -2214 | -2776 | -2059 | 153 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8077 | | | | | | | | | | | | |
| 154(M) | -2272 | -1957 | -4590 | -3986 | -1077 | -4004 | -2865 | 1417 | -3652 | -2191 | 2665 | -3646 | -3782 | -3053 | -3407 | -3149 | 1251 | -644 | -2313 | -2179 | 154 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8071 | | | | | | | | | | | | |
| 155(D) | -2253 | -3537 | 3692 | -855 | -4532 | -2333 | -2017 | -4569 | -2396 | -4510 | -3868 | -1194 | -2951 | -1735 | -3232 | 1151 | -2470 | -3856 | -4577 | -3695 | 155 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8066 | | | | | | | | | | | | |
| 156(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 156 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8061 | | | | | | | | | | | | |
| 157(F) | -4608 | -3568 | -5026 | -5363 | 3806 | -4898 | -1136 | -3489 | -4926 | -2811 | -2901 | -3545 | -4766 | -3678 | -4306 | -4161 | -4469 | -3654 | -384 | 3465 | 157 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8055 | | | | | | | | | | | | |
| 158(H) | 1044 | -2139 | -1080 | -861 | -3017 | -1958 | 3956 | -2774 | -984 | -1841 | -1992 | 1421 | -2333 | -887 | -1435 | 909 | -1252 | -2260 | -3059 | -2457 | 158 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8050 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 159(L) | -1995 | -1713 | -4228 | -3647 | -1208 | -3730 | -2645 | 1439 | -3309 | 2122 | -164 | -3321 | -3602 | 1641 | -3161 | -2864 | -1930 | 1443 | -2284 | -2058 | 159 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8044 | | | | | | | | | | | | |
| 160(A) | 2383 | -1556 | -2401 | -2072 | -2208 | -2210 | -1881 | -1266 | -1832 | -1939 | -1334 | -1898 | -2639 | 1793 | -2020 | -1435 | -1318 | 1882 | -2638 | -2245 | 160 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8039 | | | | | | | | | | | | |
| 161(I) | 855 | -2283 | -1296 | -661 | -2565 | -2186 | -701 | 1827 | 1284 | -2220 | -1411 | -884 | -2249 | 1555 | 1499 | -1169 | -1126 | -1886 | -2436 | -1937 | 161 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8033 | | | | | | | | | | | | |
| 162(D) | -1082 | -2449 | 2531 | -267 | -2754 | -1915 | -698 | -2479 | 1332 | -2474 | 2209 | -579 | -2090 | -271 | -827 | 743 | -1039 | -2075 | -2684 | -2016 | 162 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8028 | | | | | | | | | | | | |
| 163(V) | 2572 | -1717 | -4125 | -4110 | -2971 | -2517 | -3473 | -716 | -3875 | -2280 | -1954 | -3032 | -3163 | -3569 | -3746 | -1871 | -1754 | 2604 | -3798 | -3481 | 163 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8022 | | | | | | | | | | | | |
| 164(M) | -2861 | -2402 | -5299 | -4748 | -1283 | -4880 | -3804 | 1499 | -4501 | 2317 | 2674 | -4552 | -4398 | -3712 | -4200 | -4119 | -2770 | 1228 | -2863 | -2864 | 164 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8017 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 165(O) | -2277 | -4157 | 2369 | 2212 | -4337 | -2257 | -1565 | -4246 | -1745 | -4116 | -3418 | -845 | -2768 | 2820 | -2553 | -1949 | -2331 | -3727 | -4303 | -3315 | 165 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8011 | | | | | | | | | | | | |
| 166(W) | -895 | -1130 | -1817 | -1235 | -1105 | -2196 | 2271 | -700 | -958 | 627 | -314 | 1121 | -2263 | -882 | 1030 | -1203 | -832 | 1095 | 2753 | -1082 | 166 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8989 | -894 | -1115 | -701 | -1378 | -8914 | -8006 | | | | | | | | | | | | |
| 167(L) | 894 | -1665 | -4454 | -3932 | -1615 | -3916 | -3023 | 1762 | -3653 | 2037 | -555 | -3656 | -3811 | -3286 | -3532 | -3090 | -1967 | 1475 | -2679 | -2377 | 167 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8990 | -894 | -1115 | -701 | -1378 | -8914 | -8000 | | | | | | | | | | | | |
| 168(P) | -1358 | -1915 | 1378 | -983 | -1290 | -2313 | -1059 | -1560 | -1164 | 599 | -1093 | -1181 | 2573 | -988 | -1557 | -1458 | -1325 | -1413 | -1772 | 2001 | 168 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8990 | -894 | -1115 | -701 | -1378 | -8914 | -7994 | | | | | | | | | | | | |
| 169(H) | 835 | -2044 | -983 | -412 | -2272 | -1961 | 2288 | -1925 | -107 | -2006 | -1181 | -671 | -2047 | 2276 | 1159 | -910 | -883 | 818 | -2280 | -1718 | 169 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8990 | -894 | -1115 | -701 | -1378 | -8914 | -7989 | | | | | | | | | | | | |
| 170(N) | -2018 | -3288 | 1710 | -611 | -3318 | -2277 | -1523 | -3152 | -1621 | 1866 | -2576 | 2651 | -2730 | -1220 | -2271 | -1839 | -2066 | -2863 | -3553 | -2765 | 170 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8990 | -894 | -1115 | -701 | -1378 | -8914 | -7983 | | | | | | | | | | | | |

TABLE 9-continued

| | | | | | | | | | | | | | | | | | | | | |
|---|---|---|---|---|---|---|---|---|---|---|---|---|---|---|---|---|---|---|---|---|
| 171(R) | -1939 | -1994 | -2042 | -1272 | -3636 | 697 | -982 | -3164 | 2274 | -2958 | -2181 | -1388 | 1383 | -551 | 2420 | -1831 | -1784 | -2823 | -2935 | -2603 | 171 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8990 | -894 | -1115 | -701 | -1378 | -8914 | -7977 | | | | | | | | | | | | |
| 172(Y) | -813 | -1780 | -908 | -364 | -1941 | 446 | -570 | -1583 | 1228 | -1731 | -928 | 1199 | -1968 | -200 | -701 | -813 | 1109 | 664 | -2082 | 1675 | 172 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -14 | -7947 | -8990 | -894 | -1115 | -701 | -1378 | -8914 | -7972 | | | | | | | | | | | | |
| 173(V) | 1834 | -1515 | -2997 | -2525 | -2124 | -2365 | -2002 | -972 | -1828 | -1816 | -1242 | -2181 | -2772 | -1966 | 1207 | -1599 | -1390 | 2598 | -2580 | -2228 | 173 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1214 | -7948 | -834 | -894 | -1115 | -701 | -1378 | -8914 | -7966 | | | | | | | | | | | | |
| 174(N) | 2098 | -1102 | -662 | -657 | -2411 | -1122 | -1037 | -2101 | -916 | -2331 | -1548 | 2678 | -1684 | -766 | -1264 | -457 | -604 | -1513 | -2576 | -2006 | 174 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -26 | -6760 | -7802 | -894 | -1115 | -2557 | -269 | -8914 | -7960 | | | | | | | | | | | | |
| 175(O) | -711 | -1121 | -1177 | -831 | -1223 | -1760 | -770 | -238 | -424 | -821 | -384 | -912 | -1989 | 2576 | -639 | -946 | -736 | 2065 | -1698 | -1211 | 175 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -26 | -6760 | -7802 | -894 | -1115 | -2557 | -269 | -8914 | -7954 | | | | | | | | | | | | |
| 176(N) | -707 | -1550 | -295 | -469 | -2883 | 2212 | -1124 | -2747 | -1097 | -2834 | -2065 | 2825 | -1857 | -854 | -1516 | -754 | -965 | -2073 | -2881 | -2341 | 176 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -686 | -6760 | -1453 | -894 | -1115 | -2557 | -269 | -8914 | -7948 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 177(L) | -1446 | -1261 | -2639 | -2396 | -166 | -2529 | -1687 | 443 | -1969 | 2652 | 716 | -2264 | -2607 | -1810 | -1925 | -2083 | -1460 | 71 | -1338 | -963 | 177 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -6111 | -7153 | -894 | -1115 | -435 | -1941 | -8914 | -7943 | | | | | | | | | | | | |
| 178(C) | 1406 | 3275 | -2556 | -2171 | -2790 | 2067 | -1965 | -2431 | -1828 | -2675 | -1880 | -1777 | -2338 | -1781 | 1478 | -1008 | -1091 | -1870 | -3029 | -2681 | 178 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7695 | -8737 | -894 | -1115 | -1509 | -624 | -8914 | -7937 | | | | | | | | | | | | |
| 179(N) | 1616 | -1783 | -884 | -388 | -2121 | -1793 | -600 | -1720 | 1446 | -1882 | -1075 | 1636 | -1951 | -220 | -618 | -795 | -775 | 841 | -2206 | -1651 | 179 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7695 | -8737 | -894 | -1115 | -1509 | -624 | -8914 | -7931 | | | | | | | | | | | | |
| 180(H) | 826 | -2030 | 1249 | -286 | -2281 | -1850 | 2945 | -1963 | -256 | -2046 | 2137 | -570 | -1980 | -190 | -741 | 713 | -829 | -1630 | -2333 | -1721 | 180 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7925 | | | | | | | | | | | | |
| 181(L) | -1888 | -1658 | -4011 | -3398 | 1778 | -3497 | -2279 | 1355 | 1112 | 2128 | 19 | -3057 | -3387 | -2573 | -2834 | -2608 | -1812 | -657 | -1938 | -1655 | 181 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7919 | | | | | | | | | | | | |
| 182(C) | -1582 | 2847 | -3677 | -3112 | -1572 | -3286 | -2308 | 2397 | 1781 | -1057 | -639 | -2820 | -3303 | -2550 | -2691 | -2415 | -1546 | 1459 | -2297 | -1922 | 182 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7913 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 183(O) | 889 | -2895 | 1501 | 1223 | -3185 | -1975 | -867 | -2968 | -610 | -2899 | -2019 | 1640 | -2225 | 2395 | -1182 | -1154 | -1298 | -2505 | -3073 | -2320 | 183 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7907 | | | | | | | | | | | | |
| 184(M) | 624 | -2075 | -807 | 1189 | -2318 | -1853 | -499 | -2000 | 1304 | 56 | 1892 | -530 | -1940 | -75 | 1281 | -778 | -783 | -1655 | -2297 | -1689 | 184 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7901 | | | | | | | | | | | | |
| 185(M) | -2863 | -2466 | -4981 | -4452 | -787 | -4528 | -2772 | -688 | -4077 | 1881 | 3969 | -4038 | -4163 | -3323 | -3759 | -3712 | -2755 | -1286 | -2008 | 2156 | 185 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7895 | | | | | | | | | | | | |
| 186(N) | 889 | -2816 | 1294 | -278 | -3142 | -1979 | -855 | -2912 | 2030 | -2849 | -1972 | 2349 | -2220 | -431 | -1093 | -1140 | -1272 | -2455 | -3022 | -2293 | 186 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7889 | | | | | | | | | | | | |
| 187(W) | -912 | -2365 | 1857 | 1258 | -2669 | -1819 | -525 | -2416 | -128 | -2373 | -1466 | -456 | -1946 | -77 | 1280 | 718 | -855 | -1981 | 2923 | -1868 | 187 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7883 | | | | | | | | | | | | |
| 188(K) | -1038 | -1343 | -1852 | -1266 | 1554 | -2283 | -1007 | -874 | 2350 | -1087 | 2145 | -1336 | -2361 | -894 | -1097 | -1304 | 1178 | -773 | -1689 | -1243 | 188 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7877 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 189(L) | -2298 | -2730 | -2950 | -2003 | -2607 | -3127 | -1308 | -2182 | -152 | 2394 | -1514 | -1955 | -3117 | 1691 | 1757 | -2379 | -2109 | -2248 | -2689 | -2425 | 189 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7870 | | | | | | | | | | | | |
| 190(V) | -1079 | -1178 | -2219 | 953 | -1217 | -2479 | -1279 | 1243 | 1083 | 512 | -362 | -1650 | -2531 | -1279 | -1608 | -1507 | -1021 | 1902 | -1713 | -1318 | 190 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7864 | | | | | | | | | | | | |
| 191(E) | -1354 | -2910 | 1356 | 2455 | -3203 | -1991 | -882 | -2982 | 1322 | -2913 | -2038 | -608 | -2244 | -460 | -1170 | -1178 | 1230 | -2523 | -3086 | -2339 | 191 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7858 | | | | | | | | | | | | |
| 192(H) | 995 | 2611 | -2882 | -2350 | -1156 | -2330 | 3755 | 1388 | -2017 | -1028 | -400 | -2003 | -2551 | -1787 | -2019 | -1469 | -1023 | -451 | -1652 | -1275 | 192 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7852 | | | | | | | | | | | | |
| 193(F) | -873 | -2098 | -751 | 1196 | 2231 | -1853 | -534 | -2026 | -137 | -2078 | -1223 | 1242 | -1958 | -115 | 1091 | -800 | 953 | -1680 | -2329 | -1708 | 193 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7845 | | | | | | | | | | | | |
| 194(O) | 684 | -2845 | -419 | 1349 | -3160 | -1991 | -875 | -2930 | -582 | -2870 | -1997 | 2370 | -2238 | 2528 | -1121 | -1166 | -1300 | -2477 | -3045 | -2315 | 194 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7839 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 195(Y) | -3797 | -3103 | -4834 | -4924 | 2259 | -4579 | -1182 | -2596 | -4505 | -2328 | -2267 | -3426 | -4481 | -3479 | -4016 | -3789 | -3700 | 1231 | -456 | 4130 | 195 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7833 | | | | | | | | | | | | |
| 196(I) | 1842 | -1480 | -3746 | -3421 | -2131 | -2613 | -2685 | 2759 | -3142 | -1622 | -1194 | -2759 | -3062 | -2873 | -3093 | -1882 | 1362 | -243 | -2830 | -2485 | 196 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7827 | | | | | | | | | | | | |
| 197(C) | -917 | 2447 | -2927 | -2307 | -742 | -2421 | -1266 | -267 | -1915 | -627 | 2390 | -1950 | -2475 | -1643 | 1928 | -1495 | -858 | 1278 | -1243 | 1688 | 197 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7820 | | | | | | | | | | | | |
| 198(E) | -2062 | -3846 | 1749 | 2650 | -4068 | -2200 | -1423 | -3938 | -1496 | -3829 | -3070 | 1774 | -2658 | -1061 | -2241 | 835 | -2093 | -3434 | -4016 | -3094 | 198 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7814 | | | | | | | | | | | | |
| 199(H) | -1285 | -2612 | -523 | 1316 | -2833 | -2011 | 3126 | -2579 | -558 | -2606 | -1772 | 2447 | -2236 | -462 | -1057 | -1160 | -1248 | 676 | -2824 | -2144 | 199 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7807 | | | | | | | | | | | | |
| 200(G) | -2654 | -3212 | -2507 | -2588 | -4732 | 3403 | -2707 | -4668 | 1545 | -4548 | -3892 | -2604 | -3567 | -2456 | -2072 | -2733 | -2883 | -4011 | -4170 | -4141 | 200 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7801 | | | | | | | | | | | | |

TABLE 9-continued

| | | | | | | | | | | | | | | | | | | | | | |
|---|---|---|---|---|---|---|---|---|---|---|---|---|---|---|---|---|---|---|---|---|---|
| 201(Y) | -818 | -1798 | 1165 | 976 | -1948 | -1871 | -567 | 748 | -261 | -1738 | -935 | -608 | -1966 | 1445 | -722 | -813 | -758 | 820 | -2091 | 1672 | 201 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7794 | | | | | | | | | | | | |
| 202(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 202 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7788 | | | | | | | | | | | | |
| 203(M) | -2141 | -1848 | -4423 | -3825 | -1086 | -3850 | -2726 | 2359 | -3484 | 1059 | 3290 | -3479 | 1362 | -2946 | -3270 | -2988 | -2066 | -538 | -2251 | -2080 | 203 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7781 | | | | | | | | | | | | |
| 204(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 204 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7775 | | | | | | | | | | | | |
| 205(E) | -2636 | -4572 | 1810 | 3431 | -4760 | -2390 | -1841 | -4772 | -2235 | -4607 | -4040 | -995 | -2973 | -1537 | -3199 | -2253 | -2735 | -4218 | -4733 | -3691 | 205 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8990 | -894 | -1115 | -701 | -1378 | -8914 | -7768 | | | | | | | | | | | | |
| 206(I) | -2944 | -2476 | -5069 | -4784 | 2837 | -4680 | -2731 | 3180 | -4519 | -584 | -703 | -4172 | -4449 | -3817 | -4249 | -3998 | -2901 | -494 | -1967 | -1074 | 206 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8991 | -894 | -1115 | -701 | -1378 | -8914 | -7762 | | | | | | | | | | | | |

TABLE 9-continued

| | | | | | | | | | | | | | | | | | | | | |
|---|---|---|---|---|---|---|---|---|---|---|---|---|---|---|---|---|---|---|---|---|
| 207(T) | -1149 | -1001 | -3245 | -2651 | -830 | -2680 | -1537 | -200 | -2295 | 678 | -115 | -2252 | -2729 | -1967 | -2187 | -1772 | 2521 | 1202 | -1425 | 1941 | 207 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8991 | -894 | -1115 | -701 | -1378 | -8914 | -7755 | | | | | | | | | | | | |
| 208(N) | 968 | -3781 | 2422 | 1475 | -4014 | -2190 | -1399 | -3875 | -1453 | -3773 | -3006 | 2431 | -2639 | -1035 | -2184 | -1745 | -2052 | -3376 | -3962 | -3054 | 208 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8991 | -894 | -1115 | -701 | -1378 | -8914 | -7748 | | | | | | | | | | | | |
| 209(W) | 1214 | -2627 | -4165 | -4274 | -2248 | -2999 | -2977 | -3589 | -3845 | -3575 | -3208 | -3402 | -3626 | -3726 | -3688 | -2549 | -2659 | -3197 | 5855 | -1919 | 209 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7948 | -8991 | -894 | -1115 | -701 | -1378 | -8914 | -7741 | | | | | | | | | | | | |
| 210(V) | -1358 | -2495 | -1397 | -737 | -2853 | -2276 | -735 | -2472 | 1340 | -2436 | -1616 | -951 | 1242 | 1587 | 1414 | -1276 | -1250 | 1808 | -2580 | -2097 | 210 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7949 | -8991 | -894 | -1115 | -701 | -1378 | -8914 | -7735 | | | | | | | | | | | | |
| 211(W) | -3498 | -2927 | -4676 | -4658 | 236 | -4377 | -1183 | -2501 | -4186 | -2296 | -2147 | -3324 | -4322 | -3336 | -3785 | -3580 | -3418 | 1241 | 5352 | 2614 | 211 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7949 | -8991 | -894 | -1115 | -701 | -1378 | -8914 | -7728 | | | | | | | | | | | | |
| 212(H) | -955 | -1646 | -1373 | -926 | 1547 | 635 | 2162 | -1632 | -859 | -1839 | -1087 | -1075 | 2103 | -763 | -1254 | 967 | -98 | -1372 | -2122 | -1543 | 212 |
| - | * | * | * | * | * | * | * | * | * | * | * | * | * | * | * | * | * | * | * | * | |
| - | * | * | * | * | * | * | * | -8914 | 0 | | | | | | | | | | | | |

TABLE 14

HMMER2.0 [2.2g]
NAME PTA_PTB_exp_seqs
LENG 355
ALPH Amino
RF no
CS no
MAP yes
COM /app/public/hmmer/current/bin/hmmbuild PTA_exp_hmm PTA_PTB_exp_seqs.aln
COM /app/public/hmmer/current/bin/hmmcalibrate PTA_exp_hmm
NSEQ 10
DATE Mon Nov 30 18:53:24 2009
CKSUM 2317
XT -8455 -4 -1000 -1000 -8455 -4 -8455 -4
NULT -4 -8455
NULE 595 -1558 85 338 -294 453 -1158 197 249 902 -1085 -142 -21 -313 45 531 201 384 -1998 -644
EVD -321.869965 0.133020

| HMM | A | C | D | E | F | G | H | I | K | L | M | N | P | Q | R | S | Y | V | W | Y | |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | -438 | * | -1933 | | | | | | | | | | | | | | | | | | |
| 1(M) | -1511 | -1258 | -3275 | -2807 | 2269 | -2995 | -1346 | 266 | -2474 | 800 | 3792 | -2446 | -2858 | -1968 | -2335 | -2172 | -1449 | -138 | -793 | -87 | 26 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -23 | -6577 | -7619 | -894 | -1115 | -701 | -1378 | -438 | * | | | | | | | | | | | | |
| 2(M) | 426 | -1446 | -3780 | -3363 | -1521 | -2856 | -2514 | -90 | -3024 | -729 | 4481 | -2828 | -3133 | -2721 | -2939 | -2091 | -1564 | 1100 | -2424 | -2124 | 27 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -10 | -7762 | -8804 | -894 | -1115 | -701 | -1378 | * | * | | | | | | | | | | | | |
| 3(D) | -898 | -2223 | 2613 | -202 | -2512 | -1832 | -557 | -2225 | 779 | -2241 | 1722 | -504 | -1962 | -125 | -678 | 389 | 566 | -1836 | -2468 | -1816 | 28 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 4(L) | -3343 | -2811 | -5687 | -5115 | 2061 | -5345 | -3911 | 1769 | -4867 | 2527 | 56 | -5003 | -4615 | -3800 | -4424 | -4629 | -3207 | -1173 | -2733 | -2675 | 29 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 5(F) | -3039 | -2583 | -5400 | -4800 | 2731 | -4939 | -3665 | 2351 | -4517 | 1482 | 1999 | -4610 | -4383 | -3595 | -4132 | -4161 | -2919 | -1092 | -2663 | -2673 | 30 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 6(E) | -1913 | -3483 | -329 | 3240 | -3847 | -2201 | -1343 | -3669 | -1205 | -3580 | -2799 | -844 | -2614 | 1375 | -1770 | 328 | -1937 | -3187 | -3742 | -2936 | 31 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 7(K) | -892 | -2327 | -754 | -192 | -2667 | -1850 | -472 | -2397 | 1835 | -2332 | -1421 | 831 | -1938 | 1186 | 1037 | 1297 | 497 | -1961 | -2483 | -1835 | 32 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 8(I) | 514 | -1727 | -4577 | -4078 | -1745 | -4080 | -3252 | 2588 | -3824 | 1712 | -655 | -3731 | -3953 | -3476 | -3724 | -3273 | -2060 | 1203 | -2879 | -2568 | 33 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 9(W) | 681 | -1696 | -954 | -400 | 531 | -1888 | -578 | 324 | 1375 | -1628 | -839 | -651 | -1974 | 1030 | 909 | 344 | -741 | -1214 | 2014 | -1462 | 34 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 10(E) | -1665 | -3313 | 1727 | 2676 | -3578 | 225 | -1130 | -3392 | -1004 | -3309 | -2472 | -694 | -2435 | 928 | -1638 | 306 | -1659 | -2915 | -3488 | -2672 | 35 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 11(K) | -1580 | 1884 | -1764 | -1020 | -2907 | -2481 | -845 | -2479 | 1956 | 772 | -1679 | -1179 | -2514 | 1923 | 1777 | -1525 | -1447 | -2203 | -2604 | -2197 | 36 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 12(A) | 2315 | -1624 | -4424 | -3936 | -1894 | -3936 | -3165 | 1771 | -3688 | 61 | -834 | -3585 | -3870 | -3418 | -3634 | -3127 | -1946 | 1865 | -2913 | -2538 | 37 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 13(K) | 240 | -2148 | -1205 | -600 | -2451 | -2088 | -695 | -2066 | 2741 | -2143 | -1331 | -829 | -2179 | -293 | 688 | -1066 | 326 | 519 | -2394 | -1872 | 38 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 14(O) | 251 | -2245 | 585 | -74 | -2564 | 1048 | -408 | -2314 | 875 | -2260 | -1335 | -384 | 515 | 1120 | 955 | 394 | -715 | -1866 | -2429 | -1747 | 39 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 15(D) | 511 | -2241 | 1741 | -132 | -2549 | -1792 | -445 | -2281 | 1286 | 455 | -1337 | -435 | -1886 | 971 | 685 | -711 | -760 | -1857 | -2426 | -1765 | 40 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 16(K) | -884 | -2341 | 1633 | -125 | -2653 | 223 | -507 | -2400 | 1752 | -2356 | -1445 | 919 | 707 | -57 | -629 | -761 | -829 | 80 | -2535 | -1850 | 41 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 17(K) | 535 | -1741 | -1193 | -620 | -1889 | -2043 | -709 | 327 | 2612 | -1654 | -903 | -840 | -2126 | 854 | -679 | -1007 | -888 | 295 | -2069 | -1566 | 42 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 18(K) | -2416 | -3238 | -2867 | -1785 | -4015 | -3059 | -1120 | -3414 | 2580 | -3139 | -2429 | -1764 | -3047 | -698 | 2089 | -2312 | 2234 | -3140 | -3041 | -2859 | 43 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 19(I) | -2521 | -2024 | -5153 | -4783 | -2223 | -4929 | -4595 | 3447 | -4687 | 294 | -972 | -4589 | -4629 | -4430 | -4724 | -4267 | -2498 | 1528 | -3873 | -3540 | 44 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 20(V) | 213 | -1847 | -4873 | -4520 | -2465 | -4420 | -4247 | 1419 | -4388 | -1381 | -1247 | -4198 | -4362 | -4252 | -4452 | -3727 | -2270 | 3336 | -3880 | -3419 | 45 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 21(F) | -3693 | -3087 | -5586 | -5265 | 3261 | -5304 | -2888 | -912 | -4973 | 2381 | -226 | -4694 | -4708 | -3838 | -4472 | -4669 | -3558 | -1678 | -1934 | -1153 | 46 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 22(P) | 1357 | -1977 | -3526 | -3796 | -4305 | -2211 | -3504 | -4098 | -3878 | -4361 | -3542 | -2788 | 3823 | -3529 | -3749 | -1636 | -1847 | -3043 | -4411 | -4353 | 47 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 23(E) | -2645 | -4564 | 1495 | 3508 | -1462 | -2401 | -1853 | -4778 | -2245 | -4613 | -4046 | -1009 | -2982 | -1550 | -3202 | -2265 | -2745 | -4225 | -4728 | -3699 | 48 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 24(G) | 828 | -1562 | -2312 | -1921 | -2620 | 2562 | -1856 | -2263 | -1813 | -2508 | -1731 | -1730 | -2452 | -1660 | -2098 | 554 | 782 | -1818 | -2902 | 1503 | 49 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 25(E) | -1027 | -2214 | -837 | 2256 | -2461 | -1966 | -641 | -2117 | 974 | 634 | -1343 | -652 | -2082 | -229 | -588 | -955 | 1152 | -1790 | -2438 | -1847 | 50 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 26(W) | -150 | 757 | 49 | 299 | -277 | -651 | 839 | -485 | 392 | -910 | 599 | 300 | -401 | 623 | 162 | -99 | 38 | -448 | 1107 | 126 | 51 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 27(D) | -2650 | -4626 | 3535 | 2005 | -4791 | -2383 | -1844 | -4814 | -2264 | -4643 | -4090 | -983 | -2972 | -1542 | -3255 | -2259 | -2754 | -4254 | -4780 | -3711 | 52 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 28(E) | -884 | -1962 | -861 | 2360 | -2149 | -1901 | -576 | 272 | 764 | -268 | -1086 | -611 | 909 | -182 | -632 | 849 | -822 | -1489 | -2226 | -1648 | 53 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 29(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 54 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 30(V) | -1615 | -1406 | -3692 | -3190 | -1680 | -3315 | -2460 | 2105 | -2933 | -1136 | -730 | 1527 | -3366 | -2700 | -2939 | -2463 | 576 | 2489 | -2439 | -2054 | 55 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 31(L) | -2893 | -2389 | -5409 | -4931 | -1519 | -5116 | -4253 | 2238 | -4753 | 2516 | -300 | -4794 | -4601 | -4030 | -4524 | -4423 | -2823 | 819 | -3207 | -3187 | 56 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 32(K) | -810 | -2256 | -666 | 736 | -2577 | 491 | -428 | 19 | 1965 | -2266 | -1348 | -419 | -1872 | 1176 | 702 | 323 | -747 | -1879 | -2434 | -1767 | 57 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 33(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 58 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 34(A) | 2937 | -1528 | -3502 | -3308 | -3125 | -1952 | -2769 | -2630 | -3081 | -3039 | -2271 | -2390 | -2643 | -2779 | -3078 | 549 | 1011 | 493 | -3475 | -3206 | 59 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 35(H) | 804 | -2234 | 624 | 1374 | -2527 | -1779 | 1863 | 180 | -65 | -2239 | -1335 | -424 | -1886 | -14 | -572 | 1383 | -764 | -1842 | -2435 | -1765 | 60 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 36(K) | -927 | -1951 | -1003 | 613 | -2143 | -1960 | -589 | 446 | 1801 | -1893 | 1449 | -680 | -2039 | -201 | 1687 | -903 | -856 | -1504 | -2198 | 1303 | 61 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 37(I) | -3179 | -2647 | -5611 | -5124 | -1356 | -5341 | -4317 | 2901 | -4907 | 2264 | -148 | -5052 | -4698 | -4019 | -4582 | -4697 | -3088 | -546 | -3099 | -3137 | 62 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 38(I) | 1305 | -916 | -2346 | -1758 | -894 | -2325 | -1140 | 1372 | 98 | 911 | -104 | -1638 | -2383 | 1135 | -1607 | -1364 | -839 | 747 | -1366 | -994 | 63 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 39(K) | 103 | -2280 | -655 | 781 | -2607 | -33 | -431 | -2352 | 2090 | -2292 | -1371 | 817 | -1875 | 1393 | 703 | -967 | -754 | -1906 | -2454 | -1782 | 64 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 40(D) | -876 | -2355 | 1990 | 1398 | -2673 | -1797 | -489 | -2425 | 861 | -2368 | -1450 | 862 | -1916 | -35 | 739 | -749 | -818 | -1976 | -2535 | 1245 | 65 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 41(G) | -1910 | -3521 | 1036 | -459 | -3833 | 2939 | -1305 | -3641 | 669 | -3546 | -2760 | -819 | -2598 | 922 | -1710 | -1672 | -1918 | -3170 | -3710 | -2907 | 66 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 42(L) | -2752 | -2316 | -5181 | -4626 | 1316 | -4723 | -3629 | 2215 | -4364 | 2228 | -104 | -4388 | -4302 | -3622 | -4077 | -3942 | -2665 | 822 | -2775 | -2716 | 67 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 43(A) | 2595 | -1592 | -4065 | -3655 | -1874 | -3190 | -2875 | 69 | -3364 | 237 | -870 | -3140 | -3438 | -3084 | -3305 | -2430 | -1771 | 2003 | -2788 | -2442 | 68 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 44(K) | -781 | -2248 | 1290 | 1182 | -2566 | -1751 | -412 | -18 | 1303 | -2262 | -1338 | 836 | -1846 | 47 | 956 | -662 | 674 | -1869 | -2432 | -1751 | 69 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 45(P) | -1999 | -1685 | -4334 | -3818 | -1612 | -3852 | -2976 | 1828 | -3535 | 394 | -557 | -3486 | 3050 | -3199 | -3450 | -3026 | -1964 | 1176 | -2676 | -2369 | 70 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 46(V) | -2542 | -1958 | -5119 | -4802 | -2578 | -4903 | -4884 | 2288 | -4745 | -1352 | -1293 | -4595 | -4680 | -4675 | -4887 | -4275 | -2449 | 3237 | -4279 | -3776 | 71 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 47(L) | -2998 | -2538 | -5403 | -4947 | -1395 | -4989 | -4115 | -173 | -4693 | 2765 | -209 | -4769 | -4551 | -3928 | -4414 | -4328 | -2940 | 1827 | -3062 | -3033 | 72 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 48(V) | -2510 | -2021 | -5126 | -4737 | -2130 | -4872 | -4437 | 1947 | -4622 | 1286 | -893 | -4529 | -4574 | -4319 | -4624 | -4190 | -2483 | 2866 | -3732 | -3431 | 73 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 49(G) | 931 | -1908 | -3564 | -3879 | -4400 | 3463 | -3561 | -4237 | -4052 | -4490 | -3601 | -2764 | -2927 | -3600 | -3877 | -1557 | -1777 | -3055 | -4501 | -4478 | 74 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 50(N) | 91 | -2861 | 975 | -587 | -3637 | -2069 | -1361 | -3439 | -1272 | -3412 | -2579 | 2972 | -2496 | -985 | -1877 | 1896 | -1654 | -2876 | -3606 | -2851 | 75 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 51(E) | -1387 | -2840 | -463 | 2722 | -3195 | -2028 | -944 | -2952 | -645 | -2907 | -2050 | -684 | 1763 | 936 | -1162 | -1231 | 313 | -2508 | -3091 | -2377 | 76 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 52(N) | 1378 | -2248 | 457 | 624 | 806 | -1762 | -434 | -2299 | 865 | -2258 | -1342 | 1494 | -1863 | 20 | -534 | 341 | -740 | -1863 | -2438 | -1760 | 77 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 53(E) | 975 | -2349 | 734 | 2085 | -2655 | -1807 | -516 | -2399 | 1272 | -2359 | -1451 | -445 | -1934 | -67 | -640 | -772 | -840 | 10 | -2541 | -1856 | 78 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 54(I) | -2526 | -2030 | -5153 | -4776 | -2181 | -4921 | -4549 | 3338 | -4675 | 616 | -934 | -4580 | -4616 | -4394 | -4697 | -4253 | -2501 | 1644 | -3821 | -3507 | 79 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 55(K) | 398 | -2606 | -1173 | 479 | -3022 | -2165 | -660 | -2692 | 2540 | -2573 | -1705 | -805 | -2232 | 1750 | 1236 | -1146 | -1168 | -2286 | -2659 | -2117 | 80 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 56(E) | 1257 | -2318 | -622 | 1753 | -2641 | -1799 | -475 | -2386 | 1275 | -2333 | -1417 | -437 | -1908 | 1398 | -542 | 391 | -801 | -1943 | -2501 | -1824 | 81 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 57(F) | 471 | -982 | -1994 | -1417 | 1160 | -2213 | -1003 | -523 | 1101 | 784 | -172 | 584 | -2279 | -1043 | -1416 | -1230 | 532 | 1019 | -1408 | -1017 | 82 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 58(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 83 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 59(K) | 252 | -2225 | 594 | -101 | -2531 | 1206 | -438 | -2270 | 1451 | -150 | -1326 | 673 | -1865 | 14 | -536 | 340 | -739 | -1841 | -2425 | -1752 | 84 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -299 | -7942 | -2449 | -894 | -1115 | -701 | -1378 | * | * | | | | | | | | | | | | |
| 60(E) | 1167 | -2286 | 732 | 1831 | -2598 | -1667 | -407 | -2354 | 951 | -2301 | -1391 | -300 | -1816 | 40 | -560 | 783 | -749 | -1906 | -2475 | -1775 | 85 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7654 | -8696 | -894 | -1115 | -1585 | -585 | * | * | | | | | | | | | | | | |
| 61(H) | -815 | -727 | -2621 | -2031 | 1145 | -2289 | 2094 | -200 | -1722 | 1681 | 107 | 494 | -2340 | -1435 | -1697 | -1354 | -755 | 1054 | -1030 | -564 | 86 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -11 | -7654 | -8696 | -894 | -1115 | -337 | -2262 | * | * | | | | | | | | | | | | |
| 62(N) | -1704 | -3281 | 1777 | -397 | -3622 | 1646 | -1188 | -3429 | -1036 | -3352 | -2526 | 2598 | -2480 | -796 | 1047 | -1495 | -1710 | -2949 | -3526 | -2731 | 87 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 63(M) | 20 | -1214 | -3805 | -3190 | 774 | -3078 | -1973 | 1042 | -2815 | 1458 | 2157 | -2723 | -3056 | -2395 | -2615 | -2183 | -1382 | 1944 | -1731 | -1436 | 88 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 64(D) | 605 | -2467 | 2563 | -401 | -3040 | -1918 | -912 | -2798 | -624 | -2777 | -1892 | 929 | -2187 | -492 | -1157 | 1186 | 553 | -2307 | -2970 | -2279 | 89 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 65(L) | -3447 | -2885 | -5829 | -5243 | -1145 | -5544 | -4253 | 1795 | -5014 | 2666 | 2377 | -5248 | -4707 | -3887 | -4549 | -4864 | -3303 | -1162 | -2916 | -3088 | 90 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 66(D) | 250 | -2410 | 1559 | 1458 | -2748 | 39 | -576 | -2502 | -207 | -2454 | -1544 | -475 | -1976 | -130 | -729 | 1014 | 986 | -2052 | -2631 | -1936 | 91 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 67(G) | -2653 | -3216 | -2503 | -2570 | -4722 | 3367 | -2672 | -4647 | 1672 | -4521 | -3864 | -2587 | -3560 | -2414 | -2013 | -2728 | -2874 | -3999 | -4152 | -4117 | 92 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 68(V) | 1628 | -1694 | -4600 | -4141 | -2065 | -4161 | -3476 | 2051 | -3925 | 24 | -959 | -3809 | -4058 | -3687 | -3896 | -3377 | -2060 | 2431 | -3181 | -2784 | 93 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 69(O) | -1107 | -2491 | -869 | 2104 | -2843 | -2005 | -610 | -2548 | 1501 | -2474 | 1449 | -645 | -2106 | 2280 | -390 | -986 | -1031 | -2135 | -2613 | -2004 | 94 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 70(I) | -2462 | -1971 | -5120 | -4803 | -2532 | -4890 | -4848 | 3484 | -4737 | -1301 | -1256 | -4591 | -4671 | -4645 | -4865 | -4262 | -2459 | 1950 | -4227 | -3745 | 95 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 71(V) | -1021 | -845 | -3291 | 115 | -783 | -2586 | -1463 | 1772 | -2289 | 711 | 1731 | -2204 | -2623 | -1926 | -2122 | -1672 | -963 | 1810 | -1336 | 1149 | 96 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 72(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 97 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 73(P) | -1143 | -1675 | -3005 | -2989 | -3065 | -2064 | -2700 | 565 | -2869 | -2950 | -2300 | -2338 | 3698 | -2683 | -2908 | 587 | -1504 | -2001 | -3467 | -3104 | 98 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 74(H) | 1253 | -2202 | -717 | 1654 | -2478 | -1838 | 2550 | -2187 | 868 | -372 | -1310 | -496 | -1938 | -63 | -532 | -776 | -809 | -1802 | -2405 | -1767 | 99 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 75(T) | -1143 | -1868 | -2054 | -2081 | -3765 | -1965 | -2374 | -3533 | -2354 | -3699 | -2834 | 2518 | -2626 | -2132 | -2643 | 882 | 2968 | -2663 | -3905 | -3493 | 100 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | |
|---|---|---|---|---|---|---|---|---|---|---|---|---|---|---|---|---|---|---|---|---|
| 76(Y) | -1148 | -1566 | -1831 | -1449 | -1231 | -2241 | -1207 | -1418 | -1361 | -1676 | -1002 | 1156 | -2489 | -1227 | -1649 | 1580 | -1191 | 429 | -1711 | 3317 | 101 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 77(W) | -150 | 757 | 49 | 299 | -277 | -651 | 839 | -485 | 392 | -910 | 599 | 300 | -401 | 623 | 162 | -99 | 38 | -448 | 1107 | 126 | 102 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 78(E) | -1130 | -2548 | 993 | 1837 | -2823 | -1914 | -731 | -2562 | -425 | 645 | -1679 | -557 | 1649 | -306 | -961 | 330 | -1088 | -2151 | -2765 | -2070 | 103 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 79(K) | 705 | -2293 | -914 | -357 | -2734 | 819 | -598 | -2445 | 2189 | -2399 | -1507 | -628 | -2037 | -153 | 975 | 617 | -923 | -2013 | -2558 | -1945 | 104 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1567 | -7942 | -603 | -894 | -1115 | -701 | -1378 | * | * | | | | | | | | | | | | |
| 80(E) | -1455 | -2350 | 50 | 3362 | -2809 | -1547 | -927 | -2700 | -45 | -2735 | -2178 | -487 | -2000 | -660 | -1278 | -1311 | -1525 | -2365 | -2625 | -2220 | 105 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -26 | -6400 | -7442 | -894 | -1115 | -1808 | -485 | * | * | | | | | | | | | | | | |
| 81(M) | -551 | -928 | 1713 | -589 | -942 | -1741 | -615 | 5 | -559 | -521 | 2643 | -741 | -1867 | -429 | -905 | -804 | -519 | 1266 | -1450 | -997 | 106 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -19 | -6823 | -7865 | -894 | -1115 | -167 | -3194 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 82(K) | -936 | -1587 | -1304 | -718 | -1678 | -2068 | -727 | -1273 | 1622 | -91 | 1465 | -909 | -2141 | -440 | 1553 | -1037 | 1209 | -1083 | -1910 | 1220 | 107 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 83(O) | 216 | -3288 | 1080 | 1963 | -3557 | -2088 | -1124 | -3366 | -985 | -3287 | -2450 | -697 | -2432 | 3156 | -1608 | -1439 | -1648 | -2893 | -3467 | -2658 | 108 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 84(E) | 661 | -2268 | 1307 | 1400 | -2586 | -40 | -425 | -2337 | -12 | -2283 | -1359 | -392 | -1857 | 1107 | 956 | -675 | 492 | -1889 | -2452 | -1768 | 109 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 85(M) | -2903 | -2473 | -4675 | -4372 | 1750 | -4229 | -1624 | -1350 | -3989 | 445 | 3626 | -3447 | -4067 | -3192 | -3628 | -3390 | -2808 | -1716 | -937 | 3375 | 110 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 86(A) | 1907 | -908 | -3172 | -2568 | -899 | -2621 | 1244 | 994 | -2224 | 146 | -105 | -2185 | -2665 | -1906 | -2124 | -1705 | -1008 | 1900 | -1447 | -1095 | 111 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 87(O) | -1463 | -3014 | 2011 | -328 | -3316 | -2053 | -949 | -3092 | -641 | -3010 | -2150 | 2270 | -2319 | 2525 | 696 | -1279 | -1430 | -2636 | -3169 | -2433 | 112 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 88(A) | 2248 | -2123 | 670 | -520 | -2701 | -1892 | -856 | -2400 | -496 | -2451 | 1589 | -769 | -2126 | -446 | 1017 | -948 | 1463 | -1971 | -2692 | -2080 | 113 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 89(F) | -2727 | -2338 | -4825 | -4352 | 3286 | -4296 | -2265 | 816 | -3996 | 1550 | -226 | -3736 | -4033 | -3222 | -3652 | -3458 | -2628 | -1306 | 3005 | -774 | 114 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 90(Y) | -2126 | -1823 | -4287 | -3802 | -723 | -3742 | -2094 | -327 | -3430 | 1159 | -480 | -3251 | -3663 | -2945 | -3227 | -2891 | -2068 | 2283 | -1586 | 3201 | 115 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 91(E) | 703 | -3188 | -772 | 3501 | -4265 | -2379 | -2017 | -4040 | -2108 | -4114 | -3438 | -1356 | -2948 | -1721 | -2684 | -2006 | -2303 | -3449 | -4241 | -3565 | 116 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 92(R) | -2413 | -2234 | -4171 | -3369 | -1308 | -3884 | -2460 | 877 | -2018 | 2018 | -224 | -3190 | -3714 | -2356 | 2764 | -3076 | -2310 | -961 | -2462 | -2283 | 117 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 93(R) | 738 | -2612 | -3347 | -2738 | -4144 | -2736 | -2052 | -3768 | -900 | -3705 | -3029 | -2409 | -3189 | -1725 | 3817 | -2171 | -2228 | -3209 | -3627 | -3498 | 118 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 94(K) | 503 | -2445 | -1015 | -703 | -3184 | 562 | -1018 | -2893 | 2978 | -2852 | -1992 | 704 | -2331 | -602 | -835 | -1206 | -1297 | -2406 | -2999 | -2416 | 119 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 95(H) | -928 | -2405 | -563 | 997 | -2720 | 1543 | 2401 | -2472 | 959 | -2417 | -1504 | 868 | -1955 | -84 | -643 | 392 | -872 | -2026 | -2586 | -1897 | 120 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 96(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 121 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -809 | -7942 | -1234 | -894 | -1115 | -701 | -1378 | * | * | | | | | | | | | | | | |
| 97(G) | -2666 | -2751 | -3377 | -3700 | -4393 | 3753 | -3528 | -4841 | -4031 | -4741 | -4286 | -3394 | -3411 | -3824 | -3848 | -2912 | -3053 | -4080 | -3719 | -4290 | 122 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7148 | -8190 | -894 | -1115 | -541 | -1677 | * | * | | | | | | | | | | | | |
| 98(M) | 412 | -754 | -2560 | -1966 | -741 | -2291 | -1150 | 981 | -1684 | -598 | 3179 | 1245 | -2352 | -1421 | -1700 | -1351 | 649 | 877 | -1235 | -874 | 123 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -10 | -7762 | -8804 | -894 | -1115 | -413 | -2007 | * | * | | | | | | | | | | | | |
| 99(T) | -2430 | -2823 | -4179 | -4462 | -4591 | -3027 | -4037 | -4454 | -4406 | -4707 | -4191 | -3664 | -3724 | -4237 | -4215 | -2689 | 4010 | -3747 | -4431 | -4588 | 124 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 100(P) | 270 | -1065 | -2103 | 243 | -1059 | -2317 | -1151 | 1403 | -1372 | 790 | -240 | -1539 | 2257 | -1198 | -1557 | -1358 | -904 | -375 | -1531 | -1145 | 125 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 101(E) | -2392 | -4275 | 1163 | 3312 | -4486 | -2295 | -1667 | -4423 | -1934 | -4288 | -3633 | -894 | 1125 | -1341 | -2802 | -2049 | -2468 | -3888 | -4470 | -3454 | 126 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 102(O) | 297 | -2471 | 1012 | -160 | -2788 | -1849 | -577 | -2543 | 1870 | -2482 | -1573 | 944 | -1994 | 2462 | -693 | -848 | -930 | -2093 | -2649 | -1955 | 127 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 103(A) | 3227 | -1594 | -3807 | -3849 | -3646 | -1945 | -3198 | -3067 | -3621 | -3576 | -2783 | -2572 | -2704 | -3241 | -3481 | 576 | -1455 | 241 | -3977 | -3799 | 128 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 104(D) | 1261 | -2267 | 1791 | 738 | -2557 | -1813 | -517 | -2280 | -130 | -2273 | -1380 | -464 | -1934 | -76 | 1383 | -771 | -825 | 386 | -2479 | -1813 | 129 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 105(K) | 415 | -2546 | -735 | 1917 | -2896 | -1973 | -635 | -2621 | 2122 | -2543 | -1653 | -608 | -2101 | 1705 | -517 | -981 | -1047 | -2189 | -2683 | -2042 | 130 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 106(M) | 308 | -827 | -2563 | -1964 | -795 | -2335 | -1167 | 1419 | 607 | -677 | 2765 | -1747 | -2393 | -1425 | -1700 | -1388 | 1409 | -241 | 2166 | -912 | 131 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 107(M) | -2838 | -2385 | -5273 | -4720 | -1280 | -4846 | -3769 | 1119 | -4469 | 2241 | 2938 | -4517 | -4377 | -3690 | -4172 | -4080 | -2748 | 1487 | -2847 | -2840 | 132 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 108(K) | -1031 | -2407 | -918 | 1080 | -2761 | -1972 | -550 | -2464 | 1949 | -434 | -1505 | -616 | -2053 | -100 | 1475 | 1180 | -952 | -2050 | -2533 | -1929 | 133 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -169 | -3204 | -8984 | -206 | -2913 | -701 | -1378 | * | * | | | | | | | | | | | | |
| 109(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 135 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 110(P) | -893 | 2081 | -1781 | 940 | -1121 | -2183 | -978 | 444 | -1070 | -1013 | -334 | -1295 | 2567 | -933 | -1326 | -1202 | -842 | -568 | -1538 | 1138 | 136 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 111(N) | -1006 | -16 | -2854 | -2266 | -891 | -2503 | -1385 | 865 | -1966 | 1747 | -97 | 1859 | -2563 | -1688 | -1947 | -70 | -954 | 854 | -1419 | -1063 | 137 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 112(Y) | -4083 | -3282 | -4926 | -5082 | 1832 | -4728 | -1188 | -2828 | -4652 | -2243 | 2245 | -3495 | -4595 | -3549 | -4122 | -3951 | -3965 | -3052 | -449 | 4351 | 138 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 113(F) | -4576 | -3559 | -5015 | -5343 | 4263 | -4881 | -1152 | -3449 | -4910 | -2776 | -2865 | -3550 | -4757 | -3679 | -4300 | -4154 | -4444 | -3622 | -401 | 2124 | 139 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 114(G) | 2612 | -1827 | -3654 | -3943 | -4336 | 2661 | -3533 | -4149 | -4027 | -4411 | -3508 | -2727 | -2864 | -3570 | -3838 | -1474 | -1691 | -2967 | -4475 | -4432 | 140 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 115(T) | 1598 | -1522 | -3726 | -3555 | -2787 | -2149 | -2868 | -1443 | -3288 | -2470 | -1892 | -2585 | -2799 | -2974 | -3213 | -1463 | 2927 | 1522 | -3313 | -3022 | 141 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 116(M) | 845 | -1514 | -3507 | -3305 | -2427 | -2152 | -2615 | -1675 | -2968 | -2025 | 4655 | -2481 | -2760 | -2728 | -2908 | -1457 | 695 | -1444 | -2989 | -2699 | 142 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 117(M) | 103 | -2295 | -4810 | -4261 | -1123 | -4222 | -3233 | -505 | -3905 | 1982 | 4088 | -3963 | -4004 | -3263 | -3656 | -3428 | -2527 | -1018 | -2542 | -2485 | 143 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | |
|---|---|---|---|---|---|---|---|---|---|---|---|---|---|---|---|---|---|---|---|---|
| 118(V) | 249 | -1764 | -4559 | -4171 | -2124 | -3892 | -3557 | 400 | -3936 | 216 | -1010 | -3749 | -3970 | -3700 | -3906 | -3157 | -2087 | 3302 | -3297 | -2917 | 144 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 119(Y) | -1748 | -2787 | -1867 | -1117 | -3134 | -2580 | -896 | -2823 | 2430 | -2708 | -1928 | -1262 | -2616 | -482 | 1298 | 588 | -1603 | -2513 | -2720 | 2852 | 145 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 120(M) | 543 | -1502 | 454 | -655 | -1569 | -2005 | -725 | -1152 | 1280 | 1097 | 2617 | -860 | -2092 | -451 | -910 | -972 | -801 | -975 | -1856 | -1371 | 146 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 121(G) | -2913 | -3668 | 945 | -1911 | -5049 | 3566 | -2931 | -5265 | -3381 | -5155 | -4587 | -2191 | -3583 | -2748 | -4001 | -2853 | -3188 | -4499 | -4671 | -4461 | 147 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 122(E) | 418 | -2234 | 1260 | 1822 | -2533 | -1769 | -443 | -2271 | 1177 | -485 | -1330 | -412 | -1871 | 9 | -542 | -693 | -747 | -1845 | -2428 | 811 | 148 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 123(V) | 2475 | -1721 | -4141 | -4120 | -2951 | -2548 | -3488 | -657 | -3886 | -2245 | -1927 | -3055 | -3187 | -3584 | -3760 | -1902 | -1766 | 2703 | -3796 | -3475 | 149 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 124(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 150 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 125(G) | -1595 | -2107 | -3720 | -3963 | -3970 | 3471 | -3570 | -3119 | -3981 | -3886 | -3293 | -2985 | -3155 | -3665 | -3837 | -1865 | -2027 | 946 | -4215 | -4068 | 151 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 126(M) | -2025 | 2478 | -4388 | -3797 | -1130 | -3739 | -2667 | -158 | -3453 | 1208 | 4105 | -3402 | -3608 | -2937 | -3236 | -2881 | -1961 | 880 | -2231 | -2028 | 152 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 127(W) | -150 | 757 | 49 | 299 | -277 | -651 | 839 | -485 | 392 | -910 | 599 | 300 | -401 | 623 | 162 | -99 | 38 | -448 | 1107 | 126 | 153 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 128(V) | -2447 | -1962 | -5103 | -4789 | -2553 | -4857 | -4827 | 1666 | -4719 | -1334 | -1279 | -4568 | -4656 | -4638 | -4849 | -4228 | -2447 | 3448 | -4233 | -3737 | 154 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 129(S) | 2131 | -1670 | -3692 | -3910 | -4174 | -1935 | -3404 | -3963 | -3845 | -4238 | -3317 | -2599 | -2728 | -3415 | -3673 | 2964 | -1517 | -2788 | -4397 | -4269 | 155 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 130(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 156 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 131(A) | 3075 | -1760 | -2603 | -2695 | -3957 | -1941 | -2800 | -3736 | -2952 | -3942 | -3051 | 1370 | -2670 | -2640 | -3110 | 792 | -1502 | -2723 | -4139 | -3839 | 157 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 132(V) | 1970 | -1618 | -4439 | -3946 | -1865 | -3942 | -3147 | 1777 | -3693 | 528 | -807 | -3588 | -3866 | -3412 | -3626 | -3130 | -1942 | 2096 | -2880 | -2511 | 158 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 133(H) | -1102 | 2379 | -1738 | -1466 | -2663 | -2010 | 4358 | -2506 | -1383 | -2678 | -1892 | 969 | -2465 | -1337 | -1706 | 783 | -1293 | -2046 | -2891 | -2346 | 159 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 134(S) | 419 | -1643 | -3250 | -3104 | -3814 | -1905 | -2857 | -3555 | -2981 | -3781 | -2885 | -2311 | 2298 | -2716 | -3080 | 2397 | 1614 | -2583 | -4014 | -3764 | 160 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 135(T) | -1102 | -1714 | -3480 | -3700 | -4076 | -1973 | -3311 | -3843 | -3648 | -4140 | -3265 | -2565 | -2755 | -3310 | -3525 | 656 | 3729 | -2765 | -4307 | -4127 | 161 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 136(G) | 2443 | -1650 | -3680 | -3879 | -4195 | 2494 | -3389 | -3992 | -3844 | -4243 | -3304 | -2574 | -2707 | -3388 | -3682 | 672 | -1492 | -2786 | -4412 | -4299 | 162 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 137(D) | -2610 | -4414 | 3375 | -640 | -4704 | -2395 | -1885 | -4787 | -2296 | -4632 | -4069 | 2731 | -2988 | -1589 | -3253 | -2255 | -2733 | -4206 | -4710 | -3683 | 163 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 138(T) | -1802 | -1610 | -4107 | -3628 | -1625 | -3434 | -2777 | 121 | -3310 | 979 | -612 | -3213 | -3529 | -3008 | -3231 | -2634 | 2771 | 1888 | -2588 | -2269 | 164 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 139(L) | -2900 | -2445 | -5330 | -4886 | -1470 | -4921 | -4106 | -73 | -4643 | 2578 | -286 | -4689 | -4527 | -3948 | -4403 | -4253 | -2850 | 2224 | -3114 | -3047 | 165 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 140(R) | -4488 | -4181 | -4789 | -4318 | -5193 | -4148 | -3436 | -5568 | -2393 | -5152 | -4748 | -4156 | -4476 | -3286 | 4202 | -4614 | -4467 | -5273 | -4267 | -4649 | 166 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 141(P) | 1695 | -1951 | -3539 | -3802 | -4288 | -2189 | -3492 | -4075 | -3870 | -4341 | -3515 | -2772 | 3709 | -3517 | -3739 | -1609 | -1819 | -3017 | -4404 | -4341 | 167 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 142(A) | 2997 | -1820 | -3672 | -3957 | -4327 | 2092 | -3531 | -4137 | -4026 | -4400 | -3498 | -2726 | -2859 | -3569 | -3834 | -1467 | -1684 | -2957 | -4469 | -4425 | 168 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 143(L) | -3221 | -2748 | -5558 | -5092 | -1274 | -5134 | -4164 | -386 | -4812 | 3030 | -86 | -4956 | -4613 | -3913 | -4456 | -4503 | -3148 | 772 | -2987 | -3018 | 169 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 144(O) | -2871 | -3512 | -2899 | -2161 | -4235 | -3278 | -1502 | -3869 | -191 | -3535 | -2901 | -2118 | -3368 | 4099 | 1519 | -2774 | -2657 | -3608 | -3317 | -3159 | 170 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 145(I) | -2460 | -1967 | -5122 | -4804 | -2546 | -4899 | -4864 | 3420 | -4742 | -1315 | -1266 | -4595 | -4676 | -4657 | -4875 | -4271 | -2457 | 2106 | -4245 | -3757 | 171 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 146(I) | -2482 | -1984 | -5127 | -4768 | -2335 | -4912 | -4643 | 3097 | -4684 | 313 | -1075 | -4568 | -4633 | -4487 | -4753 | -4252 | -2463 | 2302 | -3978 | -3593 | 172 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 147(K) | -2698 | -3306 | -2555 | -2385 | -4613 | 1689 | -2226 | -4379 | 3466 | -4176 | -3510 | -2406 | -3487 | -1898 | -1272 | -2718 | -2789 | -3870 | -3879 | -3804 | 173 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 148(T) | -1775 | -2078 | -3737 | -3648 | -2269 | -2758 | -3026 | -1461 | -3198 | 577 | -1417 | -3004 | -3304 | -3108 | -3140 | -2144 | 3610 | -1504 | -3171 | -2809 | 174 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 149(K) | 1442 | -2243 | -1132 | -565 | -2592 | -2073 | -704 | -2218 | 2425 | -2266 | -1439 | -805 | -2179 | 1424 | -419 | -1063 | -1056 | 139 | -2490 | -1948 | 175 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 150(P) | -2229 | -3531 | -751 | 745 | -4074 | -2482 | -1471 | -3788 | 860 | -3650 | -2934 | -1174 | 3599 | -1104 | -1174 | -2025 | -2220 | -3370 | -3701 | -3125 | 176 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 151(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 177 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 152(C) | 1031 | 2336 | -3000 | -2410 | -865 | -2361 | -1377 | -341 | -2075 | 407 | -99 | -2001 | -2486 | -1756 | -1986 | 688 | 649 | 1750 | -1361 | -1013 | 178 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 153(K) | 299 | -2345 | -751 | -248 | -2698 | -1882 | 2125 | -2424 | 2532 | -2376 | -1479 | 830 | -1996 | -103 | -500 | 327 | -894 | -1997 | -2541 | -1898 | 179 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 154(T) | -908 | -953 | -2280 | -1684 | -935 | -2313 | -1108 | 722 | 344 | 1215 | -140 | -1590 | -2372 | -1223 | 1008 | -1350 | 1552 | 668 | -1392 | -1018 | 180 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 155(V) | 248 | -1426 | -4165 | -3634 | -1671 | -3597 | -2693 | 2073 | -3341 | 492 | -700 | -3234 | -3564 | -3048 | -3243 | -2750 | 488 | 2467 | -2499 | -2124 | 181 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 156(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 182 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 157(G) | 693 | -1658 | -3600 | -3793 | -4209 | 2495 | -3362 | -4011 | -3794 | -4256 | -3314 | -2553 | -2706 | -3347 | -3658 | 2479 | -1495 | -2797 | -4419 | -4298 | 183 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 158(F) | 757 | -848 | -3195 | -2588 | 2258 | -2533 | -1456 | 1163 | -2229 | -678 | -69 | -2151 | -2599 | -1889 | -2097 | 1006 | -949 | 1406 | -1371 | -1020 | 184 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 159(F) | -3561 | -3044 | -5093 | -4992 | 4144 | -4702 | -2042 | -1417 | -4612 | -651 | 2173 | -3997 | -4516 | -3679 | -4183 | -4055 | -3507 | -1990 | -1263 | -230 | 185 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 160(I) | -2399 | -1985 | -4894 | -4389 | 1240 | -4436 | -3536 | 2456 | -4148 | 1300 | -435 | -4090 | -4179 | -3651 | -3986 | -3652 | -2345 | 2073 | -2927 | -2716 | 186 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 161(M) | -2968 | -2569 | -5237 | -4809 | -1359 | -4763 | -3886 | 1091 | -4419 | -34 | 4848 | -4576 | -4450 | -3792 | -4170 | -4116 | -2930 | -673 | -2953 | -2839 | 187 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 162(O) | 309 | -798 | -2699 | -2096 | 1118 | -2361 | -1203 | 789 | -1796 | 499 | 6 | -1823 | -2416 | 1904 | -1779 | 902 | -818 | 786 | -1249 | -892 | 188 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 163(V) | -884 | -1453 | -1331 | -759 | -1529 | -2054 | -754 | 426 | 1538 | -1352 | -623 | -938 | 708 | -503 | 609 | -1024 | 716 | 1556 | -1814 | -1348 | 189 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 164(P) | -1205 | -2096 | -1371 | -1294 | -3530 | 1986 | -1732 | -3286 | -1522 | -3357 | -2495 | -1382 | 2600 | 1480 | -1930 | 689 | -1438 | -2587 | -3557 | -3013 | 190 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 165(D) | -1308 | -2864 | 2377 | 1708 | -3151 | -1969 | -847 | -2932 | 908 | -2865 | -1984 | 1026 | -2212 | -422 | -1139 | -1136 | -1274 | -2473 | -3039 | 1438 | 191 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 166(C) | 544 | 3117 | -563 | 1527 | -2011 | -1598 | -229 | -1884 | 984 | -1975 | -920 | -317 | -1617 | 1132 | -431 | -599 | -614 | -1564 | -1347 | -1372 | 192 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 167(E) | -1135 | -2652 | 805 | 2212 | -2960 | 449 | -701 | -2724 | -352 | -2658 | -1760 | -534 | -2098 | 1133 | 1725 | -983 | -1089 | -2270 | -2825 | -2111 | 193 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 168(Y) | -3596 | -3426 | -4011 | -4236 | -456 | -3926 | -2017 | -3923 | -4119 | -3489 | -3396 | -3558 | 1274 | -3712 | -3935 | -3640 | -3783 | -3834 | -1423 | 4617 | 194 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -809 | -7942 | -1234 | -894 | -1115 | -701 | -1378 | * | * | | | | | | | | | | | | |
| 169(G) | -2666 | -2751 | -3377 | -3700 | -4393 | 3753 | -3528 | -4841 | -4031 | -4741 | -4286 | -3394 | -3411 | -3824 | -3848 | -2912 | -3053 | -4080 | -3719 | -4290 | 195 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7148 | -8190 | -894 | -1115 | -2275 | -334 | * | * | | | | | | | | | | | | |
| 170(H) | -909 | -2472 | 1648 | 1963 | -2749 | -1496 | 2279 | -2536 | -207 | -2473 | -1609 | -112 | -1774 | -16 | -789 | 911 | -884 | -2079 | -2655 | -1892 | 196 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7148 | -8190 | -894 | -1115 | -2275 | -334 | * | * | | | | | | | | | | | | |
| 171(D) | -1659 | -3544 | 3062 | 1534 | -3720 | -1620 | -946 | -3633 | -1158 | -3508 | -2820 | 1807 | -2140 | -608 | -1992 | -1327 | -1718 | -3114 | -3702 | -2701 | 197 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7148 | -8190 | -894 | -1115 | -2275 | -334 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 172(G) | -2666 | -2751 | -3377 | -3700 | -4393 | 3753 | -3528 | -4841 | -4031 | -4741 | -4286 | -3394 | -3411 | -3824 | -3848 | -2912 | -3053 | -4080 | -3719 | -4290 | 198 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -15 | -7148 | -8190 | -894 | -1115 | -2275 | -713 | * | * | | | | | | | | | | | | |
| 173(M) | 896 | -558 | -2670 | -2060 | 1251 | -2185 | -1048 | 43 | -1731 | 665 | 2262 | -1717 | -2232 | -1411 | 1654 | -1259 | 1662 | 83 | -1007 | -665 | 199 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7414 | -8456 | -894 | -1115 | -1982 | -421 | * | * | | | | | | | | | | | | |
| 174(L) | -3012 | -2483 | -4991 | -4588 | 2563 | -4681 | -2567 | -365 | -4286 | 2641 | 286 | -4144 | -4140 | -3283 | -3862 | -3990 | -2889 | -1078 | -1633 | -952 | 200 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7414 | -8456 | -894 | -1115 | -249 | -2660 | * | * | | | | | | | | | | | | |
| 175(V) | -1666 | -1535 | -3931 | -3496 | -1547 | 517 | -2575 | -46 | -3176 | 1766 | -593 | -3023 | -3348 | -2859 | -3069 | -2394 | -1705 | 2567 | -2418 | -2089 | 201 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 176(F) | -4576 | -3559 | -5015 | -5343 | 4263 | -4881 | -1152 | -3449 | -4910 | -2776 | -2865 | -3550 | -4757 | -3679 | -4300 | -4154 | -4444 | -3622 | -401 | 2124 | 202 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 177(A) | 3345 | -1674 | -3727 | -3977 | -4175 | -1941 | -3439 | -3955 | -3910 | -4243 | -3329 | -2621 | -2737 | -3468 | -3709 | 825 | -1527 | -2788 | -4405 | -4282 | 203 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 178(W) | -150 | 757 | 49 | 299 | -277 | -651 | 839 | -485 | 392 | -910 | 599 | 300 | -401 | 623 | 162 | -99 | 38 | -448 | 1107 | 126 | 204 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 179(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 205 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 180(C) | -1236 | 5496 | -4197 | -4463 | -4068 | -2103 | -3603 | -3911 | -4139 | -4251 | -3414 | -2867 | -2893 | -3739 | -3846 | 647 | -1702 | -2864 | -4296 | -4138 | 206 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 181(A) | 2681 | -1648 | -3686 | -3867 | -4184 | 2067 | -3375 | -3979 | -3817 | -4229 | -3291 | -2570 | -2704 | -3369 | -3665 | 954 | -1488 | -2779 | -4401 | -4284 | 207 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 182(V) | -2422 | -1967 | -4993 | -4556 | -1946 | -4647 | -4007 | 2482 | -4386 | 447 | 1863 | -4301 | -4388 | -4024 | -4325 | -3914 | -2387 | 2602 | -3399 | -3128 | 208 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 183(N) | -1642 | -1630 | -3011 | -2702 | -1675 | -3027 | -2261 | -141 | -2480 | 399 | -827 | 3044 | -3220 | -2357 | -2577 | -2236 | -1678 | 2152 | -2448 | -1987 | 209 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 184(I) | -1310 | -1421 | -2217 | 1185 | -1569 | -2673 | -1609 | 2204 | -1689 | -1167 | -660 | -1843 | 2154 | -1552 | -1934 | -1762 | -1280 | 885 | -2135 | -1720 | 210 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 185(N) | 257 | 1558 | 440 | 612 | -2481 | -1765 | -435 | -2211 | -31 | -2194 | 1330 | 2360 | -1863 | 1379 | -534 | -683 | -729 | -1796 | -2393 | -1727 | 211 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 186(P) | -2875 | -3093 | -3978 | -4134 | -3333 | -3398 | -3665 | -3255 | -3879 | -167 | -2945 | -3727 | 4087 | -3894 | -3795 | -3160 | -3199 | -3243 | -3784 | -3483 | 212 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 187(T) | -1617 | -2991 | 2432 | -518 | -3614 | -2086 | -1314 | -3413 | -1230 | -3383 | -2559 | 996 | -2497 | -937 | -1848 | 429 | 2498 | -2889 | -3583 | -2811 | 213 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 188(A) | 2241 | -1737 | -1506 | 513 | -2489 | -1943 | -1317 | -2071 | -1119 | -2312 | -1526 | -1230 | -2307 | -1010 | -1520 | 1714 | -1101 | 416 | -2692 | -2195 | 214 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 189(E) | 525 | -2429 | 1776 | 1822 | -2741 | -1821 | -551 | -2497 | -176 | -2443 | -1530 | -453 | 124 | 1127 | -700 | -809 | 481 | -2048 | -2615 | -1917 | 215 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 190(O) | -1567 | -3175 | 1704 | 1474 | -3449 | -2060 | -1054 | -3249 | -877 | -3174 | -2325 | -671 | -2377 | 2979 | -1481 | -1362 | 1084 | -2781 | -3353 | -2563 | 216 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 191(L) | -3337 | -2808 | -5707 | -5127 | -1152 | -5377 | -4133 | -460 | -4878 | 2928 | 1801 | -5079 | -4636 | -3831 | -4452 | -4675 | -3207 | 697 | -2886 | -3022 | 217 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 192(A) | 3213 | -1669 | -3729 | -3963 | -4171 | -1937 | -3427 | -3953 | -3889 | -4236 | -3319 | -2614 | -2732 | -3450 | -3697 | 1430 | -1520 | -2784 | -4399 | -4276 | 218 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 193(E) | -2200 | -4049 | 2514 | 2580 | -4247 | -2234 | -1519 | -4143 | -1674 | -4022 | -3301 | 1158 | -2729 | -1171 | -2473 | 318 | -2248 | -3627 | -4213 | -3243 | 219 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 194(I) | -2474 | -2002 | -5104 | -4792 | -2432 | -4811 | -4734 | 3681 | -4697 | -1199 | -1182 | -4556 | -4627 | -4560 | -4788 | -4186 | -2477 | 1241 | -4098 | -3650 | 220 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 195(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 221 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 196(I) | -1091 | -1076 | -2583 | 413 | -1145 | -2551 | -1453 | 2635 | -1815 | -911 | -317 | -1908 | -2625 | -1603 | -1923 | -64 | 352 | 1441 | -1667 | -1289 | 222 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 197(O) | 518 | -2071 | -706 | 1236 | -2329 | -1787 | -464 | 158 | -79 | -2066 | -1190 | -460 | -1883 | 1523 | -571 | 1071 | 1153 | -1661 | -2309 | -1673 | 223 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 198(S) | 690 | -1632 | -3665 | -3707 | -4013 | -1911 | -3224 | -3755 | -3549 | -4023 | -3114 | -2519 | -2683 | -3185 | -3470 | 2818 | 2263 | -2676 | -4240 | -4079 | 224 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 199(A) | 2957 | -1575 | -3607 | -3525 | -3508 | 456 | -2992 | -3142 | -3331 | -3468 | -2642 | -2460 | -2661 | -2989 | -3286 | 646 | -1410 | 731 | -3811 | -3585 | 225 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 200(E) | 56 | -2745 | 1143 | 2154 | -3045 | -1930 | -765 | -2818 | 1875 | -2752 | -1859 | 945 | -2144 | -332 | -1009 | -1045 | -1166 | -2359 | -2923 | -2190 | 226 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 201(T) | -1256 | -2015 | -1982 | -1726 | -3420 | -2098 | -1785 | -3082 | 927 | -3191 | -2379 | -1663 | -2604 | -1463 | -1433 | 524 | 3369 | -2475 | -3390 | -2984 | 227 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 202(W) | 2769 | -2207 | -4068 | -3807 | 2256 | -3458 | -1352 | -1888 | -3438 | -1847 | -1513 | -2925 | -3632 | -2881 | -3227 | -2665 | -2391 | -1867 | 3112 | 296 | 228 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 203(R) | -2470 | -3357 | -2623 | 1389 | -4114 | -3061 | -1112 | -3509 | 2409 | -3196 | -2485 | -1713 | -3049 | -686 | 2844 | -2333 | -2214 | -3234 | -3079 | -2887 | 229 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -540 | -7942 | -1697 | -894 | -1115 | -701 | -1378 | * | * | | | | | | | | | | | | |
| 204(M) | 816 | -1388 | -782 | -226 | -1511 | -1668 | -358 | -1120 | 1679 | 119 | 1761 | 1028 | -1755 | -26 | -458 | -619 | -511 | -896 | -1709 | -1189 | 230 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7414 | -8456 | -894 | -1115 | -249 | -2660 | * | * | | | | | | | | | | | | |
| 205(L) | -2837 | -2376 | -5287 | -4745 | -1320 | -4877 | -3831 | 1365 | -4505 | 2429 | 1943 | -4548 | -4406 | -3738 | -4219 | -4120 | -2750 | 1537 | -2900 | -2889 | 231 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 206(C) | -1191 | 2897 | -3560 | -2991 | 2519 | -2720 | -1807 | -69 | -2623 | -837 | -305 | -2465 | -2840 | -2267 | -2460 | -1855 | 899 | 2022 | -1675 | -1297 | 232 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 207(G) | -1539 | -3140 | 2028 | -312 | -3421 | 2111 | -1027 | -3216 | 685 | -3138 | -2285 | 998 | -2361 | 1202 | -1409 | -1339 | -1520 | -2749 | -3312 | -2532 | 233 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | |
|---|---|---|---|---|---|---|---|---|---|---|---|---|---|---|---|---|---|---|---|---|
| 208(I) | 334 | -1130 | 401 | 620 | -1157 | -2255 | -1040 | 2289 | -1141 | -979 | 1812 | -1358 | -2323 | -992 | -1401 | -1264 | -866 | 644 | -1591 | -1181 | 234 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 209(E) | 425 | -2447 | 1685 | 2151 | -2749 | -1843 | -586 | -2497 | 831 | -2456 | -1553 | -477 | -1993 | -142 | -743 | -847 | -928 | 108 | -2639 | -1943 | 235 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -169 | -3204 | -8984 | -206 | -2913 | -701 | -1378 | * | * | | | | | | | | | | | | |
| 210(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 237 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 211(R) | -2896 | -3530 | -3730 | -2192 | -4456 | -3379 | -1195 | -3709 | 2481 | -3319 | -2662 | -2040 | -3291 | 1300 | 3145 | -2762 | -3535 | -3495 | -3134 | -3075 | 238 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 212(V) | -2838 | -2616 | -4834 | -4880 | -3213 | -3955 | -4416 | -610 | -4757 | -2310 | -2253 | -4383 | -4345 | -4643 | -4642 | -3732 | -3007 | 3763 | -4157 | -3886 | 239 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 213(A) | 3345 | -1674 | -3727 | -3977 | -4175 | -1941 | -3439 | -3955 | -3910 | -4243 | -3329 | -2621 | -2737 | -3468 | -3709 | 825 | -1527 | -2788 | -4405 | -4282 | 240 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 214(M) | -3386 | -2926 | -5503 | -5047 | -1187 | -5101 | -3953 | -644 | -4586 | 916 | 4893 | -4906 | -4599 | -3801 | -4244 | -4517 | -3301 | -1338 | -2841 | -2779 | 241 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 215(L) | -4119 | -3542 | -5389 | -5357 | -2027 | -4767 | -4359 | -1609 | -5118 | 3293 | -979 | -5230 | -4771 | -4474 | -4724 | -5069 | -4106 | -2331 | -3412 | -3400 | 242 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 216(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 243 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 217(F) | -4596 | -3564 | -5022 | -5356 | 4100 | -4892 | -1140 | -3474 | -4920 | -2799 | -288 | -3546 | -4763 | -3678 | -4303 | -4158 | -4459 | -3642 | -389 | 2808 | 244 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 218(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 245 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 219(T) | -1086 | -1700 | -3489 | -3680 | -4071 | -1960 | -3290 | -3842 | -3622 | -4127 | -3243 | -2550 | -2741 | -3278 | -3511 | 1633 | 3501 | -2755 | -4299 | -4122 | 246 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 220(K) | -1211 | -2188 | -1252 | -684 | -2201 | -2183 | -735 | -2041 | 2458 | -2110 | 2342 | 1770 | -2264 | -372 | -433 | -1182 | -1128 | -1772 | -2263 | 1110 | 247 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 221(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 248 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 222(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 249 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 223(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 250 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 224(K) | -2345 | -3215 | -2680 | -1702 | -4004 | -2994 | -1114 | -3430 | 3145 | -3150 | -2429 | -1707 | -3005 | -690 | 1537 | 1210 | -2130 | -3134 | -3052 | -2847 | 251 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 225(H) | -1041 | -1842 | -1795 | -1535 | -3225 | 1554 | 2940 | -2958 | -1555 | -3088 | -2233 | -1512 | -2445 | -1442 | -1925 | 2143 | 928 | -2312 | -3333 | -2843 | 252 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 226(P) | -1812 | -3493 | 1638 | 2272 | -3746 | -2139 | -1234 | -3572 | 714 | -3480 | -2668 | -741 | 2320 | -848 | -1793 | -1570 | -1815 | -3091 | -3658 | -2819 | 253 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 227(M) | -1063 | -1672 | -1185 | 1731 | -1647 | -2144 | -910 | -1218 | -725 | 1142 | 2726 | 1099 | -2261 | -651 | -1101 | -1179 | -1008 | -1100 | -2011 | -1532 | 254 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 228(W) | -150 | 757 | 49 | 299 | -277 | -651 | 839 | -485 | 392 | -910 | 599 | 300 | -401 | 623 | 162 | -99 | 38 | -448 | 1107 | 126 | 255 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 229(V) | -1683 | -1779 | -4225 | -4114 | -2704 | -2952 | -3573 | -161 | -3855 | -1868 | -1633 | -3296 | -3474 | -3653 | -3791 | -2302 | 2073 | 3159 | -3712 | -3334 | 256 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 230(E) | 576 | -3124 | 2215 | 2294 | -3448 | -2061 | -1092 | -3240 | -936 | -3183 | -2340 | -696 | -2393 | -692 | -1547 | -1375 | 1093 | -2772 | -3374 | -2589 | 257 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 231(K) | 315 | -2794 | -1360 | -1079 | -3606 | -2397 | -1201 | -3242 | 3269 | -3135 | -2344 | 1290 | -2657 | -798 | -553 | -1655 | -1723 | -2800 | -3186 | -2733 | 258 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 232(V) | -1806 | -1830 | -4356 | -4254 | -2729 | -3152 | -3789 | -6 | -4016 | -1803 | -1616 | -3476 | -3637 | -3839 | -3966 | -2513 | 660 | 3495 | -3859 | -3459 | 259 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 233(O) | 793 | -1527 | -1108 | -552 | -1618 | -1947 | 1457 | 1157 | 637 | -1440 | -683 | -772 | -2030 | 1773 | -839 | -896 | 518 | 491 | -1868 | -1365 | 260 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 234(E) | 300 | -2398 | 695 | 1659 | -2713 | -1806 | -518 | -2470 | 1395 | -2411 | -1494 | 1531 | -1936 | 1405 | -648 | -775 | -852 | -2018 | -2579 | -1883 | 261 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 235(A) | 3370 | -1675 | -3725 | -3979 | -4176 | -1943 | -3442 | -3956 | -3915 | -4245 | -3332 | -2623 | -2739 | -3473 | -3712 | 667 | -1529 | -2789 | -4406 | -4283 | 262 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 236(T) | -1487 | -1747 | -4009 | -3951 | -2829 | -2596 | -3358 | -658 | -3663 | -2137 | -1837 | -3024 | -3208 | -3442 | -3576 | -1949 | 3247 | 2128 | -3661 | -3318 | 263 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 237(K) | 78 | -2444 | -636 | 1476 | -2774 | -1872 | -554 | -2516 | 2347 | -2450 | -1542 | 1061 | -1996 | 1188 | -567 | -849 | -918 | -2073 | -2605 | -1935 | 264 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 238(L) | -2340 | -2043 | -4429 | -3825 | -1249 | -4051 | -2880 | 2209 | 47 | 2445 | -154 | -3576 | -3849 | -2947 | -3012 | -3227 | -2264 | -489 | -2490 | -2321 | 265 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 239(A) | 3066 | -1532 | -3416 | -3204 | -2546 | -2126 | -2613 | -1745 | -2919 | 251 | -1678 | -2434 | -2743 | -2680 | -2903 | -1429 | 721 | -1481 | -3078 | -2775 | 266 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 240(K) | -2775 | -3478 | -3431 | -2065 | -4356 | -3299 | -1170 | -3648 | 3068 | -3281 | -2609 | -1958 | -3227 | 2481 | 1606 | -2643 | -2444 | -3419 | -3113 | -3021 | 267 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 241(E) | 5 | -3248 | -527 | 3274 | -3691 | -2238 | -1242 | -3429 | 736 | -3351 | -2559 | -905 | -2586 | -855 | -1282 | -1630 | -1816 | -2982 | -3491 | -2801 | 268 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 242(R) | 1203 | -1274 | -1535 | -960 | 714 | -2112 | -836 | -874 | 1242 | 45 | 1502 | -1087 | -2184 | -670 | 1607 | -1097 | -814 | -732 | -1655 | -1220 | 269 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 243(A) | 1867 | -2550 | 755 | 648 | -2859 | -1875 | -646 | -2618 | -291 | -2563 | -1661 | 1632 | -2046 | -205 | 1386 | -915 | -1009 | -2170 | -2737 | -2031 | 270 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 244(P) | -1833 | -2267 | -3769 | -3944 | -3591 | -2645 | -3527 | -2530 | -3805 | -3285 | -2936 | -3132 | 3954 | -3636 | -3703 | -2130 | -2228 | 835 | -4002 | -3761 | 271 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 245(D) | 206 | -2972 | 2710 | 1351 | -3255 | -2000 | 1755 | -3042 | -683 | -2972 | -2100 | -614 | -2269 | 1462 | -1262 | -1213 | -1369 | -2579 | -3148 | -2386 | 272 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 246(L) | -3414 | -2874 | -5769 | -5161 | 1383 | -5422 | -4072 | 994 | -4912 | 2728 | 2007 | -5118 | -4630 | -3791 | -4438 | -4708 | -3264 | -1344 | -2810 | -2947 | 273 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 247(A) | 1831 | -2029 | 575 | -204 | -2274 | -1806 | -494 | -1962 | 927 | -82 | -1160 | -494 | 270 | -72 | -607 | -735 | 508 | -1613 | -2285 | -1663 | 274 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 248(I) | -2431 | -2000 | -4947 | -4466 | 1231 | -4532 | -3688 | 3189 | -4249 | 517 | -529 | -4183 | -4266 | -3781 | -4114 | -3766 | -2383 | 1363 | -3060 | -2816 | 275 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 249(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 276 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 250(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 277 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 251(E) | -4205 | -4417 | -2343 | 3901 | -5349 | -3698 | -3534 | -5837 | -3838 | -5561 | -5237 | -3039 | -4218 | -3453 | -4201 | -4072 | -4352 | -5409 | -4640 | -4860 | 278 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 252(L) | -3602 | -3015 | -5919 | -5328 | 1158 | -5654 | -4138 | -616 | -5093 | 2938 | 2013 | -5330 | -4744 | -3877 | -4575 | -4984 | -3438 | -1455 | -2794 | -2838 | 279 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 253(O) | -4207 | -4117 | -3531 | -3731 | -4752 | -3930 | -3721 | -5554 | -3395 | -5179 | -4897 | -3823 | -4399 | 4556 | -3405 | -4301 | -4380 | -5208 | -4301 | -4384 | 280 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 254(F) | -2863 | -2433 | -5172 | -4640 | 3169 | -4702 | -3234 | -392 | -4348 | 1785 | -84 | -4307 | -4290 | -3544 | -4021 | -3916 | -2769 | 1504 | -2393 | -2005 | 281 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 255(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 282 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 256(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 283 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 257(A) | 3186 | -1669 | -3728 | -3961 | -4171 | -1936 | -3425 | -3953 | -3886 | -4235 | -3318 | -2613 | -2731 | -3447 | -3695 | 1524 | -1520 | -2783 | -4398 | -4275 | 284 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 258(F) | -3002 | -2525 | -5316 | -4818 | 3177 | -4924 | -3350 | 2613 | -4551 | 818 | -147 | -4496 | -4441 | -3703 | -4215 | -4169 | -2905 | -737 | -2444 | -1989 | 285 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 259(V) | -2294 | -2438 | 724 | -2485 | -3071 | -3156 | -3064 | -720 | -3372 | -2390 | -2164 | -2598 | -3629 | -2975 | -3716 | -2757 | -2460 | 3538 | -3861 | -3370 | 286 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 220(P) | -1594 | -2934 | -619 | 588 | -3418 | -2163 | -1118 | -3148 | 755 | -3092 | -2272 | -870 | 3320 | -720 | -1108 | 321 | -1590 | -2706 | -3251 | -2595 | 287 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 261(E) | 232 | -2432 | -633 | 1887 | -2799 | -1880 | -622 | -2541 | 1768 | -2491 | -1591 | -543 | -2032 | -178 | -679 | 1460 | -962 | -2096 | -2660 | -1989 | 288 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 262(V) | -2838 | -2616 | -4834 | -4880 | -3213 | -3955 | -4416 | -610 | -4757 | -2310 | -2253 | -4383 | -4345 | -4643 | -4642 | -3732 | -3007 | 3763 | -4157 | -3886 | 289 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 263(A) | 3303 | -1827 | -3692 | -3978 | -4328 | 1129 | -3541 | -4137 | -4037 | -4403 | -3503 | -2739 | -2867 | -3583 | -3840 | -1477 | -1693 | -2962 | -4468 | -4428 | 290 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 264(E) | -1471 | -2341 | 669 | 1713 | -2646 | -1806 | -509 | -2389 | 1384 | -6580 | -1440 | -444 | -1930 | -60 | -624 | -766 | -833 | -1955 | -2531 | -1848 | 291 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 265(O) | 236 | -2063 | -853 | -302 | -2314 | -1882 | -542 | -1988 | 1473 | 799 | -1199 | -578 | -1977 | 1845 | -534 | 1012 | -820 | -1652 | -2307 | -1712 | 292 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 266(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 293 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 267(A) | 3348 | -3109 | -3336 | -3412 | -1764 | -2509 | -2437 | -2956 | -3286 | -3118 | -2630 | -2708 | -3150 | -3050 | -3249 | -1903 | -2016 | -2533 | -2364 | 1487 | 294 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 268(P) | -1528 | -2315 | -1720 | -1687 | -3833 | -2233 | -1895 | -3539 | 797 | -3582 | -2793 | -1690 | 3653 | -1574 | -1445 | 406 | -1768 | -2881 | -3673 | -3270 | 295 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 269(G) | -1935 | -3089 | 2442 | -885 | -4418 | 2762 | -1974 | -4330 | -2285 | -4310 | -3586 | -1182 | -2821 | -1681 | -3048 | 394 | -2183 | -3549 | -4481 | -3646 | 296 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 270(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 297 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 271(K) | -986 | -2487 | 579 | 781 | -2798 | -1840 | -584 | -2559 | 1709 | -2499 | -1588 | 1699 | 1485 | -137 | -743 | 394 | -935 | -2105 | -2668 | -1964 | 298 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 272(V) | -2488 | -1997 | -5115 | -4741 | -2236 | -4876 | -4521 | 1399 | -4638 | 586 | -992 | -4534 | -4596 | -4394 | -4675 | -4204 | -2466 | 3282 | -3849 | -3500 | 299 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 273(A) | 2860 | -2613 | -1445 | -1105 | -3345 | -2365 | -1181 | -2968 | 911 | -2930 | -2150 | -1269 | -2615 | 1502 | -562 | -1587 | -1627 | -2570 | -3048 | -2602 | 300 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 274(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 301 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 275(H) | -1098 | -2519 | 644 | -333 | -2880 | -1987 | 2767 | -2597 | 2281 | -2509 | -1617 | 857 | -2093 | -153 | 1114 | -970 | -1024 | -2167 | -2636 | -2015 | 302 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 276(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 303 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 277(N) | -1586 | -2305 | -1738 | -2020 | -4028 | -2232 | -2587 | -3973 | -2635 | -4158 | -3406 | 4054 | -2920 | -2402 | -2900 | -1720 | 681 | -3116 | -4157 | -3676 | 304 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 278(V) | -2446 | -1963 | -5100 | -4786 | -2548 | -4847 | -4816 | 1583 | -4714 | -1330 | -1276 | -4562 | -4651 | -4631 | -4841 | -4218 | -2447 | 3468 | -4224 | -3729 | 305 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 279(W) | -150 | 757 | 49 | 299 | -277 | -651 | 839 | -485 | 392 | -910 | 599 | 300 | -401 | 623 | 162 | -99 | 38 | -448 | 1107 | 126 | 306 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 280(F) | -3486 | -2932 | -5765 | -5195 | 3114 | -5447 | -3820 | -632 | -4937 | 2173 | 2384 | -5073 | -4656 | -3798 | -4452 | -4740 | -3334 | -1436 | -2628 | -2474 | 307 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 281(I) | -2458 | -1961 | -5125 | -4807 | -2569 | -4914 | -4890 | 3219 | -4751 | -1339 | -1284 | -4603 | -4685 | -4676 | -4892 | -4286 | -2453 | 2471 | -4276 | -3778 | 308 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 282(F) | -4720 | -3927 | -5139 | -5454 | 4513 | -4504 | -2520 | -3938 | -5326 | -3307 | -3429 | -4469 | -4782 | -4575 | -4818 | -4787 | -4810 | -4172 | -1812 | -736 | 309 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 283(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 310 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 284(D) | -2322 | -4185 | 3035 | 1469 | -4418 | -2266 | -1625 | -4341 | -1869 | -4214 | -3539 | -867 | -2800 | -1293 | -2724 | 1786 | -2396 | -3805 | -4409 | -3395 | 311 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 285(L) | -3492 | -2925 | -5831 | -5302 | -1190 | -5571 | -4334 | 974 | -5050 | 3059 | 17 | -5312 | -4763 | -3965 | -4606 | -4957 | -3364 | -1095 | -2972 | -3089 | 312 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 286(O) | -2004 | -3769 | 1173 | 2079 | -3991 | -2187 | -1375 | -3849 | -1403 | -3743 | -2969 | 1136 | -2626 | 3177 | -2117 | -1727 | -2027 | -3352 | -3926 | -3026 | 313 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 287(A) | 2861 | 2401 | -3941 | -3933 | -3713 | -1915 | -3209 | -3405 | -3647 | -3703 | -2846 | -2573 | -2679 | -3249 | -3498 | 1246 | 795 | -2497 | -4004 | -3830 | 314 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 288(G) | 804 | -1917 | -3555 | -3872 | -4406 | 3488 | -3564 | -4245 | -4053 | -4497 | -3611 | -2768 | -2934 | -3603 | -3880 | -1567 | -1787 | -3064 | -4502 | -4481 | 315 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 289(N) | -3642 | -3838 | -3004 | -3356 | -4743 | -3612 | -3773 | -5643 | -4099 | -5460 | -5060 | 4378 | -4185 | -3865 | -4225 | -3744 | -3950 | -5002 | -4391 | -4381 | 316 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 290(I) | -3202 | -2787 | -5004 | -4996 | -2836 | -4384 | -4440 | 3937 | -4838 | -1815 | -1871 | -4704 | -4600 | -4683 | -4704 | -4353 | -3280 | -603 | -3938 | -3661 | 317 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 291(G) | 1452 | -1874 | -3596 | -3903 | -4376 | 3335 | -3550 | -4203 | -4044 | -4459 | -3565 | -2747 | -2900 | -3588 | -3862 | -1522 | -1740 | -3018 | -4492 | -4461 | 318 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 292(Y) | -4791 | -3935 | -4914 | -5231 | -815 | -4530 | -2178 | -4357 | -5024 | -3745 | -3807 | -4206 | -4772 | -4328 | -4584 | -4677 | -4837 | -4435 | -1477 | 4857 | 319 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 293(K) | -4125 | -4091 | -4017 | -3615 | -5101 | -3960 | -2958 | -5182 | 3972 | -4825 | -4345 | -3552 | -4249 | -2709 | -1809 | -4154 | -4044 | -4895 | -4132 | -4389 | 320 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 294(I) | -3130 | -2603 | -5572 | -5096 | -1392 | -5301 | -4317 | 3061 | -4881 | 2084 | -185 | -5010 | -4688 | -4034 | -4578 | -4656 | -3046 | -463 | -3127 | -3143 | 321 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 295(A) | 2675 | -1535 | -3836 | -3683 | -2774 | -2214 | -2959 | -1215 | -3410 | -2393 | -1857 | -2670 | -2859 | -3085 | -3310 | -1533 | 792 | 2057 | -3350 | -3057 | 322 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 296(O) | -4207 | -4117 | -3531 | -3731 | -4752 | -3930 | -3721 | -5554 | -3395 | -5179 | -4897 | -3823 | -4399 | 4556 | -3405 | -4301 | -4380 | -5208 | -4301 | -4384 | 323 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 297(R) | -4488 | -4181 | -4789 | -4318 | -5193 | -4148 | -3436 | -5568 | -2393 | -5152 | -4748 | -4156 | -4479 | -3286 | 4202 | -4614 | -4467 | -5273 | -4267 | -4649 | 324 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 298(F) | -3500 | -2941 | -5773 | -5206 | 3166 | -5461 | -3812 | -635 | -4949 | 2227 | 2003 | -5083 | -4665 | -3805 | -4462 | -4757 | -3346 | -1441 | -2619 | -2449 | 325 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 299(G) | 2279 | -1650 | -3675 | -3870 | -4196 | 2606 | -3385 | -3993 | -3836 | -4243 | -3303 | -2572 | -2706 | -3382 | -3678 | 828 | -1491 | -2786 | -4412 | -4298 | 326 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 300(K) | -1571 | -2888 | -927 | -655 | -3321 | 2063 | 1468 | -3019 | 2355 | -2910 | -2082 | 920 | -2447 | -523 | -551 | -1431 | -1504 | -2612 | -2998 | -2431 | 327 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 301(F) | 2448 | -2615 | -4303 | -4172 | 2956 | -3922 | -1214 | -2324 | -3828 | -2183 | -1926 | -3107 | -3996 | -3105 | -3543 | -3119 | -2926 | -2325 | -560 | 2239 | 328 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 302(E) | -1402 | -2920 | 1061 | 2832 | -3242 | -2054 | -879 | -2998 | 774 | -2910 | -2042 | -672 | -2284 | -454 | 1073 | -1230 | -1357 | -2549 | -3055 | -2355 | 329 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 303(A) | 3609 | -2508 | -4184 | -4493 | -4592 | -2737 | -3989 | -4421 | -4496 | -4701 | -4051 | -3440 | -3474 | -4171 | -4253 | -2294 | -2487 | -3536 | -4484 | -4643 | 330 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 304(I) | -1878 | -1552 | -4312 | -3775 | -1491 | -3734 | -2739 | 2447 | -3471 | 521 | -541 | -3367 | -3656 | -3110 | -3335 | -2889 | -1832 | 2126 | -2430 | 2171 | 331 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 305(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 332 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 306(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 333 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 307(I) | -2574 | -2082 | -5179 | -4778 | -2009 | -4923 | -4424 | 3104 | -4656 | 1327 | -776 | -4584 | -4587 | -4278 | -4620 | -4242 | -2542 | 1595 | -3640 | -3399 | 334 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 308(C) | -1490 | 2918 | -3842 | -3258 | -1170 | -3142 | -2133 | 1934 | -2902 | 1595 | -258 | -2806 | -3152 | -2528 | -2741 | -2266 | 1394 | 65 | -1929 | -1611 | 335 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 309(O) | -4207 | -4117 | -3531 | -3731 | -4752 | -3930 | -3721 | -5554 | -3395 | -5179 | -4897 | -3823 | -4399 | 4556 | -3405 | -4301 | -4380 | -5208 | -4301 | -4384 | 336 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 310(G) | -4088 | -3924 | -4774 | -5139 | -5615 | 3825 | -4753 | -6303 | -5453 | -6014 | -5662 | -4812 | -4539 | -5232 | -5106 | -4370 | -4472 | -5527 | -4696 | -5561 | 337 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 311(L) | -3686 | -3084 | -5727 | -5319 | 2036 | -5453 | -3331 | -789 | -5052 | 2929 | -88 | -4966 | -4743 | -3883 | -4542 | -4837 | -3542 | -1589 | -2266 | -1680 | 338 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 312(A) | 2898 | -1987 | -2240 | -2485 | -4049 | -2085 | -2826 | -3885 | -3004 | -4117 | -3288 | 2707 | -2813 | -2683 | -3186 | -1506 | -1726 | -2917 | -4217 | -3861 | 339 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 313(K) | 1066 | -2626 | -1795 | -1052 | -3050 | -2498 | -872 | -2618 | 2866 | -2563 | 1526 | -1206 | -2543 | -458 | 1142 | -1556 | -1494 | -2321 | -2682 | -2281 | 340 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 314(P) | -4497 | -4117 | -4899 | -5251 | -5560 | -4139 | -4798 | -6328 | -5454 | -5976 | -5741 | -5026 | 4302 | -5328 | -5104 | -4798 | -4844 | -5739 | -4665 | -5484 | 341 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 315(V) | -2475 | -1980 | -5117 | -4752 | -2317 | -4893 | -4598 | 2349 | -4663 | 557 | -1062 | -4548 | -4617 | -4458 | -4725 | -4228 | -2455 | 2932 | -3943 | -3564 | 342 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 316(H) | 173 | -2262 | -944 | -767 | -3091 | -1973 | 2974 | -2865 | -947 | -2905 | -2052 | 2949 | -2338 | -840 | -1414 | 1020 | -1292 | -2346 | -3104 | -2474 | 343 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 317(D) | -4232 | -4465 | 4158 | -2649 | -5412 | -3676 | -3575 | -6036 | -4125 | -5722 | -5419 | -2993 | -4216 | -3512 | -4617 | -4077 | -4401 | -5553 | -4696 | -4914 | 344 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 318(L) | -4119 | -3542 | -5389 | -5357 | -2027 | -4767 | -4359 | -1609 | -5118 | 3293 | -979 | -5230 | -4771 | -4474 | -4724 | -5069 | -4106 | -2331 | -3412 | -3400 | 345 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 319(S) | -1944 | -2458 | -3696 | -4011 | -4410 | -2644 | -3753 | -4675 | -4191 | -4807 | -4070 | -3198 | -3384 | -3886 | -4051 | 3656 | -2393 | -3615 | -4374 | -4307 | 346 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 320(R) | -4488 | -4181 | -4789 | -4318 | -5193 | -4148 | -3436 | -5568 | -2393 | -5152 | -4748 | -4156 | -4479 | -2386 | 4202 | -4614 | -4467 | -5273 | -4267 | -4649 | 3347 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 321(G) | -4088 | -3924 | -4774 | -5139 | -4615 | 3825 | -4753 | -6303 | -5453 | -6014 | -5662 | -4812 | -4539 | -5232 | -5106 | -4370 | -4472 | -5527 | -4696 | -5561 | 348 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 322(C) | -1383 | 5545 | -4327 | -4558 | -4019 | -2243 | -3671 | -3414 | -4157 | -3975 | -3301 | -3006 | -3016 | -3818 | -3871 | -1656 | 540 | -2675 | -4269 | -4170 | 349 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 323(S) | -1998 | -3389 | 920 | -646 | -4194 | -2202 | -1688 | -4095 | -1857 | -4037 | -3301 | 1873 | -2745 | -1360 | -2596 | 2972 | -2145 | -3473 | -4215 | -3333 | 350 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 324(A) | 1796 | -2218 | 759 | 1121 | -2509 | -1874 | -667 | -2198 | -343 | -2259 | -1405 | -578 | -2039 | -254 | -849 | 333 | -937 | 1127 | -2521 | -1880 | 351 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 325(E) | -2264 | -4130 | 1161 | 3061 | -4316 | -2257 | -1556 | -4221 | -1720 | -4092 | -3390 | -846 | -2763 | 2340 | -2512 | -1940 | -2316 | -3705 | -4277 | -3299 | 352 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 326(D) | -33 | -4335 | 3607 | 1205 | -4570 | -2294 | -1708 | -4511 | -2035 | -4382 | -3756 | -897 | -2858 | -1390 | -2952 | -2084 | -2528 | -3963 | -4583 | -3525 | 353 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 327(I) | -2456 | -1959 | -5125 | -4808 | -2580 | -4919 | -4900 | 3012 | -4754 | -1350 | -1292 | -4605 | -4688 | -4684 | -4898 | -4291 | -2452 | 2731 | -4288 | -3786 | 354 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 328(Y) | -2065 | -1703 | -4458 | -4000 | -1497 | -3978 | -2824 | 1512 | -3720 | -1096 | -877 | -3567 | -3903 | -3404 | -3627 | -3169 | -2033 | 2744 | -2424 | 2949 | 355 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 329(K) | -1420 | -3005 | 1129 | 1097 | -3290 | 1087 | -935 | -3080 | 2093 | -3005 | -2135 | 1724 | -2283 | -517 | -1280 | -1233 | -1393 | -2613 | -3178 | -2412 | 356 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 330(W) | -150 | 757 | 49 | 299 | -277 | -651 | 839 | -485 | 392 | -910 | 599 | 300 | -401 | 623 | 162 | -99 | 38 | -448 | 1107 | 126 | 357 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 331(V) | 242 | -1739 | -4505 | -4069 | -1901 | -3865 | -3328 | 339 | -3811 | 1145 | -812 | -3662 | -3892 | -3515 | -3741 | -3100 | -2045 | 3053 | -3031 | -2693 | 358 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 332(A) | 2785 | -1548 | -3757 | -3706 | -3183 | -2010 | -3016 | -2274 | -3464 | -3018 | -2323 | -2559 | -2725 | -3105 | -3346 | 519 | -1436 | 1956 | -3604 | -3353 | 359 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 333(A) | 2301 | -1785 | -4329 | -3814 | -1389 | -3715 | -2881 | 1608 | -3501 | 1601 | -328 | -3440 | -3685 | -3079 | -3364 | -2901 | -2013 | -142 | 2516 | -2281 | 360 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 334(I) | -2461 | -1969 | -5121 | -4803 | -2539 | -4894 | -4855 | 3457 | -4740 | -1307 | -1260 | -4593 | -4673 | -4650 | -4870 | -4267 | -2458 | 2020 | -4235 | -3750 | 361 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 335(T) | 1694 | -1679 | -3770 | -3955 | -4023 | -1971 | -3381 | -3579 | -3783 | -3994 | -3161 | -2633 | -2754 | -3407 | -3608 | -1339 | 3474 | -2625 | -4286 | -4150 | 362 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 336(A) | 3145 | 2363 | -4124 | -4092 | -3068 | -2102 | -3176 | -1748 | -3745 | -2761 | -2179 | -2727 | -2812 | -3341 | -3530 | -1439 | -1489 | 622 | -3594 | -3345 | 363 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 337(V) | 1549 | -1561 | -3980 | -3800 | -2617 | -2450 | -3066 | -638 | -3529 | -2084 | -1647 | -2851 | -3038 | -3217 | -3427 | -1764 | 645 | 3033 | -3323 | -3003 | 364 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 338(O) | -1998 | -3480 | -470 | 1001 | -3872 | -2292 | -1373 | -3668 | -1085 | -3566 | -2804 | -947 | 1060 | 3783 | -1533 | -1779 | -2007 | -3214 | -3690 | -2964 | 365 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |
| 339(A) | 2845 | -1741 | -2441 | -2116 | -3476 | 181 | -2133 | -3194 | -1899 | -3346 | -2475 | -1852 | -2527 | -1850 | 1122 | 752 | -1333 | -2425 | -3579 | -3191 | 366 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -9 | -7942 | -8984 | -894 | -1115 | -701 | -1378 | * | * | | | | | | | | | | | | |

TABLE 14-continued

| | | | | | | | | | | | | | | | | | | | | |
|---|---|---|---|---|---|---|---|---|---|---|---|---|---|---|---|---|---|---|---|---|
| 340(O) | 288 | -1371 | -2820 | -2256 | -1089 | -2819 | -1668 | 1024 | -1933 | 1596 | -165 | -2151 | -2848 | 2772 | -2022 | -1891 | -1329 | -469 | -1817 | -1496 | 367 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -444 | -7942 | -1940 | -894 | -1115 | -701 | -1378 | * | * | | | | | | | | | | | | |
| 341(A) | 2553 | -1499 | -1618 | -1106 | -1437 | -1994 | -884 | -1437 | -516 | -1637 | -947 | -1150 | -2220 | -717 | 1070 | -1116 | -989 | -1219 | -1772 | 1598 | 368 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -154 | -7510 | -3381 | -894 | -1115 | -1844 | -471 | * | * | | | | | | | | | | | | |
| 342(O) | -840 | -2183 | 2051 | 46 | -2487 | 478 | -471 | -2205 | -189 | -2230 | -1379 | -273 | -1821 | 2234 | -719 | -721 | -813 | 565 | -2466 | -1782 | 369 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -13 | -7368 | -8411 | -894 | -1115 | -2041 | -402 | * | * | | | | | | | | | | | | |
| 343(K) | -542 | -1518 | 903 | -68 | -1686 | 266 | -294 | 542 | 1621 | -1463 | -666 | -332 | -1689 | 78 | -434 | -539 | -484 | 817 | -1827 | -1263 | 370 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -435 | -7368 | -1975 | -894 | -1115 | -2041 | -402 | * | * | | | | | | | | | | | | |
| 344(K) | 842 | -1833 | 1221 | 299 | -2188 | -1329 | -107 | -1924 | 1349 | -1907 | -1015 | -8 | -1492 | 329 | -247 | 1153 | -413 | -1495 | -2105 | -1431 | 371 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -1110 | -6951 | -919 | -894 | -1115 | -2432 | -296 | * | * | | | | | | | | | | | | |
| 345(R) | -956 | -1423 | -1186 | -681 | -1830 | -1454 | -276 | -1686 | 690 | -1640 | -1095 | -694 | -1696 | 14 | 3253 | -1003 | -929 | -1464 | -1574 | -1319 | 372 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 346(E) | -804 | -1735 | 497 | 2874 | -2096 | -1058 | -327 | -1858 | -157 | -1967 | -1380 | 40 | -1471 | -39 | -568 | -688 | -853 | -1562 | -2027 | -1547 | 373 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |
| 347(R) | -956 | -1423 | -1186 | -681 | -1830 | -1454 | -276 | -1686 | 690 | -1640 | -1095 | -694 | -1696 | 14 | 3253 | -1003 | -929 | -1464 | -1574 | -1319 | 374 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |
| 348(S) | 227 | -390 | -660 | -668 | -1564 | -565 | -762 | -1409 | -705 | -1690 | -1020 | -460 | -1182 | -625 | -900 | 2604 | -94 | -861 | -1818 | -1338 | 375 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |
| 349(L) | -1162 | -1035 | -2273 | -2015 | -35 | -2243 | -1374 | 599 | -1587 | 2466 | 801 | -1903 | -2350 | -1486 | -1587 | -1745 | -1181 | 283 | -1141 | -718 | 376 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |
| 350(H) | -948 | -1353 | -590 | -533 | -353 | -1374 | 4354 | -1609 | -210 | -1544 | -1090 | -628 | -1716 | -415 | -369 | -985 | -1004 | -1409 | -758 | 74 | 377 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |
| 351(T) | 71 | -435 | -987 | -905 | -1386 | -761 | -851 | -654 | -738 | -1152 | -667 | -673 | -1327 | -733 | -889 | -159 | 2865 | -370 | -1730 | -1351 | 378 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |

TABLE 14-continued

| | | | | | | | | | | | | | | | | | | | | | |
|---|---|---|---|---|---|---|---|---|---|---|---|---|---|---|---|---|---|---|---|---|---|
| 352(L) | -1162 | -1035 | -2273 | -2015 | -35 | -2243 | -1374 | 599 | -1587 | 2466 | 801 | -1903 | -2350 | -1486 | -1587 | -1745 | -1181 | 283 | -1141 | -718 | 379 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |
| 353(V) | -558 | -557 | -2112 | -1895 | -730 | -1799 | -1509 | 1150 | -1619 | 15 | 149 | -1639 | -2121 | -1558 | -1693 | -1183 | -681 | 2778 | -1647 | -1187 | 380 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -2888 | -209 | * | * | | | | | | | | | | | | |
| 354(E) | -804 | -1735 | 497 | 2874 | -2096 | -1058 | -327 | -1858 | -157 | -1967 | -1380 | 40 | -1471 | -39 | -568 | -688 | -853 | -1562 | -2027 | -1547 | 381 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -37 | -5878 | -6920 | -894 | -1115 | -3565 | 12 | * | * | | | | | | | | | | | | |
| 355(W) | -150 | 757 | 49 | 299 | -277 | -651 | 839 | -485 | 392 | -910 | 599 | 300 | -401 | 623 | 162 | -99 | 38 | -448 | 1107 | 126 | 382 |
| - | * | * | * | * | * | * | * | * | * | * | * | * | * | * | * | * | * | * | * | * | |
| - | * | * | * | * | * | * | * | * | 0 | | | | | | | | | | | | |

SEQUENCE LISTING (1923 sequences)

SEQ ID NO: 1 - DNA, 1689 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaa

SEQ ID NO: 2 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 3 - DNA, 1689 bp, Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaa

SEQ ID NO: 4 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 5 - DNA, 1599 bp, Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 6 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 7 - DNA, 1692 bp, Candida glabrata
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaa

SEQ ID NO: 8 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 9 - DNA, 1788 bp, Pichia stipitis
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagct

SEQ ID NO: 10 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 11 - DNA, 1707 bp, Pichia stipitis
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaat

SEQ ID NO: 12 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 13 - DNA, 1689 bp, Kluyveromyces lactis
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtcctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctgacttggttctatcggtcggtgctctattgtccgatttcaacactggttctttctcttactcttacaagaccaagaacattgtcgaattccactctgactacaccaagatcagaagcgctaccttcccaggtgtccaaatgaagttcgctttacaaaaattgttgactaaggttgccgatgctgctaagggttacaagccagttccagttccatctgaaccagaacacaacgaagctgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgctaccaacgctaagaac

SEQ ID NO: 14 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 15 - DNA, 1713 bp, Yarrowia lipolytica
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtt

SEQ ID NO: 16 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 17 - DNA, 1713 bp, Schizosaccharomyces pombe
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaa

SEQ ID NO: 18 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 19 - DNA, 1689 bp, Zygosaccharomyces rouxii
atgtctgaaattactctaggtcgttacttgttcgaaagattaaagcaagttgacactaacaccatcttcggtgttccaggtgacttcaacttgtccttgttggacaaggtctacgaagtgcaaggtctaagatgggctggtaacgctaacgaattgaacgctgcctacgctgctgacggttacgccagagttaagggtttggctgctttgatcaccaccttcggtgtcggtgaattgtctgctttgaacggtattgcaggttcttacgctgaacacgttggtgttttgcacattgttggtgttccatctgtctcttctcaagctaagcaattgttgttgcaccacaccttgggtaacggtgacttcactgttttccacagaatgtccgccaacatctctgaaaccaccgctatgttgaccgacatcactgctgctccagctgaaattgaccgttgcatcagagttgcttacgtcaaccaaagaccagtctacttgggtctaccagctaacttggttgaccaaaaggtcccagcttctttgttgaacactccaattgatctatctctaaaggagaacgacccagaagctgaaaccgaagttgttgacaccgttttggaattgatcaaggaagctaagaacccagttatcttggctgatgcttgctgctccagacacgacgtcaaggctgaaaccaagaagttgatcgacttgactcaattcccatctttcgttactcctatgggtaagggttccatcgacgaacaaaacccaagattcggtggtgtctacgtcggtactctatccagcccagaagttaaggaagctgttgaatctgctgacttggttctatctgtcggtgctctattgtccgatttcaacactggttctttctcttactcttacaagaccaagaacgttgttgaattccactctgaccacatcaagatcagaaacgctaccttcccaggtgttcaaatgaaattcgttttgaagaaactattgcaagctgtcccagaagctgtcaagaactacaagccaggtccagtcccagctccgccatctccaaacgctgaagttgctgactctaccaccttgaagcaagaatggttatggagacaagtcggtagcttcttgagagaaggtgatgttgttattaccgaaactggtacctctgctttcggtatcaaccaaactcacttccctaaccaaacttacggtatctctcaagtcttgtggggttctattggttacaccactggttccactttgggtgctgccttcgctgctgaagaaattgaccctaagaagagagttatcttgttcattggtgacggttctctacaattgaccgttcaagaaatctccaccatgatcagatggggtctaaagccatacttgttcgttttgaacaacgatggttacaccattgaaagattgattcacggtgaaaccgctgaatacaactgtatccaaccatggaagcacttggaattgttgaacaccttcggtgccaaggactacgaaaaccacagagtctccactgtcggtgaatggaacaagttgactcaagatccaaaattcaacgaaaactctagaattagaatgatcgaagttatgcttgaagtcatggacgctccatcttctttggtcgctcaagctcaattgaccgctgctactaacgctaagcaa

SEQ ID NO: 20 - protein, 563 aa, Zygosaccharomyces rouxii
MSEITLGRYLFERLKQVDTNTIFGVPGDFNLSLLDKVYEVQGLRWAGNANELNAAYAADGYARVKGLAALITTFGVGELSALNGIAGSYAEHVGVLHIVGVPSVSSQAKQLLLHHTLGNGDFTVFHRMSANISETTAMLTDITAAPAEIDRCIRVAYVNQRPVYLGLPANLVDQKVPASLLNTPIDLSLKENDPEAETEVVDTVLELIKEAKNPVILADACCSRHDVKAETKKLIDLTQFPSFVTPMGKGSIDEQNPRFGGVYVGTLSSPEVKEAVESADLVLSVGALLSDFNTGSFSYSYKTKNVVEFHSDHIKIRNATFPGVQMKFVLKKLLQAVPEAVKNYKPGPVPAPPSPNAEVADSTTLKQEWLWRQVGSFLREGDVVITETGTSAFGINQTHFPNQTYGISQVLWGSIGYTTGSTLGAAFAAEEIDPKKRVILFIGDGSLQLTVQEISTMIRWGLKPYLFVLNNDGYTIERLIHGETAEYNCIQPWKHLELLNTFGAKDYENHRVSTVGEWNKLTQDPKFNENSRIRMIEVMLEVMDAPSSLVAQAQLTAATNAKQ

SEQ ID NO: 21 - DNA, 2433 bp, Gluconacetobacter diazotrophicus PAl 5
atgacgtccgccccccgcatgtcagtttcggaaggaacgaagatgaacgagatgtcccccctgtccaccgcgcccctgacggccacgccgctgtcggcggcggaactcggcctgttcaaccggtggtggcatgcggcgaactatctgtcggtgggccagatctacctgctggccaacccgctgctgcgtgaaccgctgaagctggaacataccaagccgcgcctgctgggccactggggcacgaccccggggctgaacttcctctacctgcacctcaaccgcatcatccgcgcgcgggacgccaacatcctcttcatcgccggtcccgggcatggcgcgccgggcgtcgtggccaatacgtacctcgaaggcacgtacagcgaatatttccccgaggtgtcgcaggacgaaaacgggctgggccgactgctgaagcagttttccttccccggcggcattcccagccacgcggcggcgacgaccccgggctcgattcatgagggtggcgagctgggctactcgctctcgcacgcctatggcgcggtgttcgacaatcccgacctgatcgtggcctgcgtcatcggcgatggcgaggccgagaccggtccgctggccacgtcgtggcacagcaacaagttcctcgacccgcagaccgacggcgccgtgctgccgatcctgcacctgaacggctacaagatcgcgaaccccaccatcctggcccgcattccgcagcccgaactggaagcgctgctgcggggctacgggtacgatccgatcttcgtcgaaggccacgaccccgacccaatgcaccagaagatggcgacggccatggacctggccttcgaccggatcgccgcgatccagaaggcggcgcgcgagggcgggcagaccgaacgccccacctggccgatgatcgtcatgcgcagccccaagggctggaccgggccgaaggaaatcgacggcctgcggaccgaaggctactggcggtcgcatcaggtgccgttctcggacctgaccaagcccgggcacctgcaggcgctggaaacctggctgcgcagctacaagcccgaggacctgttcgacgaatccggccgcctgttcgccgacatcgcggccctggccccgtccggcgcacggcgcatgagcgacaacccccatgccaatggcggacagttgcgccacccgctgaaactgccggacatcgcgaactacgccgtgccggtcaccacgccgggcagcgtgacgggcgagggcacgcgcgtgctgggcacgtggctgcgcgacgtgatgaaggaaaacctgccctcgcgcaatttccgtgtcctggccccggacgaaaacaattccaaccgcctgaacgcggtgctggacgtcaccaaccgcgcgtggaacgcggaaacggtggattatgacgaccacttggcgcgcgacggccatgtgatggaaatcctcagcgagcacacctgccagggctggctggaaggctacctgctgaccggccgccatggcttcatgtcgtgctacgaggcgttcatccacattgtcgattcgatggtgaatcagcatgcgaaatggctgaagacctcggccgaagtgccgtggcggcggtcgatttcctcgctgaactacctgctgacgtcgcatgtctggcgccaggaccataacggcttcagccaccaggaccccggcttcatcgatcatgtgatcaacaagaaggccgatatcgtccgcgtgtacctgccgcccgatgccaacaccctgctctgcaccgccgcgcactgcctgcatagctgggaccgcatcaacgtcatcgtggccggcaagcagccggaaccgcaatggctgagcatggaagacgccatccgccattgcagcgccggcatcggtatctgggaatgggccagcaacgacaagggcagcgaaccagacgtggtgatggcctgcgccggcgacgtacccaccatcgaaacgctggcggcggtcaagctgttgcgtgagcacgcgccggacctgaagatccgcgtcatcaacgttgtggacctgatgacgctggaatcggccagccagcacccgcacggcctgacggattccgccttcgacgcgctgttcacgctggacaagccggtcatcttcgccttccatggctatccgcagctgatccacaagctgatctaccgccgcgccaacgcccggaacttccacgtccacggcttccgcgaggaaggatcgaccaccaccccgttcgacatggtggtgcgcaaccacctcgaccggttccacatcgtctcgaacgtcatcgaccgcgtgcccggcctggccacccgcgccgcctacgccaaacaggccatccgcgacaagctggtggaccacacccgctacatcgccgaatacggacgcgacatgccggaaatcgaagactggcgctggtcgtaa

SEQ ID NO: 22 - DNA, 2367 bp, Shewanella loihica PV-4
atgtcacaacagcaagagatcaccgcactaaagaaatttgtaagagcgaccaacttcctggccacctcgcaaatctaccttaagcagaacgtactgcacaagcgtccgctagagcatagcgacatcaaacccagactgctagggcactggggtacttgtccaggtatcaacttcgtctacgctaacgtcaaccgtctcatcaagaaaaccaaccgtcctttcctctaccttgtcggcccaggccatggcttcccagccgtacaagctaacctgtttatggaaggatctttgagtcatttctatccagagacgattccgtacaacgagacaggtatcgaagatatctgtaagaaattttcagccgcctatggctacccttctcacgctaacccagaagcaccgggtcagatcctcgaaggtggtgagctaggttactcgctctcagttgcttggggtgcagtactggataaccctaacctcatcgctaccgtacttattggtgacggcgaatcagaaaccggcccactggcagcctcttggtatgctaaccgtctggtatctccagccaacaacggtgccgtactgccaatcgttcacatcaacggctacaagatctctggcccaacccgtatgggacgcatgagccacgaagaacttgagcttgaatttaaaggccttggctaccacccaatcattgtcgacagcgaccttgaagaagatgtctacgtgcagatgaccaaagcgatggatgaatcctatgccatgatcgaagccattcagaccaaggcacgtagcggcgaagatgtcgttaagcctcgctggccagtgattctgatgcgcaccgcaaaaggttggacaggcgttgccgaagacaatggtaagaaactagaaggcaactgtgaatcgcaccaagttatcgttaacaagtgtgcgaaagacaaacaacaccttgaagccttagatcaatggcttgccagctacaagttcaacgaactttatagcatcaacgagcaaaaccagatcgtgttcgacaaagacattcaatcattgctcccaccaaaagagctttgctgtggtcgtcaacacctgagctatggcggcgaagtggttcgttcactgaacaatcctaagctggaagacctggcctacggtgcagaaacgcctagaggccaacgtggttactctatgctgaagatgggtcaatggatgcgtgatgcattcaagctcaacagagaccaacgcaacctgcgtatcttcagccctgacgaaacctactctaaccagctgcaagctgtgtttgaagagacagatcgtgcatggcaatggcctatcgaaagctgggacgaagatatgtctcgcgacggtcgcgtacttgagctgctatctgagaacctgctgttcggcatgctacacggctacacagtaacgggtcgtcacggcatgttcccaacttatgagtcattctcacaggtggtctcctctatggcagaccaatactgtaagtatgtctatgcgagccaaggcgtacacttccgtaagccagtgcccgcttgtaacgtcgtgctctcttcactgctggagcgccaagaccacaacggttattctcaccagaacccttctttcctaggggctatgcttgagaaacacccagagatcatctcggcttatctgccagcagatgctaactcgacactggtttacacagagcgtgccttcgccgatcgcgataaactcaacatcatcgccgccggtaagaaagagttgccacaatggctaactttggacgaagcccgtcaacaggctaaagatggtgtcatggtgtgggacttcgcctcagatgaaaacccagacgtagtactggcaggctgtggtgactatgtgacccaggaatgtatggcctccctggtcatcctgcgtgaactactaccaagagtccgcgtccgcttcgtcagcgtaaccgagctaaccagcagcggtctgggtagccgtaagttccaaagcaagccttggatgatggatgagatcttcaccgccgataagggtgtggtcttcaactaccacggttatccaaacaccatcaagaaactggtattcgattacaaaggtagccacagattccgcatcaagggctatgaagaggaaggttcaaccactacgccattcgacatgggtgtgcgcaacggtacttctcgctaccacctggttatcgatatggcttacaagctattccaacaaggtgtgatcgacgagacacaacacgttgccatcaccactgacatgctacaacgtctggttgaccaccgtaactacatcaaggcaaacggtgtcgacccagaaaacatcgaaaactggatctggacacgttaa

SEQ ID NO: 23 - DNA, 2367 bp, Shewanella amazonensis SB2B
atgactcaacagcacgagattaccgcactgaagaaatttgtgcgggccactaactttctagccacctcacagatttatctcaagcagaatgtgttacacaagcgaccactggttcacggagatatcaaacccagactgctcggtcactggggtacctgtcccggcatcaattttgtttatgccaacgtcaaccgtctcatcgtaaaacacaagcgccccttcctctatttagttggcccaggccatggcttccctgctgttcaggcaaacctgtttattgaaggctcactgagtcacttctaccccgaaaccattccgtacaatgaaaccggcatcgaagatatctgtaagaaattttcagccgcctacggttatccttcacatgccaacccagaagcgccaggacaaattctggagggtggtgagctgggttattccttgtctgtaggttttggtgccgtgctggacaaccccgatctgattgccaccgtgctcgttggggacggtgagtccgagaccggccccctggccgcgtcctggtacgccaaccgcctggtcaacccagccacttgcggcgctgtactgccaatcgtgcacattaacgggtacaagatctcaggcccaacccgcatgggtcgtatgagccacgaagaactggatcttgaattccgcggtctgggttatcaccccatcattgtggacgatcagctggaagaagatgtctatgagcaaatggtcaaggccatggatctctcctatgagatgattaatgacatccaaacccgtgcccgaaatggtgaagacgtttgtaagccacgctggccggtgatcctgatgcgcaccgccaaaggttggactggtgtagccgaagacaagggtaagaaacttgaaggtaactgtgaatcgcaccaggttatcgtcaataagtgcgccacagataaaggccacctcgaagccttggataactggctggcaagctatggatttgcagagctttgcagcgtgacagaacagggcgaactccagtttgaccccgatatcaagtcacttatcccgcccaaagaactctgctgtggtcgtcaacgcctgtcctatggtggcgaagtagtccgtgcactgaccaaccccgatctgaccaagttggcttacggcgcagaagtaccacgtggtcatcgtggctactccatgaataaaatgggcgagtggatgcgtgaagccttcaaactgaaccgcgatcagcgcaatctgcgcatcttcagtccggatgaaacatactccaaccagctgcaagccgtatttgaagaaaccgatcgcgcgtggcagtggcctatcgaaagttgggaccaggacatgagccgcgacggccgcgtgttggagctgctgtctgaaaacctgctgtttggtatgatgcacggatacacggtaacgggtcgtcacggtatgttcccaacctatgaggccttctcgcaggtggtctcttcaatggcggaccaatactgtaaatacgtttacgcaagccagggcgtccatttccgtaagccactgccatcctgcaacgtcgtactttcttctctgcttgagcgtcaggatcacaacggttattcgcaccagaaccccagcttcctcggtgccatgctggaaaaacacccagagatcatttctgcctatctgccagccgatgccaacagcactctggtttataccgagcgtgcgtatgctgaccgcgacaaattgaacatcattgttgcaggtaagaaagagctgcctcaatggttgaccctggatgaagcccgtcgccaagccaaagatggtctgatgatttgggactttgcctctgatgacaacccggatgtggtactggcgggctgtggtgactacgccacccaggagtgtatggcttcattggtactgattcgcgaattgctgccacgggtacgtttacgcttcgtaagtgtgtctgaactcaactccaatggccttggcagtcgtaagttccagcaaaagccctggatgatggacgaaatctttaccaaagataaaggcgtggtgttcaactaccacggttatccaaacaccatcaagaaactggtattcgattacaaaggtagccacagattccgcattaagggctatgaagaggaaggttccacaaccacaccattcgatatgggcgtgcgaaatggcacttcacgctatcacctggtaatcgatatggcctataaattgttccagcaagggattatcgatgaaacccaacatgtggccatcaccacagatatgctgcaacgtttggttgaccataagaattatattaaggccaatggcgtagatccgattcacatcgaaaattgggtgtggacccgttaa

SEQ ID NO: 24 - DNA, 2367 bp, Shewanella sp. MR-4
atgacgactacacatgagattaatgctcttaaaaagtatgtaagagccacaaacttcctcgctacgtctcagatttatctaaaacaaaacgtattgcacaaacgcccccttgcgcattcggacattaagcctcgtttgctcggtcactggggaacttgtccaggtatcaactttgtctatgccaacgtcaaccgactcattgtaaaacataatcgtcctttcatttacttagttggcccaggccatggcttccctgctgtacaagctaacttattcattgaaggctcactcagccacttctacccagaaaccattccttataatgaaaccggcatcgaagatatctgtaagaaattttctgcagcctatggttatccttcccatgcaaacccagaagcaccaggtcaaatccttgaaggcggcgaattaggttattcattatcagttggctggggcgcagtattagacaacccagatcttatcgctacagtattagttggtgacggtgaatcagaaactggtcctctggcagcatcttggtatgccaaccgcttagtttcacccgcaaccaacggtgctgtattgcctatcgtacatatcaacggttataagatttcaggcccaacccgtatgggacgcatgagccatgaagaattagatcttgaattccgcggtcttggctaccacccaattattgttgacagcgaagcggaagaagatatctacattcagatggcgaccgccatggataccgcttatagcatgatcaacgatattcaaactcgagcacgtaagggtgaagatattgtcaaacctcgctggccagtgattttaatgcgcaccgccaagggctggacaggtgtgagcgaatataacggtacgaaattggaaggtaactgcgagtcgcaccaagttatcgtcaataaatgtgccactgataaaggccacttagctgcactggatagctggttagccagttatcaattccaagagctttaccaaatcaacgggcagggtgaactgatttttgatgccgatattagctcactgatcccgccaaaacatttagcttgcggtcgccaacatctcacttatggtggtgaagtcgtcagagccttatctaatccagatctagaaaagctcagctatggcccagaagtaccacgtggacaccgcggttactctatgctgaaaatggggcaatggatgcgcgacgcattcaaattgaaccgtgatcaacgcaacttacgtatcttcagcccagatgaaacctattcaaaccagctgcaagcagtatttgaagaaaccgaccgcgcatggcaatggccaattgaaagctgggacgaagacatgtctcgcgatggtcgagtactcgagttgctctcagagaacttactgtttggtatgctgcatggctacacagtgacgggacgtcacggaatgttccctacctatgagtctttctcacaggtcgtatcctccatggctgaccaatattgtaagtatgtttacgccagtcaaggagtgcatttccgtaagcctttaccggcgtgcaacgtggtactttcttcattattagaacgtcaagatcacaacggttattcgcaccagaacccatcattcctaggtgcgatgcttgaaaaacatccaaagattatttctgcttatttacctgcggatgctaacagcaccttagtttataccgaacgcgcttttgcagatcgtgacaaattgaacatcctagtcgcaggcaaaaaagaactgccacaatggctcagtttagaagaagcgcgtaaacaagctaaagacggcgtcatggtgtgggattttgcttccgatgaaaatccagatatcgtgcttgcaggttgtggtgattatgtcactcaagaatgtatggcctctttagtgattattcgtgaactattacctagagtcagaattcgctttgtcagcgtgacagaattaagcagcgatggtttaggtagtcgtaaatttaaagaaaaaccatggatgatggatgaaatatttacccaagataaaggggtagtatttaactatcacggttatccaaatacgatcaaaaagttaatatttgattacaaaggaagccgtcgcttcagaattaaaggttacgaagaagaaggttcaacaaccactccatttgatatgggtgttcgaaatggcacttctcgctatcaccttgttattgatatggcttacaaactattccagcaaggtgtcatcgacgaaaccaagcacgtttccatcacaaccgacatgctgcaaagactcgttgatcatcgcaactatattaaggcaaatggtgttgaccctgttgaaattgaaaattggatttggacccgttaa

SEQ ID NO: 25 - DNA, 2367 bp, Shewanella baltica OS155
atgacacaaatacatgaaatcaatgctctgaaaaaatatgtcagagcgactaactttcttgcgacctcgcagatttatctcaaacaaaacgtcttacataaacgtccacttgcccatactgatatcaaaccacgtttacttggccactggggtacctgccccggcattaactttgtttatgccaacattaaccgattgatagtgaaacataatcgctcgttcatctatttagttggtcctggtcatggtttcccagcagtacaagctaacttattcatggaaggttcattaagtcatttctatccagaaacgatcccctacaatgaaaccggtatcgaagatatttgtaagaagttttccgccgcttatggctatccttcacatgcaaacccagaagctccaggacaaattcttgaaggtggcgaactaggctactcactttctgttggctggggtgcagtactcgataatccagatctgatcgccaccgtcttaattggtgacggtgaagcagaaaccggaccattagccgcgtcttggtacgcaaaccgtctagtctctcctgcgacaagtggtgcagtattaccgattgtgcatatcaatggctataaaatttcaggccctacccgcatgggacgcatgagtcatgaagaactggatcttgaattccgtggtcttggctacttcccaattatcgttgataacgaattagaagaagatatctatgtgcagatgacgaatgccatggataccgcttatgccatgatcaatgatatccaacgtcgtgcccgtagcagtgaagatgtagttaagcctaaatggccagtgattttaatgcgcaccgccaaaggttggaccggtgtcagtgagtataaaggtaagaaattagaaggtaactgtgaatcacaccaagtgatcgtcaataaatgtgccacagataaaggtcatctggatgcactcgacaattggcttgccagttacaacttccaagaactttaccaaatgaatgataaaggcgagctgatttttgatgccgacatttgctcattaattccacctaagcaacttgcctgtggtcgtcaacatctcacctatggtggtgaagtggttagagcgttaacgaaccctgatctcgaaaaactcagctacggtccagaagtaccacgtggtcaccgtggttattcaatgttgaaaatgggtgaatggatgcgtgatgcattcaagctaaaccgcgatcaacgcaatctacgtatttttagccctgacgaaacctattcaaatcaactacaagccgtatttgaagaaaccgatcgtgcatggcaatggccaattgagagctgggatgaagacatgtcccgcgaaggacgagtgattgagctcctttctgaaaacttgctctttggtatgttgcacggctacacagtaacaggccgccacggcatgttccctacgtatgaatcattctcacaagtgatctcatcgatggccgaccaatactgtaaatacgtctatgcaagccaaggcgtgcatttccgtaagccactgccttcatgtaacgtcgtattatcttcgctgcttgaacgccaagaccataatggctactcgcatcaaaacccgtctttccttggggctatgctagagaagcatccaaaaattatctctgcttatttaccagcagatgctaacagcaccttggtttataccgaacgggcttacgccgaccgcgacaaactcaatattcttgttgctggtaagaaagagttaccacaatggttgagcttggaagaagcgcgtaaacaagcaaaagatggcgtgatggtgtgggatttcgcctctgatgagaatccagatattgtgctggcaggttgtggtgattacgtcactcaagagtgcatggcctcattagtattgatcagagaactccttccaagagtcaaaattcgcttcgttagcgtcaccgaattaagcagtgatggcttaggaagccgcaaatttaaagaaaaaccttggttaatggacgaaatatttacccaagataaaggcgtggtattcaattaccatggttacccaaatacgattaaaaagttaatatttgattacaaaggcagccgtcgcttcagaattaaaggctatgaagaagaaggttcaacaaccactccattcgatatgggcgttcgtaacggcacatcacgttatcacctagtgattgatatggcttacaaactgttccaacagggcgttattgatgaaactatgcacgtttccatcaccactgacatgctgcaaagactagttgaccaccgcaactatattaaagcgaatggtgtcgacccaatagaaattgagaattggatatggacacgttaa

SEQ ID NO: 26 - DNA, 2379 bp, Shewanella benthica KT99
atggggttatttatgtcacaacagcaagagatcggcgcattaaagaaatttgtcagagcgacaaactttctagcgacatcgcaaatttatcttaagaaaaacgtactgcataagcgtgcactcgaacacacagatatcaagcctagactattaggtcactggggcacttgcccagggatcaactttgtttacgctaacatcaaccgtcttatcgttaagaataatcgctcattcgtctaccttgtaggcccaggtcacggtttccctgcagtacaagctaacctattcatggaaggttctcttagtcattattaccctgaaaccattccatacagtgaagaaggtatcacagatatctgtcagaagttttcagcagcttatggttacccttcacacgctaacccggaagcacctggacaaatccttgaaggtggcgaactaggttattcactttcagttgcctggggtgctgtattagataatcccgaccttattgcggcatgtctgattggcgatggcgagtcagaaacaggccctcttgccgcttcttggtatgccaaccgtttagtagaccctgccactaacggtgcggtgctacccatagttcatatcaacggttacaagatttctggtcccactcgtatgggccgtatgagccacgaagaattagatctcgaattccgtggcctgggttatttccctatcatagtcgatgaccaaaatgaagaagacgtctatgtgcagatgattaacgccatggataagtcatatgagatgatcaccgacattcagaaacgcgcgcgcagcggtgaagatgttgttaagccacgctggcctgtcatcttgatgcgtaccgctaaaggttggactggtactgcgcagtacgacggcaagaagcttgaaggtaactgcgaatctcatcaggtaatcgtcaataagtgtgctaccgataagggtcacttagacgcgctcaacacttggttaggcagttataagttcagtgaactttattcgattaacgataaaggcgagctcatcttcgatgaagagatccagagcctacttccacctaagcagttaacttgtggtcagcaacacttaagctacggtggtgaggtggttcgcgcactgactaaccctgacctatctaaactagcctacggtccagaaacacctcgtggtacacgtggtcactccatgtacaagatgggtgagtggatgcgtgatgcgatgaaactcaaccgcgatcaacgcaacctgcgtatctttagccctgatgaaacttactcgaaccagcttcaagccgtattcgaagagactaacagatcatggcagtggcccatcgaagagtgggataccgacatggcccgtgacggccgcgtcatcgagctattatccgagaacttgctcttcggtatgatgcatggttacacagtgacgggtcgtcacgccatgttccctacttatgaggcattctcacaagttatctcctcgatggctgaccaatactgtaagtatgtctatgccagccaaggcgttcacttccgcaagccagtaccggcatgcaacgtggtactatcttcgctgctagaacgccaagatcacaacggttactcgcatcagaacccatcattcttgggcgccatgcttgagaagcacccgaagatcatctcagcctatctgcctgcagatggtaacaccactctggtttacaccgagcgtgccttcgcggatcgtgataagttaaacatcatagttgccggcaagaaagacttgccacaatggctatcactcgatgaagcacgtgcacaggtcaaagacggtgtcatggtttgggacttcgcttccgatgaaaacccagatgtggttctggttggttgtggtgattacgtgactcaggaagcgatggcatctctggtattaatcagagagatactccctcgtgttcgtatccgtttcgtcagtgttaccgaactcaccagcagcggtcttggtagcttagacttccagagcaagccctggttgatggatgaagtcttcactgccgataagggcgttatctttaactaccatggctacccgaacaccatcaagaaactggtattcgattataaaggcaataacagattcagaatcaagggttatgaagaggaaggatcgaccacaacgccattcgatatgggtgtcagaaacggaacctcgcgttaccatctcgttatcgacatggcctacaagctgttccaacaaggtgttatcgatgagacacaacatgtcaccatcaccacagatatgctgcagcgccttgtcgaacatagaaactacatcaaggaaaacggtgtcgatcccatcagcctggacaactgggtctggactcgctaa

SEQ ID NO: 27 - DNA, 2367 bp, Shewanella sediminis HAW-EB3
atgtcacaacagcaagagatcagcgcgttaaagaaattggtaagagctacaaactttctagcgacatctcaaatttatctaaagaagaacgtactgcataagcgtgcacttgcacacacagatatcaagcctagactattaggtcactggggtacttgccctggtatcaactttgtctacgctaacatcaaccgtctaattgttaaaaacagccgttcattcgtctaccttgtaggcccaggtcacggtttcccagcagtacaagctaaccttttcatggaaggctctcttagccattattacccagagatcattccatacaatgaagaaggtatcaccgatatctgtcagaagttctctgcagcttatggttacccttcacacgctaacccggaagcacctggacaaattttagaaggtggcgaactcggttattcactttcagttgcctggggtgcagtattagataacccagacctgattgccgcttgtctgattggtgatggtgagtcagaaactggtcctcttgccgcttcttggtatgcaaaccgtttagtagaccctgccactaacggtgcggtactaccaatcgttcatatcaacggttataagatctctggtccaactcgtatgggtcgtatgagccacgaagaacttgatcttgaattccgtggtctgggttaccacccaatcatcgttgacgacgagctcgaagaagacgtctacgttcaaatggcaaatgccatggacacgtcatatgagatgatcaacgatatccagaaacgtgcgcgcagtggtgaagatgttgttaagccacgctggcctgtcatcttaatgcgtaccgctaaaggttggacgggtactgcagaatacaatggcaagaaacttgaaggtaactgtgaatctcaccaggttatcgtcaacaagtgtgctacagacaaaggtcacttagaagcgctaaacacttggttatcaagctataagttcgatgaactttatactattaacgataaaggcgagctaatcttcgataaagagatccagagcctacttccacctaaacagttaacttgtggtcagcaacacctaagctacggtggtgaagtggttcgtgcacttgccaacccagacctgtctaaacttgcttacggtgcggaaacgcctcgtggcacacgtggtctatctatgtacaagatgggtgagtggatgcgtgatgcaatgaaactcaaccgtgaccaacgtaaccttcgtatcttcagcccggatgaaacttactcgaaccagcttcaagccgtattcgaagaaactgacagagcatggatgtggccaatcgaagagtgggatgacgacatggcccgcgatggtcgcgttatcgagctactatctgaaaacttgcttttcggtatgatgcacggttatacagtgacaggtcgtcacgcgatgttcccaacttatgagtcattctctcaagttgtttcatcaatggcagaccaatactgtaagtatgtctatgctagccaaggtgtacacttccgtaagccggtaccagcatgcaacgtagtattgtcttcactgcttgagcgtcaggatcataacggttactcacatcagaacccatcattcctgggcgctatgcttgagaaacatcctaagattatctctgcttacctacctgcagatggtaacagcacactggtttacactgagcgtgcctatgccgaccgtgataagctaaacatcatcgttgccggtaagaaagacttaccacaatggttatcacttgatgaagcccgtcaacaagctaaagatggtgttatggtttgggacttcgcttccgatgaaaaccctgatgttgttctagttggttgtggtgattatgtcactcaagaagcgatggcggctctggtattaatcagagagttactaccacgcgttcgtatccgtttcgtcagtgtttcagaattaaccagcagcggtctaggtagcctggacttccaaagcaagccttggttaatggatgaagtatttacagccgataagggcgttgtattcaactaccacggttacccgaacaccatcaagaaacttgtattcgattataagggcagtgagcgcttcagaatcaagggctatgaagaggaaggttcaacgaccactccattcgatatgggcgttcgtaacggtacttctcgttatcacttagttattgatatggcttacaagctattccaacaaggtgtgatcgatgaaactcagcatgttgcaattacaaccgatatgctacagcgcttagttgaccatagaaactacatcaaggccaacggcgtcgacccaatcagccttgataactgggtatggactcgatag

SEQ ID NO: 28 - DNA, 2367 bp, Shewanella woodyi ATCC 51908
atgtcacaacagcaagagatcagcgcactaaagaaatttgttcgagctaccaactttctagccacttcgcaaatttacctcaagcagaacgtactacataaacgttcgcttactcactcagatattaaacctagactgcttggccactggggcacctgcccaggtatcaactttgtttatgccaacgtcaaccgccttatcgtcaagaaccagcgctcctttgtctatttagtcggccctggccatggttttcctgccgtacaagctaacctgtttatggaggggtctcttagccacttctacccagaaaacattccatacaacgaaactggcattgaagatatctgtaaaaagttctccgccgcttacggctacccatcccatgcaaaccctgaagcaccaggccaaattttagagggtggcgagctaggttattcgctttctgttgcctggggcgcagtactggataatcctgatttaattgcagcatgtcttgtgggtgatggtgaatcagaaacaggtccactcgcagcatcttggtatgctaaccgcttagttgaccctgcaaccaatggcgccgtactgcctatcgtccatattaatggttataagatctcaggcccaacccgtatgggacgtatgagccacgaagagctagatcttgagttccgcggccttggctaccatccaatcatcgttgacgatgagctcgatgaagatgtctatgtgcagatgacgaaagccatggacacctcctatgagatgataaccgccattcaaacccgtgcacgcagtggtgaagatgttgtcaagcctcgctggccagtgattttgatgcgtacagcaaaaggctggacaggtacctcacagtataatggtaagaagctagagggtaactgcgaatctcaccaagttatcgttaataagtgcgccacagataaaggccacttagatgctctcgatacttggcttgcaagctataactttaatgagctctactcaatcaacgaacaaggccagctaattttcgataaagagatccaatctctcattccaccagcagagctttgctgcggccgtcaacacttaagctatggtggcgaagtcgttcgtgccctgtccaaaccagaccttgaaaagctctcttatggtccggaaacaccaagaggacagcgggggctctctatgtataagatgggtgagtggatgcgtgatgcatttaaactcaaccgtgaccaacgtaacctacgtatcttcagccctgatgagacttactcgaatcaacttcaagcagtatttgaagaaacagaccgcgcatggcagtggcctatcgaggagtgggatgaagacatggcccgtgatggacgtgttatcgagctactttcagagaacttactcttcggtatgatgcatggctacactgtgacaggtcgccacgcgatgttcccaacttatgagtcattctcacaagttgtctcatcaatggccgatcagtactgtaagtatgtctatgccagccaaggggtacacttccgtaagccagtacctgcctgtaacgtggtgctatcatcgctccttgagcgtcaagaccacaacggttactcgcatcaaaacccgtcattcctcggcgcaatgttagagaagcaccctaagatcatctcagcttacctaccagccgacggtaacagcactttggtttatacagagcgtgcatatgaagacagagacaagctcaacatcttagttgcgggtaagaaagacttgcctcagtggctaacacttgatgaagcacgccaacaagcaaaagatggcgtcatggtttgggattttgcctccgatgaaaacccagatgttgtactcgttggttgtggtgattacgtcacccaagaagcgatggcatcactggtactcatacgtgagttactgccaagggtgcgtattcgctttgttagcgtcaccgagcttaccagcagcggcttaggtagcttggatttccaaagcaagccttggttaatggatgaggtatttaccgccgataaaggtgtggtatttaactatcacggttacccaaataccattaagaagttggtatttgattataaaggcagtgatagattcagaatcaaaggttacgaagaggaaggttcaacaacaacgccatttgatatgggcgttcgtaacggtacttctcgttaccacttggttattgatatggcttacaagttgttccagcaaggcgtcatcgacgaaacccaacacgtggccattaccacagacatgcttcagcgtctcgtggaccacagaaactatatcaaagctaacggtgttgaccctattagtcttgaaaattgggtctggactcgctaa

SEQ ID NO: 29 - DNA, 2367 bp, Shewanella halifaxensis HAW-EB4
atggcacatcagcaagaaattgtcgcacttaagaaatttgttcgagcaactaactttctggcgacatcacaaatttatttaaagaaaaacgtgctgcataaacgcgcacttgaacactccgatattaagcctaggctacttggtcactggggaacgtgcccaggtatcaattttgtctacgctaacgttaacaggctcatcaccaagcacaaccgctcattcgtttatttagttggccccggccatggctttccagctgttcaagcaaacttgtttatggaaggctccttaagccacttctaccccgataccattccatataatgaagacgggatcaccgatatctgccagaagttctctgccgcttatggttacccttcgcatgcgaaccctgaagcgccaggccaaatccttgaaggtggtgaactaggctattcactttctgttgcttggggcgctgttttagataatccagatctgattgccgcttgccttatcggtgacggtgagtcagaaaccggcccactagctgcctcttggtatgcgaaccgtttagtgtctgcaaagaataatggtgctgttttacctattgttcatatcaacggttataagatttcgggtccgactcgtatgggtcgtatgagccatgaagaactcgatcttgaatttagaggtctaggttaccatcccattattgttgatgatcaattagaagaagacgtttatcttcagatggctgccgcaatggataagtcatacgaaatgatcaatgacatccaaacccgcgctcgtgcaggtgaagatatcgttaagccacgctggccagtgatcttaatgcgtaccgctaaaggctggacgggtactgccgagtttgatggtaagaaattagaaggtaactgtgaatcccaccaggttatcgtcaacaaatgtgctagcaacaaaggtcacctcgatgcactaaatacttggcttgcgagctacaagtttaatgagctttatagtatcaatgaaaaaggcgagctgatcttcgacgaagatattcagtcccttctaccaccaaaagaactaacctgtggtcgccagcatttaagttatggtggtgaagtggttcgcgcactcgctaaacctgatctagaaaagcttgcctatggtcctgaaacccctcgcggccatcgcggcttatctatgtataagatgggcgaatggatgcgtgatgcatttaagcttaaccgcgatcagcgtaacttacgtattttctgtccagatgaaacctattcaaatcaactacaagccgtatttgaagagacgagccgtgcatggcagtggcctatcgaaagctgggatgaagatatgtctcgtgacggtcgagtcatcgagttgctatcagaaaacctattattcggtatgttacacggctacacagtaacgggtcgccatgccatgttcccaacttatgaggcgttctcacaagttgtttcttcaatggccgaccaatactgtaaatatgtatatgcgagccaaggcgtacatttccgtaagcctgttcctgcttgtaacgtagttttatcctcactacttgagcgccaagatcacaacggttattcacatcaaaacccctctttcttgggtgcgatgcttgagaaacacccgaagattatctcagcttaccttcctgcagatggtaacagcaccttagtttatactgagcgcgcttatgccgatcgcgacaagctcaacatcttagtggcgggtaagaaagatctaccacagtggctaacactcgatgaggctcgtcaacaagcaaaagatggtgtcatggtttgggatttcgcatcagatgaaaacccagatgtggtacttgtcggttgtggtgattatgtcactcaagaggcgatggctgcactggtgcttattcgtgagctgctaccacgtgtacgcattcgctttgtcagtgttacagaactcacaagtagtggtttaggtagcttagagttccaagctaagccttggttgatggatgaagtattcacggcagataaaggtgtagtattcaattatcacggttatccaaacacgattaagaaactagtgtttgattataaaggtagcaagcgcttcagaattaaaggctatgaagaggaaggctcaacaacaactccatttgatatgggcgttcgtaatggcacatcacgttaccatctagtcattgatatggcatacaagctcttccagagcagcgtgattgacgagtctcaacacgtggctatcaccaccgacatgctgcaacgcttagtcgaccatagaaattacatcaaggccaacggtgttgatcctgaaagcatcgaaaactgggtttggacacgttaa

SEQ ID NO: 30 - DNA, 2367 bp, Shewanella denitrificans OS217
atgacacaagctaacgaaattaaggcgcttaaaaagtatgttagagcaacaaactttttagccacctctcaaatctaccttaagcaaaacgtcctctacaaacgtcagcttgagcacacagatattaagcctagattactggggcactggggaacttgcccagggatcaactttgtctacgccaacataaaccgacttatcgttaagcataatcgtgaatttatctatcttgtaggcccaggtcatggcttccctgcggtgcaggccaacctatttatggaaggttccctaagccatttttatccagaaaccatcccatttacagaaactggcatcgaagatatttgtaaaaaattctcagcggcatacggttatccatcacatgctaacccagaagccccaggccaaatccttgaaggtggtgagctaggttattccttgtctgtcgcatggggctctgtgctcgataaccccaacctgattgcagcctgtttaattggtgatggtgaagctgaaactggaccactggccgcctcttggtacgctaaccgcttagtgtctccagccaataacggtgcggtattgccaatcgtgcatatcaatggctataaaatttcaggtcccactcgcatgggccgcatgagccatgaagaacttgatttagaattccgcggtctgggctatcaccccatcattgtcgatgacgaacaggatactgacatctatgagcagatgacagcggcaatggatttatcctatgagatgatcaccgacatacagcgccgcgctcgctctggtgaagatgtggttaagccgcgctggccggtgatcttaatgagaacagctaaaggctggacgggtacctctgaatacgcaggtaaaaagcttgaaggcaactgcgaatctcaccaagttatcgttaacaattgtgctaccgacaagggccacctaaacgcgcttgatcaatggctcgccagctacaaatttgatgaactagtacaaaccactgaaactggcgaattagtatttgataaagacattttattgctaataccaccaaaagacttatgctgtggccgccaacgcttaagctacggtggtgaagtggtacgtgccttagctaatccagatttggctaagctgggttatggcgccgaaaccccgcgtggacaacgtggttactccatgttgaaaatgggccagtggatgcgtgatgcatttaaactgaaccgcgatcaacgtaatctgcgtatcttcagcccagatgaaacctattcaaaccaacttcaagccgtgtttgaagaaacagatcgcgcttggcagtggccaattgaaagctgggatcaagatatgtctcgtgatggccgcgtgattgagttgctgtcagagaacttgctgttcggtatgttacacggttacacagtaacgggtcgtcacggcatgttcccaacgtatgaggctttctctcaagttgtctcttctatggcagaccaatactgtaaatatgtgcatgcaagccaaggtatacattttcgtaagcccattcctgcgtgtaacgtcgtattgtcttcactgctagagcgccaagatcacaacggttattctcaccagaacccgtctttcctaggcgccatgctagagaagcaccccaacattatctcggcttatttacccgcagatgctaacagcaccttggtttacaccgaacgtgcttatggagatcgcgataaactcaacattatcgtcgccggaaagaaatcgctaccccagtggttatcgctggatgaagcccgcaagcaggccaaagatggcatcatggtgtgggattttgcctctgatgaaaacccagacgtggtactggctggttgtggtgattacgccactcaagaatgcatggcctcactagtactaatccgtgagattttacccagagtgcgcatccgttttgtcagtgtgtcagaacttcacagcagcggcttaggtagccttaagttccaaagcaagccttggatgatggatgaagtcttcaccgaagataaaggcgtggtatttaactatcatggctatccaaacaccatcaaaaagctagtatttgattataagggtaaccgtcgtttccgcatcaagggttatgaagaagaaggttcaacgactacaccctttgacatgggcgtgcgtaatggtacttcgcgctaccacttagttatcgatatggcttacaagttgttccaacaaggggtgattgatgaaacgcaacacgttcgcatcactaccgatatgttacaacgtctggttgaccacaagaattacatcaaagccaacggcgtagatccagttgaaatcgaaaactgggtatggactcgctaa

SEQ ID NO: 31 - DNA, 2250 bp, Legionella drancourtii LLAP12
ttgattaataatttcttactgaaaaaaacactcgatttccaggatattaagccacggcttttggggcattggggtacttgtcctggaattaattttatttatgcacacctcaattttcttattaaaaaacatagagtacctactatttttattctcggtcctggtcatggttttgcggctttacaagccaacctttttatggaaggtactttaaaaacttattatcctcaagcgacccatgattatgttggtattgaatatttaataaaaaattttagttggccttatgggtttcccagtcatagtaatccaggggcacctggagttattcttgaagggggtgaattaggctattcattagctacagcttatggcgcggtacttgataatccaggtactcttattgcctgtgttgttggggatggtgaagcagaaacagggccttctgcaacggcttggcatttgaataaatttatagatccaacgaaaaatggggttgttttaccaattcttcatctcaatgggtataaaatttctggcccaactatttttggcagaatgaccaataaagaattaaaatcactcttttatggctatggttatgagccttttattgttgaaggtggcgctatttataaaaaaatgctcatcacccttgagacgtgttatcaacatattgatgctttacgaaaaaatgacaaaaacatacgtccgccaatgattatattaaaaacacctaaggggtggacgggaattaaaaaattacatggccagaaaattgaagggaattgtctcgctcaccaagtggtagtaacccatgcaaaaactgatcgtagtgaattacaggctttggagaattggttacactcttatcaatttaataccttatttgatgaaaaaaaggggtttatcgatgacattaccagtctgatacctgaaaacaccttgtgcatgggggcgaataaacatacttatgctgatcctgagctggtaaacaaattattgcttcctaatctaaatggtatgactgaagatattattcatcccggaagtatgggggcgagtagtatgcggtttgctggcgcttatcttgctgaattaattaaactaaatcaaacaaatcgtaattttagaatgttttcacccgatgaaacttattccaataaactggataaggtttttgaagagacaacacgtgcaaatctgcaggcccaaaaagcgtgggataaagatattagtgttgatggtcgtgtcattgaaatgctcagtgaacattcattgcaaggtttaatgcaaggctatgtgcttaccggtcgtcatgcccttttcgcatcttatgaggcatttattcaaattgtttccagtatggtggatcaatacatgaagtttttgcatgtctctcggcaatttccctggcgcggggaacttccttcccttaattacatcttaacttcatcaggctggcggcaagagcataatggcttttctcatcaaaatccgggattcatttccaatatactgcaaaaaaatggtgattatggtcgtgtctatttccctcctgatgcaaacagtaccttattcgtccttgaaaaatgctttcagtcgcgtaataaagtgaatgttattgtggcgggaaaaacatttgagccatgttggttgactccagagcaggcgaaaattgaattagagcagggcttaatgatttgggattttgctagcgatccgcatccagatattgttcttgcaggcgttggtgactatgtttctcttgaagcacttgcagccattaggttaattagacaagaaacgcctgctgtaaaaattcgttttgttaatattattgaattatctgctttaggattaggttattctcattcgttaacagaagagcaatttgatacgttctttacgggagacaaaccgattatttttaattttcatggctatcctgcggtactgcaacaacttctttttccttatggcaatacaaaacgattttatattcatggttatgttgaaaatggttcgacaacgaccccttttgacatgcatattcgcaacagaaccagtcgttggcaccttgctttggaagtattttctcttatggctcaaaggggtgttattgagactaaagtagtgatgagattaaataaaaaatataagaaaaaattcatggagcatacgcgctatattaaacaatatggagttgatccagatgagatagcgaaatggcaatggtcaggagaataa

SEQ ID NO: 32 - DNA, 2187 bp, Ajellomyces dermatitidis ER-3
atgcctggggagatcatcaaaaaagctaatccaaaggcattaccgtctcatctacctggggctatagatcaactggcggacaacgcatatctgaaacgggagctgaaatttgatgatattaagccgagattattaggtcattggggaacctgcccaggactgaccttcgtctattcccacctgaattacttgatatgcaaacatgaccttgacatgatatacgtcgtggggccaggccacggtgcaccggcaatcctaacagcgctctggatggaaggttctttggagagattttatccagactatagccgagacacaaagggccttacgaagctgatcacgacgttcagtaccacaggcggattttcaagtcatatcaatgccgaaactccaggagcaatccacgaaggcggcgaattgggatacgctctatccgtttcgtttggggcggtcatggacaagccggatttgattgtcgcatgtatcatcggcgacggcgaagcagaatctgggccgacagcaactgcacgaactatattcggatgcatggatgatcgcgagcttattgctttgtttgtcggatatggctatcaaccacgaattatcgacgatatgaaacatattgatgccgattttaatgcagctttggaatgggcattggctgaaatccgcgaaatacagaaggctgctcgttcgggaaatccgatcatgaaacctcgttggcctgttttgattctgcgaactccgaagggatggaccggtccaaaacaaatccatggtcaaattgttgaaggttctttcaatgcccaccaagtccctcttcccgccgccaagaaggaccaggaagaattaaagacactgaacgaatggctctcatcgtataagccgcaggaactatttacagaaggtggtggtttgactgatgatatcaatgcaatcatccctcgaaatgacctgaaaaagctggggcagcgaagtgaggtttatgaatcgtacaaggcacccaaactgcccaattggaagaaatttggaatcgagaagggcaagcaggaaagttctatgaaagccatcgctgagtttattgatcaagttttcgtcgataatcctcactctgtcaggttgttttcaccagacgagctggagagtaataaacttggtggtacgctggcacacacgggaaggaactgccagtgggaccaagatcgccaacgcccaggggtacacattgacggtcgagtgggtatatttccttcgtatgagagtttccttggcatcattcatacaatgatggttcaattttgcaagttcactaataagatgggcctagagacctcatggcgccgagacattgctagtaacaactacatcgagacaagcacctggactcggcaagagcacaatggattttcgcatcaaaacccatcgttcatttcggcagtgttgaatctaaaaccaaacgcggaccgcgtttacctaccactggacgcaaacacatccctttctacgctaaaccatcgcttgaagtccaagaactatatcaatctcatggttgggtccaagcagcccacgcctgtatttttgagcccggataaagcagaaaggcactgtcgcggtggtggttcggtttggaaattcgcgtctaccgacgaagggagggatccagatgtggttctcattggtatcggtactgaactcacattcgaagtcatccgggcagccgctctacttagagaacgggttccagagctgcgtgtgcgcgtagttaatgtaatggatttaatgatccttagcagggagacgagccacccgcatgccctgtcagacgaagcattcagcgctctcttcacacgcgagcgtccgatccacttcaattatcatggatacgagaccgaaatgaagggacttctctttggaagaccaaatatggaacgggttacaattgcgtcatatatggaagagggaagtaccacgacaccatttgatatgatgttggccaaccgagtttctcgattccatgttgctcaggctgcagttcgtggcggtgccattagggtcgaggatgttacgataaggagacaagagttgctttctgagtttgaccacgatgtgaatgaggcgaggaagtatatcctgcagcaccacaaggatcctgacgacatgtatgacatgccaaaattttctaattag

SEQ ID NO: 33 - DNA, 2034 bp, Ajellomyces dermatitidis SLH14081
atgatattcctgcaggacaacgcatatctgaaacgggagctgaaatttgatgatattaagccgagattattaggtcattggggaacctgcccaggactgaccttcgtctattcccacctgaattacttgatatgcaaacatgaccttgacatgatatacgtcgtggggccaggccacggtgcaccggcaatcctaacagcgctctggatggaaggagcaatccacgaaggcggcgaattgggatacgctctatccgtttcgtttggggcggtcatggacaagccggatttgattgtcacatgtatcatcggcgacggcgaagcagaatctgggccgacagcaactgcacgaactatattcggatgcatggatgatcgcgagcttattgctttgtttgtcggatatggctatcaaccacgaattatcgacgatatgaaacatattgatgccgattttaatgcagctttggaatgggcattggctgaaatccgcgaaatacagaaggctgctcgttcgggaaatccgatcatgaaacctcgttggcctgttttgattctgcgaactccgaagggatggaccggtccaaaacaaatccatggtcaaattgttgaaggttctttcaatgcccaccaagtccctcttcccgccgccaagaaggaccaggaaggattaaagacactgaacgaatggctctcatcgtataagccgcaggaactatttacagaaggtggtggtttgactgatgatatcaatgcaatcatccctcgaaatgacctgaaaaagctggggcagcgaagtgaggtttatgaatcgtacaaggcacccaaactgcccaattggaagaaatttggaatcgagaagggcaagcaggaaagttctatgaaagccatcgctgagtttattgatcaagttttcgtcgataatcctcactctgtcaggttgttttcaccagacgagctggagagtaataaacttggtggtgcgctggcacacacgggaaggaactgccagtgggaccagatcgccaacgcccaggggtacacattgactggtcgagtgggtatatttccttcgtatgagagtttccttggcatcattcatacaatgatggttcaattttgcaagttcactaataagatgggcctagagacctcatggcgccgagacattgctagtaacaactacatcgagacaagcacctggactcggcaagagcacaatggattttcgcatcaaaacccatcgttcatttcggcagtgttgaatctaaaaccaaacgcggcccgcgtttacctaccaccggacgcaaacacattcctttctacgctaaaccatcgcttgaagtccaagaactatatcaatctcatggttgggtccaagcagcccacgcctgtatttttgagcccggatgaagcagaaaggcactgtcgcggtggtggttcggtttggaaattcgcgtctaccgacgaagggagggatccagatgtggttctcgttggtatcggtactgaactcacattcgaagtcatccgggtagccgctctacttagagaacgggttccagagctgcgtgtgcgcgtagttaatgtaatggatttaatgatccttagcagggagacgagccacccgcatgccctgtcagacgaagcattcagcgctctcttcacacgcgagcgtccgatccacttcaattatcatggatacgaaaccgaaatgaagggacttctctttggaagaccaaatatggaacgggttacaattgcgtcatatatggaagagggaagtaccacgacaccatttgatatgatgttggccaaccgagtttctcgattccatgttgctcaggctgtagttcgtggcggtgccattagggtcgaggatgttatgataaggagacaagagttgctttctgagtttgaccatgatgtgaatgaggcgagggagtatatcctgcagcaccacaaggagcagctccaagctaataagatggtagatcctgacgacatgtatgacatgccaaaaatttttaattag

SEQ ID NO: 34 - DNA, 2421 bp, Ajellomyces capsulatus NAm1
atgcctggggaaatcatcgataaacccaatccaaaaccgcttccgtctcacctacctgaggtaatagaccaactggccgttcagctagcaagaacatcgctagaccagaatgtcattgattctctgcagagattccagcgtgcggcgaactatattgctgccgctatgatattcctgcaggacaatgcatgcttaaagcgagagttgaaatttgacgatattaaaccgagattactgggccattggggaacctgcccagggttgacctttgtctattcccacctgaattacttgatttgcaaacatgaccttgacatgatatatgtcgtggggccgggtcatggcgcaccaggaatcctagctgcgctctggatggaaggttctctcgagaaattctatccaggatatagtcgagacacgaaaggccttacgaagctgatcactacgttcagtaccacgggtggatttccaagtcatatcaacgccgaaactccaggtgcaatccacgaaggcggcgaattgggatatgctctatccgtttcgtttggggcggtcatggacaagccggatttgatagtcacatgcattatcggtgatggcgaagcagaatctgggccgacagcagcgtcctggcacggattcaaatatattgaccctgcagaatcgggggcggtgctgcccattctccacctcaatggatttaaaatcagtgaacgaaccatattcggttgtatggatgatcgcgaactcatcgctttgttcgtgggatacggttatcaaccacgaatcatcgacgatttggaacatgttgacatcgattttcatggagcactagaatgggcgttggaggaaatccgcaaaatacaacaggctgctcgctccggaaacccgattatgaaaccgcgttggcctgttttgattttgcgaactcctaagggatggactggtccaaaacaaattcgtggtcaaattatcgaaggttctttcaaagctcatcaagtccctcttcctggggtcaaaaaggacaaggaagaattgaatgtgctaaacgaatggttgtcgtcgtacaaaccacatgagctttttacagaaggcggtgatgtgatagatgacattaaggctatcatccctcgaaatgacttgaaaaagttagggcagcgaagtgatgtttatgaatcgtacaggacactcaaactgcgggactggaagggattccatatcgagaagggcaagcaggagagctctatggagattatcgccgagttcattgaccaagttttcgtcgataaccctcactctgttaggctgttttccccagatgagctagagagtaataaacttggtggcgcactagcacacacgggaagaaatttccaatgggaccagtttgctaatgcacagggtggtcgcgtaattgaagtattgagcgaacatatgtgccaggggtttttgcaagggtatacattgacaggtcgagtgggcattttcccttcatatgagagtttcctcggcattatacatacaatgatggttcaattttccaagttcaccaaaatgggcagagagaccgtgtggcgccgtgatattgccagtatcaattacatcgagacaagcacatggactcgacaagagcacaatggattctcgcatcaaaatccatcgttcatttcagcagtgttgaatctgaaaccaaacgcagcccgcgtttatttaccaccggacgcaaacacattcctttccacgttaaaccattgcttgaagtccaagaactatatcaatctcatggttgggtccaagcagcccacgcctgtatttttaggtccagatgaagctgaatgccactgtcgcgcgggcggttcggtgtggaaattcgcatctaccgatgaaggaaaagacccggatgtggtgcttgttggcgtcggtacagaactcacattcgaagtcgtccgggcagccgccctactcagggaacgggttccagaattgcgcgtgcgtgtagttaatatcacggatttaatgattcttagcagggagaccagtcacccgcatgccctgtcagacgaagcattcgacgctctcttcaccagcgaacgtacgatccatttcaattatcatgggtatgagactgaattgaggggacttctctttggaaggtcgcagatggaacgggttacaattgcatcatacatggaagaaggaagtaccacgacaccatttgatatgatgctgatcaaccgagtttctcgattccatgttgcacaggctgcagttcgtggtggtgccatcaggaacgaagatgttatgataaggagatgcgagctgctttctgagtttgaccataatatgaatgagacgaggaagtatatattgcagcatcataaggaccctgacgatatgtatgacacgccaaaattttcttga

SEQ ID NO: 35 - DNA, 2412 bp, Ajellomyces capsulatus G186AR
atgcctggggaaatcatcgataaacccaatccaaaaccgcttccgtctcacctacctgaggtaatagaccaactggccgttcggctagcaaggacatcgctagaccagaatgtcgttgattctctgcagagattccagcgtgcggcgaactatattgctgccggccattggggaacctgcccagggctgaccttcgtctattcccacctgaattacttgatttgcaagcatgaccttgacatgatatatgttgtgggaccgggtcatggcgcaccaggaatcctagctgcgctctggatggaaggttctctggagaaattctatccaggatatagtcgagacacgaaaggccttacgaagctgatcactacgttcagtaccacgggtggatttccaagtcatatcaacgccgaaactccaggtgcaatccacgaaggcggcgaattgggatatgctctatccgtttcgtttggggcggtcatggacaagtcagatttgatagtcatatgcattatcggtgatggcgaagcagaatctgggccgacagcagcgtcctggcacggattcaaatatattgaccctgcagaatcgggggcggtgctgcccattctccacctcaatggatttaaaatcagtgaacgaaccatattcggttgtatggatgatcgcgaactcatcgctttgttcgtgggatacggttatcaaccacgaatcatcgacgatttggagcatgttaacgtcgattttcatggagcactagaatgggcgttggaggaaatccgcaaaatacaacaggctgctcgctccggaaacccgattatgaaaccgcgttggcctattttgattttgcgaacgcctaaggttagtgcccaaatggcaatacactatgtcttgtcgatgttaacgtatatggttcagggatggactggtccaaaacaaattcatggccaaactatcgaaggttctttcaaagctcatcaagtccctcttccggcggccaaaaaggacaaggaagaattgaaggtgctaagcgaatggttgatgtcgtacaaaccacatgagctttttacagaaggcggtgatgtgatagacgacattaaggctatcatccctcgaaatgacttgaaaaagttagggcagcgaagtgatgtttatgaatcatacaggacactcaaactgccggactggaagggattccatatcgagaagggcaagcaggagagctctatggagattatcgccgagttcattgaccaagttttcgtcgataaccctcactccgttaggctgttttccccagatgagttggagagtaataaacttggtggcgcactagcacacacgggaagaaacttccaatgggaccagtttgctaatgcacagggtggtcgtgtaattgaagtattgagcgaacacatgtgccaggggtttttgcaagggtatacattgacaggtcgagtgggcattttcccttcatatgagagtttcctcggcattatacatacaatgatggttcaattttccaagttcaccaaaatgggcagagagaccgtgtggcgccgtgatattgccagtatcaattacatcgagacaagcacatggactcgacaagagcacaatggattctcacatcaaaatccatcgttcatttcagcagtgttgaatctgaaaccaaacgcagcccgcgtttatttaccaccggacgcaaacacattcctttccacgttaaaccattgcttgaagtccaagaactatatcaatctcatggttgggtccaagcagcccacacctgtatttttaggtccagatgaagctgaaagccactgtcgcgcgggtggttcggtgtggaaattcgcgtctaccgatgaaggaaaagacccggatgtggtgcttgtcggcgtcggtacagaactcacattcgaagttgtccaggcagccgccctactcagggaacgggttccggaattgcgcgtgcgtgtagttaatgtcacggatttaatgattcttagcagggagaccagtcacccgcatgccctgtcagacgaagcattcgacgctctcttcaccagcgaacgtccgatccatttcaattatcatgggtatgagactgaattgaggggacttctctttggtaggccgcagatggaacgggttacaattgcatcatacatggaagaaggaagtaccacgacaccatttgatatgatgctgatcaaccgagtttctcgattccatgttgcccaggctgcagtttgtggtggtgccatcaggaacgaagatgttatgataaggagatgtgagctgctttctgagtttgaccataatatgaatgagacaaggaagtatatcatgcagcatcataagggtaagtttacccctgtaccatttttgaacgatcaggctctggattag

SEQ ID NO: 36 - DNA, 2331 bp, Paracoccidioides brasiliensis Pb03
atgcccggcgaagttattgacatagctaatccaaagtcattaccgtctcacttgcctccactgatagatcaattggccgtccagctgtccaggacttcactggatgaaaatgtcttcagatcgctacaaaagttccagcgtgcggcaaactatattgctgctgctatgattttcctccaggacaatgcatatctgaagcgtgagctgaaatttgatgatatcaagccaaggttattaggtcactggggaacctgccccggattgacatttgtctattctcacttgaactacctgatatcccaacatgaccttgacatgatatacgtcgtgggaccaggccatggggcgccggggatcctagctgcgctttggctggaaggttctctggagagattctatccagattatgctcgaaacgcaaagggcctaacgaagctggtcacttcgttcagcaccccgggtggatttccaagtcacatcaacgccgaaactccgggagcgatacacgaaggtggtgaattgggatatgcattatcagttgcgtttggtgctgtcatggacaagccggatttgattgccacatgcatcattggtgacggcgaagcggagactgggccaacagctgcatcctggcacggattcaagtttcttgaccctgcagaatcaggggctgtattacctatcctccacctcaatgggttcaagatcagcgaacgaactatattcggatgcatggatgaccgcgagcttgttgccttattcgccggatatggatatcatccacaaattatcgacgatttggaacatattgacgctgattttaatacagctctagaatggaccctgggtgagatccgtaagatacagaaagctgctcgatccgggaatccggtcacgaaaccccgttggcccatactgattctacgcactcccaagggatggaccagcccaaaacaaatccacggtcagattatcgaagggtcattcaaggcccaccaagtacccttgcctgctgctaaaacagacgaaaaggaattaaaggagttgaacgcatggctcttttcgtataaaccggcggaattgtttaccgaagacggtggtgtgagtgacgacattaatagcatcattcctcgtaatgataagaagaaacttggccagcgagatgaggtgtatgaatcgtataagcctttcaagctagccgactggaggaaatttggagtcgaaaagggaacgcaggaaagctctatgaaggctattgctgaattgattgaccaagttttcgtcgacaatcctcactcaatacggctgttttctcctgatgaattagagagcaacaagcttggtggagtattggcgcacacaggaagaaatttccaatgggaccaattctcgaatgcaaagggtggtcgcgttatcgaagtattaagcgagcacctgtgtcaggggtttttgcaaggttacacattgacgggtcgagtgggaatattcccctcctatgaaagtttcctcggtattatccacacaatgatggttcagttttgtaagttcactaagatgggcagagacacttcgtggcggcgtgatattgcaagtatcaactacatcgaaaccagcacctggacccgacaagagcataatggattctctcatcagaatccgtcattcatctcagcgaattatatcaacctcatgattggatccaagcagcccacaccggtgatcttaagcccggaggaagcagaaagccactgtcgggcgggcggttcggtatggaaatttgcctccatagatgaagggcgggacccagacgtcgtcctggcggggatcggcacagaactgacgttcgaggtcatccaggccgctgcattactcaggaaacgtgttccagagctccgtgtgcgcgttgtaaatgtgacagacttgatgattctgggcgcagagactggccatcctcatgcactgtcagacgaagcatttaatgccctttttacagctgatcgcccaatccatttcaattaccatggatacgagacggaaatgaaggggcttctctttggaagacagcagatcgaacgagttacgattgcgtcatatatggaagaagggagtaccaccacgccgtttgatatgatgcttgccaacagagtttctcgatttcatgtagcccaggctgcagttcgaggcggagcagttagaaatgagggagtaagaataaggagacaggggctgctttcggaatttgacttcgatatgaatgagacgttgaagtacatctctgagcatcacaaagatcctgatgacatgtatgacatgccaaagttttctgattag

SEQ ID NO: 37 - DNA, 2316 bp, Paracoccidioides brasiliensis Pb18
atgcccggcgaagttattgacaaagctaatccaaagtcattaccgtctcacttgcctccactgatagatcaattggccgtccagctgtccaggacttcactggatgaaaatgtcttcagatcgctacaaaagttccagcgtgcggcaaactatattgctgctggtcactggggaacctgccccggattgacatttgtctattctcacttgaactacctgatatcccaacatgaccttgacatgatatacgtcgtgggaccaggccatggggcgccggggatcctagctgcgctttggctggaaggttctctggagagattctatccagattatgctcgaaacgcaaagggcctaacgaagctggtcacttcgttcagcaccccgggtggatttccaagtcacatcaacgccgaaactccgggagcgatacacgaaggtggtgaattgggatatgcattatcagttgcgtttggtgctgtcatggacaagccggatttgattgccacatgcatcattggtgacggcgaagcggagactgggccaacagctgcatcctggcacggattcaagtttcttgaccctgcagaatcaggggctgtattacctatcctccacctcaatgggttcaagatcagcgaacgaactatattcggatgcatggatgaccgcgagcttgttgccttattcgccggatatggatatcatccacaaattatcgacgatttggaacatattgacgctaattttaatgcagctctagaatgggccctgggtgagatccgcaagatacagaaagctgctcgatccgggaatccggtcacgaaaccccgttggcccatactgattctacgcactcccaagattatcgaagggtcattcaaggcccaccaagtacccttgcctgctgctaaaacagacgaaaaggaattaaaggagttgaacgcatggctcttttcgtataaaccggcggaattgtttaccgaagacggtggtgtgagtgacgacattaatagcatcattcctcgtaatgataagaggaaacttggccagcgagatgaggtgtatgaatcgtataagcctctcaagctagccgactggaggaaatttggagtcgaaaagggaacgcaggaaagctctatgaaggctattgctgaattgattgaccaagttttcatcgacaatcctcactcaatacggctgttttctcctgatgaattagagagcaacaagcttggtggagtattggcgcacacaggaagaaatttccaatgggaccaattctcgaatgcaaagggtggtcgcgttatcgaagtattaagcgagcacctgtgtcaggggtttttgcaaggttacacattgacgggtcgagtgggaatattcccctcctatgaaagtttcctcggtatcatccacacaatgatggttcagttttgcaagttcactaagatgggcagagacacttcgtggcggcgtgatattgcaagtatcaactacatcgaaaccagcacctggacccgacaagagcataatggattctctcatcagaatccgtcattcatctcagcggtgttgaatttaaaaccgaatgcagcccgtgtctacctgccaccagacgcaaacacgtttctttgcacattgtgtcattgtctgaaacccaagaattatatcaacctcatgattggatccaagcagcccacaccggtgatcttaagcccggaggaagcagaaagccactgtcgggcgggcggttcggtatggaaatttgcctccatagatgaagggcgggacccagacgtcgtcctggcggggatcggcacagaactgacgttcgaggtcatccaggccgctgcattactcaggaaacgtgttccagagctccgtgtgcgcgttgtaaatgtgacagacttgatgattctgggcgcagagactggccatcctcatgcactgtcagacgaagcatttaatgccctttttacagctgatcgcccaatccatttcaattaccatggatacgagacggaaatgaaggggcttctctttggaagacagcagatcgaacgagttacgattgcatcatatatggaagaagggagtaccaccacgccgtttgatatgatgcttgccaacagagtttctcgatttcatgtagcccaggctgcagttcgaggcggagcagttagaaatgagggagtaagaataaggagacaggggctgctttcggaatttgacttcgatatgaatgagacgttgaagtacatctctgagcatcacaaagatcctgatgacatgtatgacatgccaaagttttctgattag

SEQ ID NO: 38 - DNA, 2421 bp, Uncinocarpus reesii 1704
atgcctggagaagttattgataagccaaatccgaagcctttgccttctcaccttcccgagtctctcgatgagttggggattcagctggacgtgagaccgttagacaaaaatgccattgattccctggccaagttccgtcgggctgcgaactatatcgcggcagcgatgatatttctccgagacaatgcgtatttaaaacgcaagttgacttttgacgatatcaagccccggttgttgggtcactggggaacctgtcccggtataaattttgtttattctcacctcagctatctgatctgcgaatatgaccttgatatgctggctgttatcggccctggccatggagcgcccgcaatcctggcttctctttggttagaaagatctctggaaaaattctaccccgattattcacgagatacgagtggccttaccaaattaattacgacgtttagcaccacgggtggttttccaagtcacatcaatgcggaaactccaggtgcaatacatgaggggggcgaacttggctatgctttggcggtctccttcggtgcggtaatggacaagccagacatgatcgttacttgcatcgtaggagatggcgaggctgagagtgggccatgtaccgcgagttggcattcctacaaatttattgatcctgcagagtctggtgcggtaataccaattctccatctcaatggattcaaaataagcgagcgcacgatatacgggtgcatggatgataaggaacttcttgcgctattctcgggtttcggctatcaacctgtaattgttggggatctagataatattgactccgaatttaacagcgcgctacgttggactgtgaccgagatacgaaagatccaaaaagccgcacggtccggtaatccgattgtcaaaccgcgatggcccatgattattcttcggacgccaaagggttggacgggcccgaaaaaaattcacggaaaaatcgtggaaggctcctttcacgcgcatcaagttcctcttcccgctgcaaagaaggacgacgaagaattaaacgcattacaagattggttgtcatcctatcgcccaaatgaactctttcaagagaatggggacatgattgaggagattaagaccatcctcccgaaagaacattcaaaaaggatgggccagcgaccggaagcctacaaggaactagcaacagttaacttaccggactggaagcagtttgctgcagaaaaaggttcaaatgagagttcaatgaaaactatagggggtctcattgacaaattgtttgtggacaacccccatagtgcgcggttattcagtccagatgaacttgaaagcaataaacttgatcaagccctggctcatacaaatcgaaactttcaatgtgatcaattctccaatgcaaaaggtggccgagtcattgaagtgctcagcgagcatatgtgtcaagggttccttcaagggtacactctgacaggaaggcttggtatctttccatcatatgaaagtttccttggaattattcataccatgatggtgcagtattccaagttcaataaaatggcccgggaaacaacatggcatagggacttatacagcctgaactatatcgagacgagtacatggactcgtcaagagcataacgggttttcccaccagaatccatcattcattggggctgtgatgaatctaaaaccggactatgcgcgcgtctaccttccaccagacgcgaatacgtttctttccacattgtctcattgcttgaagtcaaagaattacgttaacctaatgattgggtctaaacagcccacgcccgtttacttgagccccgaagaagcagaaaatcactgtcgagcaggaggctccgtgtggaaattcgccagcacagatgatggcttggacccggatgtcactatcgtcgggattggaacagaacttacgttcgaagttatccaagccgcgtctatattgaggaagcgcgtcccggaactacgtgttcgcgtggtcaacgtgacagatctcatgatccttggagtggaaaacagacatccacattccctttctgatgaggcattcgatgcgctcttcaccccagatctacctgtacacttcaactaccacggctatgagaccgagttgaaggggttattgtttggaaggccaaaactgcaacgtgtgagcatcgcttcatacaaggaagaaggcagcactacaacgccgtttaatatgatgttggtcaatggagtttcgcgcttccatgttgccaaagccgccgtcaggggaggctcagttcgaaatgagagagtgaggcttaggcagcaggagctcgtcactgcttttgatcatgagatccatgcaacttccaagtatatcctcgagaaccagaaagacccagatgatatgtatgatatgcccaaattcgactag

SEQ ID NO: 39 - DNA, 2421 bp, Coccidioides posadasii C735 delta SOWgp
atgcctggggaagtcatcgataaaccggatccgaaggcactaccttcgcatttgccttcctcacttgatgagttgatagttcgccttcaagtgtcacccctgagcaaggatgcacttgattcgctggtcaaattccgtcgaactgcggactatatcgcagcagcgatgatatttcttcgagataatgcgtatctcaagcgtaagctgacgtttgatgatgttaagccacggttattgggccactggggcacctgccctggtttaaattttatctattcccacctcaattatttgatttgtgaacataaccttgacattctggctgttatcggccctggtcatggagcgccggcccttcttgcctgtctctggatggagggctccctggagaaattctaccccgattattctcgagatacgagtggtctcacaaagttgattactactttcagcactacaggtggattcccaagtcacatcaacgcggaaacccctggagcaatacatgagggtggtgaacttggctacgctttggctgtctcatttggagccgtaatggataagccagacatgattgttgcctgcattgtaggcgacggcgaggctgagagtgggccgtgcaccgcgagttggcattcctataagtacatcgacccagcggagtctggtgctgtcatcccaatcctccatctcaatgggtttaaaataagcgaacgcacaatatatggatgtatggatgacagagagctgcttgcgttgttttctggttttggttaccaagccgtaattgttggaaatctagataatatcgatgcggaatttagcactgctctgaactggacgctatcagaaatccggataattcagaatgctgcccgatccggtaaaccaattatgaaaccgcggtggccaatgatcattcttcgaacacccaagggatggacggggcctaagaagatccacggcaagattgtagagggttcattccatgcacatcaagtcccgctccctgcggcaaagaaagatggcgaagaactgaatgctttgcaagagtggctgttatcttataagccaaatgaactgtttcaagagaatggagatgtcattgacgaaataaacttcatccttccgaaagaacattcacagaggatgggccagcggccggaagcctacaaaagtttgcaaaagattgccataccagactggaaacagtttgctgtggatacaggctctcatgggagttccatgaaaaccattggaaggctcattgatcagttatttctggacaaccctcatagtgcgcgattattttctccggatgaacttgaaagcaataagttagatcaggctcttgcgcatacgattcggaatttccagtgggaccaattttcgaatgcgagaggcggacgagtcatagaagtactcagcgaacatatgtgtcaggggttccttcagggatacacgttgactgggcgacttggaatatttccatcttacgagagctttcttggaatcatccacacaatgatggtgcaatatgccaaattcaacaagatggctcgagaaacgacatggcatcgagacttatacagtctcaactatatcgagacgagtacttggacccgccaagagcataacggattttctcatcagaatccatcgtttattggggcagtactgaacctgaaaccggattatgcacgggtctacctcccgcctgacgcaaatacgtttctttctacgttggctcactgcttgaagtcgaaaaattacgtaaatcttatgattggttctaaacagccaactcccgtgtatctgagtgcagaggaagccgagagccactgtcgagcaggtggttctgtgtggaaatttgctagtacagatgatggcttggacccagatgtcgtgattgttgggataggtacggagctcacatttgaagttatccaggcagcgactatgctgaggaagcgcgttcccgagctgcgggttcgcatggtcaacgtgacagacctgatgatcctcggagtagagaatagacatcctcattctctttctgaggaagcattcgaagcacttttcactccaaatgtcccagtgcatttcaactaccatggctacgagaccgaactgaaagggcttttattcgggagacctaagctgcaccgcgtgagcatcgcatcgtacaaggaagaaggaagcacgaccaccccattcaacatgatgttggttaacggagtctctcgcttccacgttgctaaagctgccgtcaaaggtggctcgctgcgaaatgagagggttaagctcaaatatcaggagctcctcactgaattcgaccatgagatcaattcgctgagccagtatatcctcgaaaaccagaaagacccggacgatatgtatgatatgctaaagttcgaatag

SEQ ID NO: 40 - DNA, 2418 bp, Microsporum canis CBS 113480
atgcctggggaagttatcgaccggccaaatccagggccacctccctctcatctaccagattcggtggacgagctcatggtccggctgcaaacggtcaagctggatgacaatgtccgtcgatctttggagaagtttcgcagagttacagattatatcgctgcggctatgatatttcttcggagtaatgcctatttgaaacgtccagttaagcgtgaagatatcaaacctcgactactaggccattggggaacctgtcctggtctgaatctcgtgtattcccatcttaattacttgatacgatgccatgacttggacatgctgtttgtcactgggcctggacatggcgcacctgcgatcctcgcctcactctgggttgaagggtcattgggaaagttttaccctaaatacgccaacgacaccagtgggctcacgagattgatcacccagttcagcacaactggcggatttcctagccatatcaatgcggagacacccggagcaatacatgagggtggcgaacttggatatgctctggcagtctcgtttgggtccgtaatggataacccacacctgataacggctgttgtagtgggcgatggtgaggccgagagcggcccgtgtacagcgagttggaatggtatcaaatacatcgatcccgcagaatcaggggctgtcttacccattctacatctcaatggatttaagattagcgagcggactatctatgggtgtatggatgacagagaacttgtgtccctattttctggtttcggctaccagacacgaatcgtggaaggcttggatgatattgataccaatctgaataactcgctagaatgggcactagcgggaatccgtaggatccaaaaggccgcccggtctggaagtccaatcatgaaaccccggtggccaatgttgatcttgcggacccccaagggttggacaggtccaaagagtatccatggaaagatcattgagggttctttcgcggctcatcaagtgccgcttcctgaagcaggagaggatgacgacgagctccaagcattacaagcatggctttcttcatataatcccgaagaattattcaatgagcacggagacgtaatcgatgacattaaatcgatcctccccagggaagactcaaaacggatgggccaacggaaagaggtgtgtgattcttttgacaaactcaaaatgccggattggaggtgttacacagtctcaaaggggtctcaagaaagctccatgaaaacgatctcgcatttcctcggtcagatccttgtggacaaccctcattcgatgcgaattttctcgcctgatgagctggagagtaataagctaggtgccgtattggagaagacgggccgaaactttcaatgggatcagtattctaacgctcagggtgggagggtgattgaagtgttgagtgagcatatgtgccagggtttcctccagggatatactttgacaggacggacgggcatattcccatcttacgagagtttcttagggatcatccatacaatgatggtgcaatactctaaattcaacaaaatgaccagcacctgggcacgccaggagcataacgggttctctcaccagaatccctcatttatctccgcggttttaaacctgaagccaaacgctgcgagggtttatttaccacctgacgcaaatacattcctttcaacgttgtctcattgcttgcagtcaaagaattatgttaatctcatgattgggtcgaagcagccaactcagatatatttgagtgcagaggaggcagaaagccattgtcgagcaggaggctcaatctggggctttgcaagcactgatgatggtcttgacccggacgtcgtactggtaggcattgggacagaagtcactttcgaggttatccacgcggcgtccatcctgaaaaagttaataccggacctacgcgtacgagtgattaatgtgacagacctgatgatccttgggtcggagagaagccatcctcactccctctcggatgaaactttcgactcgctgtttacggcagagcgtccgatacatttcaactaccatggatacgaaacagagctcaagggtttgctttttggcaggcctcgtgttgatcgtattagcatagcttgttacatggaagagggttctaccaccaccccgtttgacatgatgcttttaaatagggtatcacgattccatgttgcccaagcagccgtgagaggaggttctctgcgcaatgaaaaggtaagagtccgacagcatgagctcctcaccactttagaccatgagattcgaagcgtaaggaagtatatcatggagaatcataacgatttgaagcagtccactgacaaggtctgcatggcagatcccagtgatttgtacgacatgcccagttttaaccttctttctatataa

SEQ ID NO: 41 - DNA, 2457 bp, Aspergillus oryzae RIB40
atgccgggagagattatcgacaggccaaacccgaaggctgagccgtcgcacataccggatgtcgttgaacagctgcaagtacagctcgaccaggcttcattagaccaatctacctctgatgctttcttgaaatttcgcagagcagctgcttacattgcagcagacatccgctcatgttctctagcaatgatttttcttcaggacaatgtgttattgaagcgcgacctgcaacatgatgacatcaagcctcgactacttggtcactggggaacatgtcccgggcttatcctcgtatattcccatttgaactacatcgttagaaagcaaaacctagacatgctgtatgtcgtcggaccggggcacggcgcaccaggtctacttgcttcgctatggctggagggctcattggggaggttctacccacagtattctcgagacatggaaggtctgaagaatctcatctcgacttttagtacctctggcggtttgccaaggttggacgctcctcaccatattaacgccgagacgccaggagccatccatgaaggtggcgagttgggttatgcgttagctgtatcctttggtgcagtcatggataatcctgatctcattgtcacatgcgtggtcggtgatggagaagcagaaaccggtccaacagcgacttcctggcatgcaatcaagtacattgaccccgcggaatcaggggcagtcttgccaattctgcatgtcaatggattcaaaatcagcgagcgcaccatctttggctgcatggacaacaaggagttaatctcccttttcacaggatatggttaccaagtgcgcattgttgagaatctagacgatattgatactgatctccattgctccatgaattgggcggttggggaaatccataagattcagcaagcagcccgctccggaaagccgatcatgaagccccggtggcccatgatcgtgctgcgcacaccgaagggttggtcaggacccaaggagctgcacgggcaattcatcgaagggtcgtttcattcacaccaggttcctctgcctaatgcaaagaaggacaaggaagaacttcaggcgctccagacatggctatcttcctacaacccacatgagctcttcaccgaaacaggagatgttattgatgaagtcaagtcgatcattccctcggatgactccaagaagctcggtcaacgttttgaggcatacaaagcctacgagccgcctaatcttccggattggaggactttctgcgtagagaagggcgcgcaagaaagctcgatgaagacaattggaaaattcatagataaagttttcacccaaaacccacacagtgtcagactgttctcgccggatgagttagagagcaataagttggatgccgctctcgcgcatactggacggaacttccaatgggaccaatactctaacgcgaagggtggccgtgttattgaagtactgagtgagcatatgtgtcaaggtttccttcagggctacactttgaccgggcgtgtgggcctctttccctcttacgaaagcttcttgggtattgtccacactatgatggtgcaatacgccaagttcatgaagatggcccgagaaacagggtggcacaaagatgtagctagcatcaactatattgagaccagtacctggacccgacaggaacacaacggcttctctcaccagaacccatcattcatcggaaatgttcttaagctgaaacctaatgctgcgcgtgtttacctgccaccggacgccaatactttcttgacaacagttcatcattgcttgaaatccaagaattacatcaacctcatggttggctcgaagcagccgacacccgtttacttatcgcccgaagaagctgaaagccactgcagagctggcgcatcaatctggaaattctgcagtacaaatgacggactcgacccagatgttgttcttgtgggggtcggagttgaagtgatgtttgaagtcatctatgccgctgcaatacttcgccagcgctgccctgaacttcgcgttcgggtgattaacgtgacagacctgatgatattggagaatgaaggagcccacccgcatgctttgacaaccgaatcctttgataaccttttcacctccgacaagccaatccattttaactaccacgggtatgtgaccgagttgcaaggtctgcttttcggccggccccgcctagagcgtgtgagcattgccgggtacatcgaggagggaagcaccacgacgccgtttgatatgatgctcgtgaacaagacctctcgcttccatgtggcccaggctgctattaaaggagcggcgaagcgaaacgagaaggttcaactccgtgagcaggagctgagcacagagttgaatcacaacattgtcgagacacgaaagtatatccatgcaaaccgcaaggaccctgatgatatgtatgagatgccacaatttagataa

SEQ ID NO: 42 - DNA, 2421 bp, Aspergillus niger CBS 513.88
atgcctggagaggtcatcgacaggccaaatcccaaggctgagccttcacacatccccgatcttgtcaatcaattgcaggtcaaacttcaagagacgcgtttggaggaaactgattacaatgcccttctgaaattccgccgtgcagcggcctacattgctgctgcaatgatctttctccaagacaatgtgctgctgaagcagaatctaaggcacgaggacatcaagcccaggcttcttggccactggggaacatgtcccgggttgattcttgtatactctcacttgaactacatcatcagaaagcagaacctggatatgttgtatgtcgtcgggcctggccacggcgcgccagctattttggcctcactgtggcttgagggctctttagagaaattctacccccactactcacgagacatggatggtctccatgagctcatctcgaccttcagcacaagtgctggattaccaagccatatcaatgcggaaactcccggtgcaatccatgaaggtggtgaattgggttatgcgttagctgtctcttttggtgctgttatggacaatcccgacatgatcgtcacctgcgtggttggtgacggggaagcagaaactggtcctaccgcgacgtcctggcatgcaatcaagtacattgaccccgcagaatcaggtgccgtcctgccgattctccacgttaatggctttaagatcagcgagcgcaccatttatggctgcatggacaacaaagagctggtctccctcttcacgggttatggataccaggtgcgcattgttgagaacctggatgacatcgacgcagatctccatagctctatgatgtgggcagttgaggagatccacaagatccaaaaagcggcgcgttccggcaagccaattatgaagcctagatggccaatgattgttttgcgcacaccgaagggttggtcaggacctaaagagctccacgggtcattcatagagggatctttccactcacatcaggttcctctacctaatgcaaagaaggataaagaggagcttcaggctctgcagaaatggctgtcctcgtataatccgcacgaacttttcactgagacgggagacatcattgacgacatcaagtcagtgatccctctggaagacaccaagaagcttgggcagcgagcagaagcctacaagggctatagggcacccgatctcccagactggcgcaagtttggcgtagaaaagggctcccagcagagcgctatgaaaacaattggaaagttcattgaccaagtgtttacccaaaatcctcatggcgtccgtgtattttcgccagacgagctagagagcaacaagctggatgcagcactggcgcacacgggaaggaactttcagtgggatcaattctcgaatgccaaaggcggccgcgtcatcgaggtgctcagtgagcacctgtgccagggctttatgcagggatacacgttgacgggccgggtgggcattttcccatcgtacgaaagcttcttgggaatcatccataccatgatggtgcaatatgccaaatttaacaaaatggctcaagagacgacctggcataagccggttagtagcatcaactatatcgaaacgagtacgtgggctcgtcaggagcacaatggattctctcaccagaacccctcctttatcggagctgtgctcaggctgaagcccaccgccgcgcgagtttatctgccacctgatgctaacacatttttgaccacccttcaccactgtctcaagtccaagaattatgtcaacctcatggtaggttcaaaacagccaactcccgtgtacttgagccccgaggaagcagagagccactgccgagccggcgcatcgatctggagattctgtagtaccgacaatgggctgaacccggatgtcgtgctggttggcattggagtagaggtgatgttcgaggtcatctacgcggcggccatcctccgcaagcgttgtccagaactccgggtgcgtgtggtcaatgtgaccgacttgatgattctggagaaggaaggtctacatccacatgcattgacgaccgaagctttcgacagtctgtttggctcggaccggccgatacacttcaactaccacggatacccgggcgagctcaaaggtctgctctttgggcggccccgcctggaccgagtttcagtagaaggatacatggaggaaggaagcacgacgacgccgttcgatatgatgttgctgaaccgcgtctcacgataccacgtggcgcaggcagccgtgatcggggcgtccagacggaatgagaaggttcaagttcggcagcacgaactggtcagcgaattcggccacaacatcgtggagacacgcaaatacattctggccaaccgcaaagacccggatgatacgtatgatatgccctcctttgaataa

SEQ ID NO: 43 - DNA, 2421 bp, Neosartorya fischeri NRRL 181
atgccaggagaagtcattgatacaccaaatccccaggcattgccttcccatattccggatgtagtggaacagctgcaggtgaaattggacctggcgagtctggagcaacctgcttgcgatgctttatttaagttccgtcgagcggcttcatacatcgccgcagcgatgatcttcctacaggacaatgtgctgttgaagagaaacctgacacacgatgacatcaagcccagattgctaggccattggggaacatgtcctgggctgatcttggtatattcacacttgaactatctcatcaagacgcgcgacctcgatatgctctatgtcgtagggccaggacatggcgcgccagccatcctagcctctctttggctggagggctcactggagaaattctatcctgactactcacgaaacgccgagggtctccgtaacctcatctccacattcagtacaacagccggattgccaagtcatatcaacgctgaaacgcctggtgccattcacgaaggaggcgaattgggatacgctcttgcggtatccttcggcgcagtcatggacaatcccgatctaattgtcgcttgcgtagtgggcgatggtgaagccgaatcaggcccaacagcaacatcgtggcatgccattaaatacatcgaccctgctgagtctggtgccgtgctgcctatcctgcacctgaatgggttcaagattagcgagcgcacgatttttggctgcatggatgatagagaattgatttctctcttcactggctatggttaccaggtccgcattgttcaagatctaaatgatattgacaccgatctccatcgctccatgacctgggccgtcgacgaaattcataaaattcagcaagcagcacggtctggaaagccaatcttgaagccgagatggccgctgctcatcttgcgcactccaaagggatggtcgggaccgaagaaactgcacggtcagttcatcgaggggtcattccattcgcaccaggttccgcttcccaaagcgaagaaggacaaggaggaattgcaggccctccatgagtggctgtcgtcatacggccccaatgagcttttcaaggaaaacggagatattatcgacgagataaaatctataattccctccgaggattcgaagaagctcggtcaacgcgtggaggcatacaaggcatatgcgccgccaaacctcccggattggagaaacttcgccgttgacaaaggcagtcaagaaagtgcaatgaaagtaaccgggaagctcatcgacgaggtcttccagcttaatcctcacagagtgcgactgttctcgccggacgaactcgagagcaacaagttgagcgcggcattggatcgcacaggaaggaacttccaatgggatcagttctcaaatgctcgaggaggccgtgtcattgaagtgctgagcgagcacatgtgccagggtttcctccaaggctacactttgactggccgcacgggtattttcccctcttatgagagcttcctgggaattatccacaccatgatggtgcaatacgctaagttcatcaagatggctctagagacaatgtggcaccgcgatgtagctagtatcaactatatcgagacgagcacatggacgaggcaggagcataatggtttctcgcaccagaacccgtcgttcatcggcgcagtgctgaagctaaagcccaccgctgctcgggtttatttgccgccggacgcaaataccttcctgacgactcttcaccactgcctgaaatcaaagaattacattaatctcatggttggttcgaagcagccaactccggtatatctgacgcccgaagaggcagagagccactgcagagccggcgcatccatatggagattctgcagcaccgacaacggcctggatccggatgtagtacttgtcggaattggcgtcgaggtgatgtttgaagtcattagtgcggcagccattctgcgcaagcgttgtcccgagctgcgtgtccgcgtcattaatgtgacagacctgatgatcctcgaaaatgaaggcgctcacccgcatgctctcacaacggaggcattcgacaatctgtttacatacgacaaaccaattcacttcaactatcacgggtatgcgacggaactgcaggggctgctgttcggacggccccgtctggaccgagtcaccatcaacggatacatggaagagggaagcaccacgacaccgttcgatatgatgcttgtgaacaagacatcacgcttccatgtggcacaggctgcccttcggggagcggcgaggagaaacgagagcgttcgaatcaggcaacaagagctctacacggagctgaaccacaacattgcagagacgaagaagtacattatcgagaatcgcaaggatcccgatgacatgtatgagatgccgacgtttgattga

SEQ ID NO: 44 - DNA, 2421 bp, Aspergillus clavatus NRRL 1
atgcctggggaagtcattgacagaccaaacccgcaggcgctgccttcccatattcccgatgtggttgaacagttgcaggtgaagctggatttgacgagtttagagcaaccggcctgcgatgccttgttcaaattccgtcgagctgcttcatacatcgctgcagcaatgatctttctgcaagataatgtgctactgaaaagaagcttgacgcatgacgacataaagcctagattgcttggtcattggggaacatgtcccggcctgatattggtatactctcacctgaattacctcattacaaagcgcaatctcaatatgctgtatgtcgtgggaccaggacatggtgcaccagccatcctagcctctctctggctggagggctcgttggagaagttctacccagagtattcgcgaaatgcggagggcctcgccaatctcatctcgactttcagtacaacagccgggctgcctagccatatcaatgcggaaacaccaggtgctatccacgaaggaggggaactgggatacgcacttgctgtatcatttggtgcagttatggacaaccccaatctgatcgttccatgcattgtgggcgatggagaagcagaaactggcccaacagcagcatcttggcacggcatcaaatatatcgatcctgcagagtcaggcgctgtgctgccaatcctgcacctgaacggattcaagatcagcgagcgcacgatctttggctgcatggacgacaaggagctgacctcgcttttcactgggtatgggtaccaggtccggattgtgcaggatttgaatgacatcgacaccgatctccatcgatctatgacctgggctttggaagaaatccacaagattcagcaagcagcgcgatccggaaagcccattatgaagccaagatggccaatgctgattttgcgcacaccaaagggatggtcaggcccaaaggaaattcatggccagttcattgagggctcattccattcacatcaagtccccctgcccaacgcaaagaaggacaaggaagagctgcaggccctcgagaaatggctttcctcgtatgggcccagagaacttttcactgagaatggagatgttatagatgagattaaatccatcatccctacggatgatgcgatgaagcttggtcagcgtgtggaggcatacaaggcttatctgccaccaaagctcccggactggaggaagttcgccgtggataaaggtagccaacagagcccgatgaaaacgaccggaaagcttatcgacgaggtcttccaactcaaccctcacactgttcgattgttttcaccggatgaattggagagcaacaaactgagcgccgctctggatcacactgggagaaatttccagtgggatcagttctctagcgcgaaaggtggccgggtcatcgaagtcctgagcgaacatatgtgccagggttttatccagggttacacgttgaccggacgcacgggtatcttcccatcgtatgagagcttcttgggaatcgttcataccatgatggtgcagtactccaaattcatcaaaatggctcaagagaccacatggcaccgtagcatagccagcatcaattatattgagacaagcacgtggacacggcaggagcataatggattttcacaccagaatccatctttcatcggggcagtactcaaattgaagcccacggctgctcgggtttatctgccgccggatgctaacactttcttaatcactctccatcactgcttgaagtcgacgaactacatcaatctcatggttagttcgaagcagcccactccggtgtatttgaccccagaagaggcagagagccactgcagagcaggtgcatctgtctggaaattctgcagcaccgacgatggtctggacccagacgtagtattggttggaatcggcgtcgaggtgatgtttgaagtcattgctgctgccgccattctgcgcaaacgttgccccgagcttcgcgtacgggtggttaacgtcaccgatttgatgatcttggagaacgaaggcgcacacccgcatgcgctcaccaccgacgcgtttgatagcctgtttacatctgacagacccatccatttcaactaccacggatatccgactgagttgcagggcttgctgttcggacggccacgtctggagcgcgctaccatcggcggatacatggaggagggaagcaccacgacaccatttgatatgatgcttgtcaaccgcgtttcacgcttccatgtagcacaagcggccatttgtggggcgtcaaagagaaatgaaagagttcagatccgacaacaggagctgtacacggagttggaccacaatatggtagagaccaagaagtacatcctcaaaaaccgaaaggatcccgatgatatgtacgatatgccgaaattcgaataa

SEQ ID NO: 45 - DNA, 2400 bp, Aspergillus terreus NIH2624
atgccgggcgaagtcatcgatcggcccaacccccaggcgcctccgtcgcatattcctgatgtggtacagcaacttcaagtccagctccagcgtacgagcctggaccaatccgcctgcgatgcattgatgaaattccgccgggcggcttcttacatcgctgctgcgatgattttcctgcaggacaatgtgttgttgaagcgcgatcttatccacgacgatatcaaacctaggttacttggacactggggaacgtgtccgggtctgattctggtatactcgcatatgaactatctaattcgacagcacaatcttgacatgctttacgtcgtgggacctggacacggcgcaccgggtattctagctgcactctggctagagggctcgctggggaagttttacccgcattattcgcgcgatggcgaaggcctcaagaggctcatctcgacttttagtacccctgctgggctgcccagccatatcaacgcggaaacacccggtgctattcatgagggtggcgagctggggtatgccctttcggtctcgttcggcgcggccatggacaacccggacctgattgttacctgtgtcgttggtgatggagaagccgagactggtccaaccgccacgtcatggcatgggatcaagtaccttgatcctgccgagtcaggagccgtgctgccgatcctccatgtcaatggattcaagatcagcgagcgaaccatctacgggtgcatggacaataaagagcttgtcacgttgttcactggatttggatatcaggttcgcatcgtcgaggatctcgaagatatcgataccgatctccactgctccatgatgtgggcagtggaagagattcgcaagatccagcaggctgcacgctccggcaagccgattatgaagcctcggtggcctatgatcgtcttgcgcacgccaaagctgcacggccaattcatcgaaggatctttccattcccaccaggtgcctctgcccggcgcaaagaaggacaaagacgagctccaggagctgcagaaatggctgtcctcgtacaaaccccatgagctctttaccgagtctggagacgttatcgacgaggtcaagtcgatcattccgtccgatgagtcgaagagactcggtctgcgggcggagtcatacaaaggttacgtccctcccaaacttccagattggagaaagtttgccgtggagaagcatagcgacgaaagctcgatgaaggcaatcggtgatctgattgacgaggtgttcaccatgaaccctcacagcgttcgtttattttcgccggacgaactggaaagcaacaagcttgctgccgccctgaaacataccagcagaaatttccaatgggatcagttttccaatgccaaaggcggtcgggtcatcgaagtcctcagcgagcatatgtgccaaggctttatgcagggctatacgctcaccggccgagtgggcatcttcccatcctatgagagttttctgggaatcgtccacaccatgatggtgcagtacgcgaagttcatgaagatggcccgggaaacgaaatggcaccaggatgtagccagcatcaactacatcgagaccagcacttggacgcgacaggagcataacgggttttcccatcagaacccctcgttcatcggcaatgttctcaagctgaaacccactgctgcacgggtctatctgcccccagacgccaacaccttcctgacgacactccaccattgcttaaagtcgaaaaactatgtgaacctcatggttgggtcgaagcagccgacaccagtctacctgtcggcagaggaggcggaaaaccactgtcgcgccggcgcttccatctggaatttctgcagcaccgacggtggcctggatcccgacgttgtgctcgtaggaatcggagtcgaagtgatgtttgaggtcatctatgcggcggccatcttgcgacagcgttgccctgagcttcgcctgcgggtgatcaacgtgacggatctgatgatcctggagaatgaaggcacccatccgcacgctctcacaacggaatcgttcgacaacttgttcacgcccgataggcccatccatttcaactaccatgggtatccgaacgagctgcagggactgctctttggccggccgcgtctcgaccgggtgagcattgcggggtacatggaagaaggaagcaccacgacgccattcgatatgatgctagcgaacaagacgtcccggtttgacgtggcgcgggcagcggtgaagggggcgtccaagagaaatgaaagagtgcgaattcgcgagcaggagctcaccatggaactggcgcaaaatatggccgatactcgcaagtacattctggctaatcgtaaagatccggatgatatgtataccacgcccagattcgagtag

SEQ ID NO: 46 - DNA, 2343 bp, Aspergillus nidulans FGSC A4
atgccaggagaagtcatcgagcgaccaaacccggcgccaaagccgtcgcatgtccccgatttagtagaaaaactcataattcccgcgcagaagacgaagctggagaaaagcgattgtgatgcgttgcacaagtatcgtcgcgcggcggcgtatattgctgctggacactggggaacatgtcctgggttgatcctcgtttactctcacctgaactacctgatcaagaagcagaacctcgatatgctgtatgttgttgggccagggcatggagcaccgggcttgctagcatcgttgtggcttgagggctcgctggggaagttttatccgcagtataccaaggacaaggagggtctgcacaacctcatctcgacgttcagtaccagtgccggactgcctagccacatcaatgctgaaacacccggcgctatccacgaaggaggagagctgggctatgcgctgtctgtctccttcggcgcagtcatggataaccccgatttgattgtaacatgtgtagttggagacggagaggcggaaactggtccaacagccacatcatggcatgcgatcaagtacatcgatccagctgagtcaggagccgtgcttccaatcctgcatgtgaatggcttcaagatcagtgagcgcactatttttgggtgcatggataacagggagatagtctgcctgttcacagggtacgggtatcaggtgcgcattgtcgaggacctcgaggacatcgacaacgaccttcacagcgctatgtcctgggcggttgaggaaatccgtaatattcagaaagcagcgcgctccggaaagcctatcatgaagcctcaatggcccatgattgtcttgcgaacgcccaagggttggtcagggccgaaagagctgcatggccagttcatcgaaggatcgttccactcccaccaggttcccctccctaatgctaagaaagacgatgaggagctccaggctctgcagaaatggctttcctcttacaaacccgatgagctgtttaccgagtctggcgacgttatcgacgaaatcctatccattattccttcggatgataagaaactcggcatgagacccgaggcctacaagactcatctaccgccggacctccctgactggagacagttctgcgtgaaaaaaggggatcagttcagcgcaatgaaggccattggtagcttcatcgaccaggttttcgtcaagaacccgcataccgtccggttattctcacccgacgagctggaaagcaacaagttgagcgctgccctatcacatacgggaaggaatttccagtgggatgagttctcgaatgcaaaaggtgggcgggtgatcgaggtcctgagtgagcatttgtgtcagggcttcatgcaggggtatacattgaccggccggacgggcatcttcccatcatatgagagtttcttgggtattatacataccatgatggtccagtatgccaagttcgcaaagatggctaaagaaacggcatggcaccatgacgtgagtagtatcaactacatcgagaccagcacctgggcccgacaggagcacaatggcttctctcaccaaaatccatccttcatcggcgcggttctcaaactgaagccgtacgccgcccgcgtctacctgcctcccgacgccaacacatttcttaccactttgcaccactgcctgaaatcaaagaattatatcaacctcatggtcggctcaaagcaacccaccccagtctacctgagccccgaggaagcggaaagccactgccgagccggagcctcgatcttcaagttctgcagtaccgacggtgggctccgcccggatgtcgtactcgttggaatcggtgttgaggtcatgttcgaagttatcaaggcggcagccatactgcgagaacgatgccctgagctgcgtgttcgtgtagtcaacgtgacggatttattcattctcgagaacgagggtgcccacccccacgccttgaagcacgaggccttcgacaacctcttcaccgaggatcgctccatccatttcaactatcatggatatgtgaacgaactccagggcctgctctttggccgccctaggctcgaccgggcaaccatcaagggatataaggaagagggaagcaccacaactccatttgacatgatgcttgtgaatgaagtatcgcggtaccacgtcgcgaaggcagccgtcacgggaggagcgaggttcaatgagaaagtcaagctgcggcaccaggagctttgctctgaattcgatcataacattgctgagacgcgcaagtacatcatgaacaatcatcaagatcccgaagacacatacaatatgccctcatttaactag

SEQ ID NO: 47 - DNA, 2469 bp, Penicillium chrysogenum Wisconsin 54-1255
atgcctgcagaagttataagcgaaccaaatccacaagctctgccgtcgcatctgccagactatcttgagaaattgagcgtcagcttggaacgtgagaaactagatgaaaagacctacgatgccttgatcaagttccgccgagcggcttgttacattgcggcagctatgatatttctgcaagaaaatactcttttgaagtcagaactcacatttcaacatgtcaagcctagactactcggtcactggggaacatgcccgggcctaatctttgtctactctcatttgaactacctgatccggacaatgaatctggacatgttgtacgttgtcggtccaggacatggcgcaccggcaatactagccgcgctatggttggagggttcgctggagaaattctatccccactattcgcgagacgaaaagggcctacacagattgatctcgacctttagtaccacaggtggttttcccagccacatcaattccgagacccccggtgcaatccatgaaggtggagaactgggttacgctctggcagtgtcctttggcgctgtcatggataaccccgatctgattgtgacttgtattgtgggggacggggaggctgaaagcggtcccactgctacgtcctggcatgcgatcaagtacattgatccaaaggagtccggtgcagttttaccaattctgcatttgaatggattcaagatcagcgagcgcactatcttcgggtgcatggaccacaaagagcttttgactctcttcagtggatacgggtaccaggttcgctttgtcgaggataacaacgatattgatgcggatttacacacctctatgatctgggccgtcaatgaaatccagaagatccagaaggctgcccgttcagggaagccgattatgaagccaaggtggccgatgctgattctgcgtacttccaagggctggactgggcccaagcagcttcatggcaagtttcttgagggctcataccattctcaccaggtgccattgcccaaagcaaagaccgacaaggaacaactagatctgctgcagaattggctgtctagttataagccagaagagctgttcacttcgaacggtgatgtaattgatgagatcaagtctgtgatacccacagaagacaaaaagaagcttggccagcgcatcgaagtctacaatagttatacaccaccgaatctgccggattggaagcccttctgcgcggataaaggctctcaagaaagcgctatgaaagcggctggcaccttcattaatcagacattcaaggacaacccgaacagcgtgcgactcttctcgccggacgagttggaaagcaacaaactcgatgcggtatttgaatacacaaaccgcaatttccaatgggacgagttcgccaatgcccgcggcggccgtgtaattgaagtccttagcgaacatatgtgtcaaggattcatgcagggctataccttgaccgggcgcattggtattttcccgtcctatgagagcttcctcggcatcattcatacgatgatggtgcagtatgccaagttcatcaagatgggactggaaacaacttggcactccggcgtcagtagtgtgaactacatcgaatcgagcacctgggcacgccaagaacacaacggcttctctcaccagaacccatccttcatcggcgctgtgctaaagctgaagcctagtgcagctcgggtatacttaccaccagatgcgaatactttcctgacaaccatccaccattgtttaaaatcaaagaattacatcaacctaatggtaggctcaaagcagccaactccagtgtacctgactcccaaagaggcggaaagccactgtcgcgcaggagcatccatttggaagttctgcagcacggacgatggaattaatccggatgtcgtgctggtcggtattggtgttgaggtgatgttcgaagtaattgcggcagcggcgcttctgcgtaagctcatcccagagcttcgtgtttgtgtcattaacgtgacggacctgatgattcttgataacgagggtgcgcatccgcatgccctgtccactgaggcattcgatggtctctttacttccgacaggcccattcacttcaattaccacggctatccaactgagctgcagggtttgctctttggacgtccccgccttgatcgcgtcagtgtcgccggctatatcgaagagggtagcaccaccacgcctttcgacatgatgcttgtcaaccgtgtctcgcgtttccatgtcgcccagcatgctattcgtggtgctgccaaagtaaatgagaaggtcagggtgtatcagcaggagctgaatgctcagcttgaggcgagtatggtcagcacgaggaagtatattgtggaaaaccgggatgaccccgacggcatttatgacatgccacaattccacagcttccacaaaccggctgagtctgagacattctggaatattgcccagtag

SEQ ID NO: 48 - DNA, 2421 bp, Talaromyces stipitatus ATCC 10500
atgcctggcgaagtgatagaccagccaaacccacctccattgccatcagatctccctgaagagctcgacaaatttgctgtgcagctccagaagatctctctcgaccagaaagactacgatgacttggctaaatttcgaagggcggcatgttatatcgctgctgcaatgatatttttacaggacaatgtgtacctaaagagagagattaaaccagaggatatcaaacctcgattgttgggtcactggggaacatgcccaggtttgatcctggtttattcccacctcaattacctgataactaaatatgattacgatatgctatatgtagttggaccgggtcatggagctcctgcaattctagcctctgtttggcttgaaggttctctcgagaagttcttccctcagtactctcgcgataccaagggactttccaatctcattaccagattcagtaccacatccggcttaccaagtcatatcaatgcggaaactccaggagccatccacgagggaggcgaactgggttatgcacttgcggtttcgttcggtgcggttatggacaacccagatctcattgtcacatgtgtcattggagatggtgaagcagagagtggtcccacagccacgagctggcacgcggcgaagtatattgatccgaaagaatctggtgcggtcttgccaatagtgcatgtcaatggcttcaagatcagcgaaagaacggtctatggatgtatggacaatcgagaactgaccgcgctgttcctcggatatggctatcagccccgatttgttgagaaccttgacgacatcgacactgatatgcacacttcaatggtttgggcggttggagaaatccgccgtattcaaaaggcagctcgcgaaggaaagcctctgagcaagcctagatggcccgttttgatcctacggacacctaagggatggtctggaccaaaaaagatccatggagagttcattgagggctccttccactcccaccaagttcctcttccaaaagctaaaaaagacaaggaagagcttcaagctcttcaagactggcttacctcttataaaccagaggatcttttcaatgaacaaggcggcccaattgatgcgattacttcaatcatcccaaagacagatagcaagaagctcggccagcgtattgagtcctatggcaactacaaacctcttgagatgcctaactggaaacatttcgtggtctccaaaggctcctacgagagttcgatgaagactatcggaaagtttattgacgaagtatttgtcaagaatcctcaaacagcaaggcttttcagccctgacgaactagaaagcaataagttagatgctgccctggctcacactgggcgaaacttccagtgggatcaattttcacgcaacaagggtggccgtgttattgaagttttgagcgagcacatgtgtcaaggtttcatgcagggctacactcttactgggcgaaccgctatcttcccgacttatgaaagcttcctcggtattgtccacacgatgatggtacaatacagtaagtttaacaagatggcacgtgaaacgagatggcacagcgatattgcgagcatcaattacattgaaacgagcacttggactcgccaggagcataatgggttctcgcatcagaatccttctttcattggtgcagtgctcaaactcaagccttacgcagcaagagtctatctgccaccagacgccaatactttcttatccgcacttgaccactgtcttcgatccaggaattatgttaatctcatggtcgggtcaaaacagcccactccagtgttcctcagtcccgaggaagcagctattcattgtcgggccggtgcatctatctggaagttctgcagcactgacgatggcctagacccagacatcgtgctggttggcatcggtagcgaactcatgttcgaggtcatatacgccgcatcaattctacgcaaacgggtaccggagttgagagtgcgtgtcgtgaatgtcatcgatctcatgatcctcgaaaaccaaggtgcacacccacatgctctatcaaccgacggatttgatgcgctcttcacccctgatctcccaattcatttcaactaccatggctataacacagagttacaaggtctactttttgggcgtcccaatctcgatcgtgtgagtattgcgggatatatcgaagaaggaagtaccactacgccattcaacatgatgctcgtcaacaaggtttcgcggttccatgttgcaagagccgctgttgaaggagcagcgaagcggaatgagaagatccgtctgagactccaggaattgataagtgagctggatacgaatatcagagagactaccaagtacattgttgagcatggaaccgatcccgaagacatgtacggtatgccaaagtttggctga

SEQ ID NO: 49 - DNA, 2421 bp, Penicillium marneffei ATCC 18224
atgcctggcgaggtcatagaccagccaaacccacctccattgccatcaggcctacctgaagagctcgataggtttgtggtacagctccagaatatctccttgggccaaaaagactacgatgacttggctaagtttcgtagggcggcgtgttatattgctgctgcgatgatatttctgcaagacaatgtatacctgaaaagagagattaagccagaggacataaagcctcggcttttaggtcactggggaacatgtccaggtctgattctggtttattcccacctcaactacctaataaccaaacacgaatacgatatgctatatgtggttggtccaggtcatggggctcctgcgattctagcttctgtctggcttgaaggctcccttgaaaagttcttccccgaatactcacgcgacaccaagggactttccaaccttataaccagattcagtaccacggcaggccttccaagtcatataaatgcagaaactccaggagcaattcatgagggaggggaactaggttatgcactggcggtatcgttcggtgcagtcatggataatccagatctcatcgtcacatgtatcattggagacggcgaagcagaaagtggtcctacagccacgagctggcacgccgcaaagtatatcgacccgaaagagtccggcgcggtcctgccaatagtgcatgtcaatggcttcaaaattagcgagcgagcagtttacggatgtatggataaccgagaactgaccgctttgttccttggatacggctaccaaccacgatttgtcgagaaccttgatgacattgacactgatatgcatacttcaatggtctgggcagttgaagaaattcgccggattcaaaaagcagctcgtgaaggaaagcccttgagcaagcctagatggcccgttttgatcctacggacacctaagggatggtcaggaccgaagaaaattcatggggaatttattgaaggctccttccactcccaccaagtccctctgccaaaagccaagaaagacaaggaagaacttcaagctcttcaagactggctcgcctcttatggaccagaagatcttttcaatgacaaaggtgggccgattgatgcgattacttcaatcatcccgaagacggatagcaaaaagcttgggcagcgtattgagtcttatgggaactaccaaccccttgaaatgccaaactggaagcatttcgtggtttccaaagggtcctacgagagttcaatgaaggtcatcggaaaattcattgatcaagtttttgtcaagaaccctcatacagcaagactttttagtcccgatgagttggaaagcaacaagttagatgctgcgttggctcacagtggccgaaacttccaatgggaccagttttcacgcaaccaaggtggccgtgttattgaagtattgagcgagcatatgtgtcaaggtttcatgcagggttacaccctaactggtcgaactgcaatctttccaacgtatgaaagctttcttggtattgttcacacgatgatggtgcaatatagcaagttcaacaagatggcacgtgaaacgagatggcatagcgatatcgccagcataaattacattgagacgagcacttggactagacaggaacataatggattctcgcatcaaaatccttccttcattggtgcagtcctcaaactcaagccttacgcagcaagagtttatttgccaccagatgccaatactttcttgtccactctcgaccactgtcttcgatccagaaattatgtgaatctcatggttgggtcaaaacagccaacccccgtattcctcagtcccgaggaagcggctgtgcattgccgagcgggtgcctctatctggcaattctgcagcaccaacgagggattgaatccagatgtcgtgctggtcggcgtaggtagtgaactcatgttcgaggtgatatatgctgcagcaattctacgcagacggatgccggaactgagagtgcgtgtcatcaatgtcaccgatctcatgattcttgaaaatcaaggcgcccatccacatgctttatccattgatgggtttgatgcgttgttcacccctgatattccaattcatttcaactatcacggctataacaccgagatacaaggcttactttttggacgtcccaatctcgaccgcgtaagtattgcgggatacatcgaagaaggaagtactaccacaccattcaacatgatgctcgtcaacaaggtctctcgatttcatattgcaaaggccgctgttcaaggagccgcgaaacgaaatgagaaggttcgtttgagatgccaggaattgttgagtgagttggatatggatattggtgagacttctaagtacatcgtcgagaatggaaatgatccggaagatatgtacgatatgccaaagtttgaatag

SEQ ID NO: 50 - DNA, 2145 bp, Aspergillus fumigatus Af293
atgatcttcctacaggacaatgtgctgttgaagagaaacctgacacacgatgacatcaagccgagacttctagggccaggacatggcgcgccagccattctagcctctctttggctggaaggctcactggagaaattctatcctgactactcacgaaacgccgaaggtctccgtaacctcatctccacattcagcacgacagccggcttgccaagtcatatcaacgctgaaacgcctggtgccattcacgaaggaggcgagttgggatacgctcttgcggtatccttcggcgcagttatggacaatcccgatctaatcgtcgcttgcgtagtgggcgacggtgaagccgaatcaggcccaacagcaacatcatggcacgccattaaatacatcgaccctgctgagtctggtgccgtgctgccaatcttgcacctgaatggattcaagatcagcgagcgcaccatttttggctgcatggatgatagagaattgatttctctcttcactggctatggttaccaggtccgcattgttcaagatctaaatgatatcgacaccgatctccatcgctccatgacctgggccgtcgacgaaattcataaaatacagcaagcagcacggtctggaaagccaatcttgaagccgagatggccgctgctcatcttgcgcactccaaagggatggacgggacccaagaaactgcacggcaagttcatcgaggggtcattccattcgcaccaggttccgcttcccaaagcgaagaaggacaaggaggaattgcaggccctccatgagtggctgtcgtcgtacggtcccaatgagcttttcaaggaaaacggagatattatcgacgagataaaatctatcattccttccgaggattcgaagaagcttggccaacgcgtggaggcatacaaggcatatgcaccgccaaacctcccggattggagacacttcgccattgacaaaggcagtcaagaaagtgcaatgagagtaaccgggaagctcatcgacgaggtcttccagcttaatcctcacagagtgcgacttttctcgccggacgaactcgagagcaacaagttgagcgcggcattggatcgcacaggcaggaacttccaatgggatcagttctcaaatgctcgaggaggccgtgtcattgaagtgctgagcgagcacatgtgccagggtttcctccaaggatacactttgactggccgcacgggtattttcccctcttatgagagcttcctgggaatcatccacaccatgatggtgcaatacgctaagttcatcaagatggctctagagacaatgtggcaccgcgatgtagctagtatcaattatatcgagacgagcacatggacgaggcaggagcataatggtttctcgcatcagaacccgtcgttcatcggcgcagtgctgaaactaaagcccagcgctgctcgggtttatttgccgccggacgcaaataccttcctgacgactcttcaccactgcctgaaatcaaagaattacattaatctcatggttggctcgaagcagccaactccggtatatctgacaccggaagaggcagagagccattgcagagccggcgcatccatatggaggttctgcagcaccgacaacggtctggatccggatgtagtactggtcggaattggcgtcgaggtgatgtttgaagtcattactgcggcagccattctgcgcaagcgttgtcccgagctgcgtgtccgagtcattaatgtgacggatctgatgatcctcgaaaatgaaggcgctcacccgcatgctctcacaacggaggcattcgacaatctgttcacatacgacaaaccaattcacttcaactatcacgggtatgcgacggaactgcagggactgctgtccggacggccccgtctggatcgagtcaccatcaacggatacatggaagagggaagcaccacgacaccgttcgatatgatgcttgtgaacaagacatcacgcttccatgtggcacaggctgcccttcggggagcggcgaggaggaacgagagcgttcggatcaggcaacaagagctctacacggagctgaaccacaacattgcagagacgaagaagtacattatcgagaatcgcaagggtaagtttgcctgcgcttga

SEQ ID NO: 51 - DNA, 2061 bp, Botryotinia fuckeliana B05.10
atgaagatcaccacacccccggctaacatcttcatagctatgattttcctttccgataatgcctatttggaaagagatctcacatttgatgatataaaaccaagacttttaggtcactggggaacatgtcctggtcttactttggtttatgctcatttgaattatctcacgaagaagaatgatcttgatatgatatatgttgttggacctggtcatggagctccggcaattctttcttctctttggctagaagggactttggccaaattctatcccaaatattccaacaataagcaaggtcttcataacctcattactggtttcagtacaccatctggatttccttctcacatcagtgccgaagttccaggttccatccatgaaggtggagaacttggatatgctctttcggtagcttttggggctgtgatggataatccagatttggtggttgcttgtgtagttggtgatggtgaagcagaatcgggtccaacagctactgcatggcatgcggccaaatatattgatcctgcggaatcaggtgcggttattccaattgttcatgtaaatggtttcaagatttccgaaagaactatttatggttgtatggatgacaaggaaatggcatctttatttactggatatggatatcaatgccgatttgttgaggatttggaagatatcgaccgtgatatggctacaagtatgcaatgggctcttgatgaaatccgtaagattcaaaaggccgccagatctggaaagccaattatgaaaccaagatggccagtaatcatcatgagaactccaaaaggatggagtggtcctaagattgttgatggagaatatgttgaaggatcattccatgcccatcaagttcctctgatggccgtaaaatccaacaaagatcaactcgctgacctccaaaaatggcttttatcatatggcccagctaaattgtttacagaatccggtgatgttgtggattctgtcaaggcaatcatcccacccgaacacaaaaaacttggtcagagaccagaaacatacaaaaaccatgaagtattaaaagtgccagattggaaaaattatggtgttgagaaaggaacagaagtttcttgtatgaaagctattggcgatctgattgatcaaactttggttgataacccaaaatcccttcgtctcttctccccagatgaacttgtcagtaataaacttgacgcagtattcaagaatacagggcgtgatttccaatgggatgaattttcacatgctcaaggtggaagggttattgaaattcttagtgaacacacatgtcaaggtttccttcaaggatacactctcaccggacgtactggaatcttcccatcttatgaatccttcctcggtataattcacaccatgatggttcaatatagtaaattcaacaaaatggctcgagaaacccgtttcagagcagatctctcatctctcaattatatcgaaaccagtacatggactcgtcaagaacataatggattttctcatcaaaatccttcattcatcggtgcagtgttgaatctcaaaccaacagccgcaagagtttatctcccacccgatgcaaatactttcctctcgacaatctctcactgtctccaatcaaccaactacataaacctaatggttggatccaaacaacctcagcccgtcttcctcagtcccgaagaagcaaacaagcattgccaagccggtgcttcgatttggaaattctgcagcacagacgatggacttgaccccgatgtcgtcctcgtaggaatcggttctgaactcatgtttgaagtcgtggtcgccgctgccttgctccgcaaaaagtgtccagaattgagaatcagagtggtcaacgtaaccgatttgatgattttggaagccgaaactctgcatccgcatagcttgacacaggaggaatttgatagtttgttcacgcctgataagccgattcattttaattatcatgtgtatagtaatgagattaaggggttgctgtttggaagacctcatttgcagagaatgagtatcgcgtgtttataa

SEQ ID NO: 52 - DNA, 2430 bp, Sclerotinia sclerotiorum 1980 UF-70
atgcctggagaaatcattgatagaccaaatcctcaagcattggcttcaaatatatcgggttcaacgacaatagatgagttagcagttaagttggaaaagttacaaattcccgatgatgatttaagaggacttgaggaatttcgcagagctagcaattatattgctgctgagatctttacattcgatgatattaaaccaagacttttaggtcattggggaacatgtcctggtcttaccttagtttacgctcatctcaattatctcaccaaaaagaatgatctcgatatgatctatgttgttggacctggtcatggagctccagcaattctttcttccctctggctagaaggaactcttgagaaattctaccccaaatattccaacaataaacaaggtcttcataacctcattactggtttcagtacaccatctggctttccttctcacatcagtgccgaagttccaggttctattcatgaaggtggagaacttggatatgctctttcggttgcttttggtgctgtgatggataatcccgatttggtggttgcttgtgtagttggtgatggagaagctgaatcgggtcctacagctactgcttggcatgcggctaaatatattgatcctgctgaatctggtgccgttattccaattgttcatgttaatggatttaagatttccgaaagaactatttatggttgtatggatgataaggagatggcatctttgtttactggttatggatatcaatgtcgatttgtggaggatttggaggatattgatcgtgatatggcaacaagtatgcaatgggctttggatgagattcgtaaaattcaaaaggctgccagatctgttattattatgagaactcctaaaggatggagtggaccaaagattgttaatggagggtttgttgaaggatcattccatgctcatcaagtccctcttatggccgcaaaatcaaacaaagatcaacttacagatcttcaaaaatggcttctctcatatggaccagctaaattattcacagaatctggtgatgttattgattctgttaagaagatcttaccaccagaacataaaaagctaggtcaacgaccagaaacatacaaaaaccatgaagtattaaaaataccagattggaaaaagtatggtgttgagaaaggaaccgaagtttcttgtatgaaagctattggtgatcttcttgatcaggctttggttgataatcccaaatctctacgtctcttctctccagatgagctcgtcagtaataaacttgacgcagtattcaaacatactggacgtgattttcaatgggatgagttttcaaatgctcaaggtggaagagttattgaaattcttagtgaacatacatgtcaaggtttcctacaaggctatacccttactggacgtactggaatctttccatcttatgaatccttccttggtataattcataccatgatgattcaatatagtaaatttaacaaaatggctcgggaaacacgtttccgcgctgatctctcctcactcaactacatcgaaaccagtacatggactcgtcaagaacataatggtttttctcatcaaaatccttcatttatcggtgcggttttaaacctgaagcctacagctgctagagtttatttaccacctgatgcgaatactttcctctcaacaatcgctcattgtctcaaatcaaccaattacataaacctaatggttggatccaaacaacctcaacctgtattcttaagtcctgaagaagcaaacaaacattgtcaagccggcgcatcagtttggaaattctgcagcacagatgaaggaatagatcccgatgttgttctcgtaggaatcggatcagaactcatgtttgaagtcgttgtcgcagccgccttactccgaaaaaagtgtcccgacttacgggttcgagtcgtcaacgttacggatttaatgattctcgaagctgaaactctccatccgcatagcttgaccagagatgaatttaatagtttattcacggccgataaacctattcattttaattatcatggttatagtaatgagattaagggattactttttggaagaccaaatttggagaggatgagtattgcgtgttataaggaagagggatcgacgacgacgccgtttgatatgatgttgaggaatgaggttagtaggtatcatgttatggagtgggcgattaagggggcggcgagggtgaataagagggtggcgctggagatgacgggttggttgggggaggttagaggttcgaggagtagggttgcggagtttattttgaggaatgggaaggatcctgaggggacttttgatacgccgatgtttgaggggtcggtttttgggagggagaaagaggggaaggggggggagggggagaaggaggatgggttttttgttaattga

SEQ ID NO: 53 - DNA, 2418 bp, Gibberella zeae PH-1
atgcctggagaagtgatcgaccgaccaaaccctgctccattggatagctcacttccaggtgcggttctggaccttgcagcaaaggcgcctaagaaacagctagataagaagatcgcccagtcgcttaatgattttcagcatgcggcgtgttacattgcggggtctatgatctttttgagagataacgttctactcgagagagagatcaagacagaagatatcaagcctcgattgttaggacactggggaacatgtcccggtatcatccttgtatggtctcatctgaaccttcttatccgcaaccatgatctggagatgatcttcgtcattggacccggtcacggcgctcctggtgcccttgcatcgctctggctcgagggatctctcgaacggttcttccctcaaaagtatggcgtcaacaaggatggcctgcgaaacctcattaccggattctcggttcctggcggcttccccagccacattaactctgagacaccgggatccattcatgaaggtggtgaattgggttactctctagctgtttcttttggtgcagttatggataacccagacctgatcgtgacctgccttgttggagatggtgaggctgagagcggccctactgcagctgcctggcactctatcaagtacatcgaccccgccgagtctggagccgtcattcccatcctccacgtcaacggcttcaagatcagcgagcgcaccattttcggatgcatggacaacaaggagctcgtcagtcttttctccggttacggttaccagcccatcatcgtggagaccatcgaagagattgatgcagaactatctggtgtactcgagtgggctgtcagcgagatcaagaaaatccagaacgccgcgcgagacggaaagcccatcgtcaagccccgctggcccatgattgttctccgaacacccaagggctggacaggtcccaagaaggttgacggagagtttatcgagggatccttccgctcacatcagatacctgttcctggagcaggtcaggatggggagcatgtcaagattctccaggactggttgaagacttatggtactgaccgcctgctcaaggacggtaaacctgcagagagtatcacagacatcatcccccaaaaggacgaaaagcgactcggacagctgaaaaagacatataacccacaccagcagctgcagctccctgactggaagtcttttggcgtggagaagttgtcagaaaatagttgtatgaagcaggttggcaacttcttgaaccaggtcatcaaagagaatcccaagagcttccgcatcttttctcctgacgaactagagagcaacaagctcagtgcggtgtttgagaatactggtcgaaacttccagtgggacgaattctcgcgtgctcagggtggtagggttattgagatcctttccgagcactgttgtcagggatggatgcagggctacacacttactggccgcaccgcgctctttcccagctacgaatccttcctcggcatcatccataccatgatggtccaatactcaaagttcaacaaaatcgctcgcgaaaccaactggagaggcgacctcagctcaatcaactacatcgagaccagcacctgggcacgtcaagaacacaacggtttctcacatcagaacccatcgttcatcggatccgtcctaaacctcaaggccgaagctgcgcgcgtgtacctacctcccgacgccaactgcttcctcagcactatccaccactgcttgggttcaaagaactatgtcaacctcatgattggctccaagcagcccaccgctgtcttcctatcacctgacgaagctgcagatcattgtagaaagggtgctagtgtttgggagtttgcatccactgatagtggaaagcaacctgatgtcgtgattgctggtattggtgtcgaggtgactttcgaagttgtaaaggccgccgaacttctacgcgctttgatccccgatctcagagtccgcgtcgtcaacgttaccgatctcatggtcctcgccgccgagtcacgccacccccacgcccttagccgcgccgacttcctcgacatgttcaccgaagacaaggctatttgcttcaactaccacggctacgccgctgagcttcagggccttctctttggacgccctggcctgcaccgcatgacagtcgagggatacaaggaggagggtagcacgactacgcctttcgacatgatgcttcttaactgggttagtcgatttgacgttgccaagcgtgcgctcaagggcgctgccgagacgaatgataagatcaaggctaagcttgacaagaccttaaagaagattgatgatcgggttgaggaggttagaaggtatattgctgagaatggcaaggaccctgaggacttgtacgatatgcccaagttttag

SEQ ID NO: 54 - DNA, 2403 bp, Nectria haematococca mpVI 77-13-4
atgcccggcgaagtcattgacagacccaacccggcgccgctcgagagtcggttgccatatgagaccctgaaccttgcggcgaggccgccaaagaaggtcctggacaagagtgttgcgcagtccctgaaagactttcaacaagcagcatgctatcttgctgggtccatgatattcctaagggacaatatcttactcgagagagacttgcgattagaagatatcaagccccggctgttgggtcactggggaacatgtcctggcctcatcctcgtatggtctcatctcaatttattaatccgtaatcatgacttggacatgatttatgttattgggcccggccacggcgctccagccgctctggcatccctatggcttgagggctccttggagcgattctttcctcagaagtatggtgttaacaaagatggtctacgaaacctcatcacaggcttctctgttcctggaggttttcccagtcatatcaactctgaaaccccgggatccatccacgagggtggtgagcttggctatgccctagcagtgtcgttcggtgcagtcatggacaaccctgacctcattgttacatgtgttattggcgacggtgaggctgagagcggcccaaccgcagcgcaatatatagatcccgcagagtctggagccgtcatccccatcctccatgccaatggattcaaaatcagtgagcgcaccatctttggctgcatggacaacaaggaacttgtcagcttgttctctggctacggatatcagccggccatcgttgagactttggatgagatcgacgtcgaacttgggagcgctttagaatgggccattagcgagatcaagagcattcagagagctgcgagagagggcaagccgattgcgaaaccgcgatggcccatgattatccttcgaacccccaagggctggacgggccccaagaaggttgataatgacatcattgaaggctcattccacgctcaccagatccccattcccaacgccaacaaggatgagaagcacctaaagattttgcaggactggctccagacctatgacgcaggtcggttgctcaagggcgggaaacctaccgagagcatcttggagatcatgccccggaaggatgaaaagaggcttgggcagcttaagcagacgtacgacccgtacaaggccctcaaactccctgattggaagcccttttctgtggaagcctctcggcagagaagctgcatggagcagacgggcaagttcctggacaaggtcatcaccgagaaccccaagagcttccgtattttctcccccgatgagctggagagcaataagctcagtgcagttctcgagcatacaggccgaaacttccaatgggacgagtactcacgggctcaaggtggtagggtcattgaaatcctctctgagcattgctgccagggatggatgcaggggtacactctcacgggtcggactgcgctattccccagctatgagtctttcctgggcatcatccacaccatgatggtccagtattccaagttcaacaaggttgcacgcgaggtggaatggagaggccccctcagctccatcaactatattgagtctagcacctgggcccgacaggagcacaacggcttctcgcatcagaacccatccttcatcggagccgtgctgaatctcaaggccgaggccgcgcgggtatatctacctcccgacgccaactgcttcctcagtaccatccatcactgcctggggtccaagaactatgtcaacctcatgatcggctccaagcagccgaccgctgtctatctttcgcctgatgacgctgcggagcattgcagaaagggtgcaggagtctggaagtttgcatctactgacggtggaaaggaccctgacgttgtgcttgttggggtaggtgtcgaggtgacctttgaggttgtcaaggccgccgaaatgctccgacagctacttccagacctacgagtccgtgttatcaacgtaacggatctcatggtgcttgcttctgaatctcgccacccacacgcgctcagccgagtcgagtttctagacatgttcaccgaggacaaggccgtgtgtttcaactatcacggctacgctgcggagctccagggcctcatcttcggtcgtcctggtttgcaccgcatgacagttgaaggatacaaagaagagggaaccacgacgacgccgttcgacatgatgttggttaacggggtgagcaggttcgatgtggcgaagcgagcgctgggaggtgccgccaagtacaaggacgaggtcaagaagaaactagacggcatgttggagaagattgatacaagagttgaagaagtcaaggcgtatattagagatgagggcaccgacccagacgaattgtataatatgcccgacttctaa

SEQ ID NO: 55 - DNA, 2364 bp, Verticillium albo-atrum VaMs.102
atgccgggagaggtcatcgaccgtcccaatccatcggcgctgccgtcacagctgcctgacgaggtcctgaaccttgcagtcaagctccagagaaagccacttgacaaagatgtagcccaatcacttgaagacttccagaatgccgcctgctacatcgcggctgctatgatcttcctgcaggacaatgctctcctcgagtcagacctcacgttcgatcatgtcaagccacgactcctcggtcactgggggacgtgtcccggcctcattctggtctggtcacacctcaatctcttgatccgcaaccacgacctcgagatgatctatgtcatcggtcccggccatggagcgcctgccgccctggcctctctttggctcgaaggctccctcgagcgcttctatccaaagcaatatcccgtcaacaggaagggtctctcgaaccttatcagcgggttttctgtgcctggaggctttcccagccacatcaattcggagacgcccggttccatccacgagggcggcgagctcggctatgctctgggggtatcctttggtgccgtcatggacaatcctgacctgattgtcacttgcgtggtgggagatggtgaggcggagagcggacctacagcagccgcctggcacgccatcaagtatattgacccaaaagagtctggcgctgtcatccccatcctccacgtaaacggcttcaagattagcgagcgcaccatctttggctgcatggacgacaaggagatagtttcgcttttcagcggttacggctaccaggtttgcattgtccaggacctcgccaatatcaacgaagacctcgcgaacgcactggagtgggcactttctgagatcaagaagatccaaaaggctgcgcggtttggagagccaatttctaagccccgatggcccatgctggtgatgaggaccccgaagggctggagcggacccaaaaaggttgacggtaagattgtcgaaggatcgttcaactcgcaccaggttcctttgaagaaggccaaaacggacgagagccatctccgcaatctcaaggagtggctgtcgtactacaagatcaacgatctcttaaccgacggaaagccgaacaacaccatcctcgacattctccccaaaacggacgcgaagaaacttggacagttcaagccaacacatgagccttacatcggtctagatcttcctgactggaagtcattcagtgtcgaacgcggtcaccagaacagcgagatggaggcgacggctaagttccttgaccgggtcatccaagacaatccgcacaccttccgcatgttctcacccgacgagctggaaagcaacaagtttggagctgttctcgaacatacggggcgcaacttccagtgggacgagttttcgaggaacaaggggggccgcgtcattgagattctgtcagagcactgctgccagggcttcatgcagggctacacgctcaccggacgagtcgctctgtttcccagctatgaatcgttcttaggaatcgtccatacgatgatggtccagtacgccaagttcagcaagatcgctcagtcgcttgagtggcgcggtgacctggcatcaatcaactacatcgaaacgagcacctgggcgcgccaggagcacaacggcttctcccaccagaacccctcattcatcggagccgtcctgaacatcaaggccgaggccgcaagagcaagtcccatcaagattccctccattgggacccagccgactacaaccttcctctcccccgaagacgccgatgagcattgccaggccggcgcctccatctggcctttcgcctccaccccacttgcagagggcgaccagcccgacgttgtcctcgtcggcatcggcgtcgaggtgacctttgaagttgttaaggccgccgagctcctgcgcacgttggccccgtcgctcaagatccgcgtcgtcaacgtcacggacctcatggtcctcgtcgccgagtcgcgccacccgcactccctgacgcgcgacgagttcatagccatgttcaccgccgacaggcccgtatgcttcaactaccacggctacgccaccgagctgcagggcctgcttttcggcaggccgaacatggaccgcatcagtattgagggctatcgcgaggagggcagcacgacgacgccgtttgacatgatgctcgtcaactgcgtcagtcggtttgacgtcgccgcgagggcgcttcgcggcggggccgcattcaatgacaaggtgaggacggagctggaccgactgttgaaagagatcgatggccgcgttgagacgattcgggacttcatcaacaatgagggcaaaggtcagctttcttcgccgtgtacacgcactctgtga

SEQ ID NO: 56 - DNA, 2448 bp, Neurospora crassa OR74A
atgggcggaacacagatcacaattcccaacccccctcctctaccatcccacctccccgacaatgtcctcgacctggcagtccaaattgagcgcaagaacctcccagacaatgtccgcgagtcgctgcgcgcattccagcgtgcaggatgctacattgccgcctccatgatcttcttgcgcgacaatgtcctcctccaagacaaactccaagtttcgcacatcaagccccgactcctcggtcattggggaacatgccccggcctaatcctggtctggtcgcatctcaacgtcttgatccgcaaccatgacctcaacatgatttacgttatcggccccggccacggcgcccctgccgccctcgcctctctgtggctcgaaggctcccttgagcgcttctaccctggcgaatacgaccgcaatgctactggtttgcgcaacctcatcacccgtttctctgtccccggcggttttcctagccacatcaacgctgagactccaggtgcgatccatgagggtggtgagctcggatatgccctttctgtctcgttcggcgccgtcatggacaaccccgatttgatcgtcacttgtgtggtaggcgatggtgaggcggagactggcccgacagcaaccgcctggcatgctatcaagtacatcgaccccaaggagtcaggtgccgtcatccccattctgcatgtcaacggcttcaagatcagcgagcgcaccatttttgggtgcatggacgacaaggagatcgcctgcttgtttagtggctacggataccaggtgcgcattgtggaagacctggagaacattgatgatgacctgcaaagttcgctggaatgggctctagtcgagatcaagaagatccagaaggctgcgagggaggacaacaagccgattgtgaagccgagatggccgatgattgtcctcagaacgcccaagggatggactggtcccaaggaggtggagggccaaatcatcgaaggatccttccactcccatcaagtcccccttcctaaggctggtagtgatgagaagcaactccaggctctagacgagtggctttccagctacaggatcagcgagctccttgatgatgagggcaagcctactgaggccatcactcgtgtcttgcccaaggcagaaaagaggctcggtcaactcaagatcacatatgacccatacattcctctgaaactgattgactggaagcagtttggcgttcaaaagggcgtcgacgaaagctgcatgaagagtgccggcaagttcctcgacaagttgttccaagagaaccccaaaaccctccggctattctcccctgacgagctcgagtcgaacaagctcaacgccatcctggatcacacacagcgcgactttcagtgggacgagttctcgagggcacatggcggtcgcgtcatcgaggttctctccgagcacaattgccagggcttcatgcaaggatacactctcacgggccgcaccgccctcttcccctcctatgagtccttcctgggtatcgttcacaccatgatggtgcaatactccaagttcgtcaagatcgcgcgtgaagtaccctggcgtggcgacctggcctccatcaactacatcgagacttcgacctgggcgcgtcaagaacacaatggcttttcccatcagaacccctccttcattggtgctgtacttaacctgaaggccgaggccgctcgcgtttacctcccgcccgacgccaactgcttcctcagcaccgtgcatcatgtcatggacagcaagaacaagaccaacctcatcatcggctccaagcagcccacggccgtctacctctctcccgccgaagcagccgaccactgtcgccagggtgcctcgatctggcatttcgcctcttcctccgaccccaactcatccgcaggagagtcggtacaagacccagatgtagtcctcgtcggcatcggcgtcgaagttacttttgaggtgattaaagctgctgaactcttgcgctccattgcgcccgccctcaagatccgcgtcgtcaatgtgacggatctgatgattctcatcgaagagtccaagcacccgcatgccctggccaaggccaagttcatcgaaatgttcaccgccgacagaccggtgttgttcaactaccatggctacccgacggaactgcagggtctcttgtttgggagggaaaaggcggagcgcatggatgtcgagggttaccaagaagagggaagcacgaccacgccgtttgatatgatgttgaggaaccgggtcagtcggttcgatgtggcgagctgggcgctgaagaggggtgcggagaggaatgcggaggtgaagaatgatttggaaggtttgttgggtgacgtggataggagagtgaaggaggttcgtgagtttattgggaatgaaggaaaggatcccgatgatatctaccaactgcccaagttcgagtag

SEQ ID NO: 57 - DNA, 2442 bp, Magnaporthe grisea 70-15
atgcctgctccagagatcaccgagccaaacccaccacctctgccatccaacatcccagacagtgccagcgagctcgcagtacgcaaacacttgcctgtgagcaaactgtccgaagatgacctcgccggtgtcaaagagtttcgccgtgcggcgtgctacatcgccgcggccatgatattcttacgggacaatgtcctcctcgcagacgacctcacagtcgatcacatcaaaccgcgcctgttgggccactggggtacctgccccggattggtcttggtctgggcgcatctgaacctgctggtccgagatcatgacctgcacatgatccacgtcattggcccaggccacggcgcccccgcagcgctggccgccctctggctggagggttcgctggagaggttttaccccggagagtacgatagaagctcagagggcctaaagaacctcatcacgaggttctcggtccccggcggctttcccagtcatatcaatgccgagactcccggcgcaatccatgaaggcggagagctcggctacgctctatccgtctcgtttggcgccgtcatggacaagcctgatctcgtggtcgcctgcgttatcggagacggtgaggccgaatctggccccacggccacagcgtggcactcgatcaagtaccttgacccagccgagtcgggtgccgtgctgcccattctgcacgttaatggcttcaagatcagcgaacgtacgatttttggttgcatggacgacaaggagctcgtcacgctcttcacgggctacgggtaccaggtccgcatcgtcgaggagctggatgacatcgacaacgacctgcaccaagcgctcgagtggggcctctccgagatccggaatatccaaaaggcagcgaggtcgggagagaaaaagccaatcgtcaagccgaggtggccgatgatcataatgcgaacgcccaagggctggtcgggaccgaaggaggtggatggaaaggttgtggagggatccttccgctcccatcaggtgccgctgcccaaggctggaaacgacgagacccaattggagctgctgcgggactggctcgcgagctacaagatcggcgatctgcttgaggacggtggcaagcccatccggcggattactgacaccatgccccgcaaggatgagcaaaagctggggcaggtcaaggaaacttacgcgcctgaaccaggcctggaggcagtcgactggaaaccttatggtgttgagaagaagacgacagccagctgtatggcgaccacgggcagcttcctcgatgccgtgtttcaggcaaacccgaaccgtatccggctcttcagcccggacgaacttgaaagcaacaagcttcacgccatcctagaccacacgcagcgcaacttccagtgggacgcatactcgcggggtaatggcgggcgcgtaatcgagaccctgtcggagcaccaatgccaaggtttcatgcagggatacacactgacaggccggacggccatcttcccatcctacgaatccttcctcggcatcgtgcacacaatgatggtgcagtacagcaagtttgtcaagatcgccaaggaagtgaaatggaggggtgatctcagcagcatcaactacatcgaaactagcacttgggcgcggcaggagcacaatggcttctcgcatcagaacccgagtttcatcggggcggtgctcaacatcaagcccgattccgcaagggtctacctcccgcccgacgccaactgcttcctcagcacagcgcaccattgcgtaaagtccaagaactacgtgaacctgatgatcgggagcaagcagcccacgagggtgtacctctcaccagacgaggcggcagagcactgcaaggctggagctggcatctttcactttgcgtcaacgccggccgagaatggcggagacaagaccaagtcgacagcagacccggatgtcgtgctggtcggcatcggtgtcgaggtcactgccgaggccgtggccgcggcagaactcctgctagacctgtgtccggagctcaaggtacggatgatcaacgttacggacttgatgatccttatccctgagagccggcatccacactcgctgtccgatgataagtttgaagagcttttcacggccgacaagccggtgcttttcaactaccacggctacgcaacggagctgcagggactgctgtttggacgaccccgtacggagaggatgacggtcgaaggttaccgcgaggagggcagcacgacgactccctttgacatgatgcttgccaactgcgtcagccgattccaccttgccaggagagccatccgcgccgcttcttcgtcgtccgctgtcgacaagaacaagctggaccaggtgctgaaggagatccaggccagggaggaccgggtgaggaagtatattgacgagaacggcaaagatccggaagagatgtaa

SEQ ID NO: 58 - DNA, 2316 bp, Podospora anserina DSM 980
atgccccgatccgaaatccccatccccaacccccccgccctcccctcctccctcccagacagcatcctccacgacctatctgtcaccctccctcccaaacccctcccccccaccgacctcgcctccctcaaagccttccagcgagcagcaaactacctcgcggcatccatgatcttcctccgctccaacactctgctgcaaaaccccctctcccacaacgacatcaagccccgtctcctcgggcactggggcacctgccctggcctcgtccttgtgtattcccacctcaaccttcttttgcgaaacaaccccgacctagaaatgattttcgtcatcggtcccggtcacggcgctcccgctgcgctggctgctttatggcttgaggggtcactggagaggttttaccccggggagtatgatctcacggaaagcgggtttcataacctggtgacgagattttctgtgccgggggggtttccgagtcatatcaatgccgagactccgggtgctattcatgaggggggggagttggggtatgcgctgggggcggcgtttggtgctgtcatggacaagcctgatttggtcgtcacggtagtggttggtgatggagaagcggagacgggaccgacggctacggcgtggcatgcgatcaaattcttggacccgaaggagtcgggggcggtgatcccgatactgcatgtcaacgggttcaagattagcgagaggactatttttgggtgtatggatgacaaggagattgtggctttgtttagtgggtatgggtatcaggttttggtggtggaggatttggaacgggtggatgaggagttgcagggggggttggactgggctttgggggagatcaggaagatacagaaggcggcgagggaggggagggcagtggttaagccgaggtggccgatgattgtgctgaggacgccgaaggggtggacggggccgaaggaggtggatgggaagattattgaggggagttttcactcgcatcaggtgccgcttcccaaggcgggggaggaggatggacagctgggggacttggggaagtggcttgagagttatcggattggggagctggttaaggacggaaggccgacggaggaggtgacgaggattttaccgcgggagagggagaggaggttggggcagaataggctgacgtatgatgcctatgaggggttgaagagggttgattggagggagtttacggtggagaaggggactgatcagagctgcatgaaggttacgggcaagtttttggacagggtgtttcgggagaatccgaagagcataaggttgttttcgccggatgagctggagagcaacaagctggatgcgatactggatcacacgcagaggaactttcagtgggatgagtattcgagggggaacgggggaagggtgatcgaggtgctgtcggagcatgactgccaggctttcatgcaggggtatactctgactgggaggactgccatctttcctagttatgagtcttttttgggtattgtccacaccatgatggtgcagtactccaagtttgtcaagatcgcccgggaagttccctggaggggggatttggcgtcgatcaactacattgaaaccagcacttgggctcggcaggagcacaatgggttttctcatcagaaccccagcttcattggtgcggttcttaacctcaaggctgaggctgcgagggtttatcttcctcccgacgccaattgttttttgtcgactgttcaccactgcctcgggtcaaggaattatacgaatctcatcatcgggtccaagcagcctactgctgtgtacctctctgcagaagaagcggccgaacactgcaggcgaggcgcgagcatctggcagtttgcctcgacccctctcgggccgaacgaggagccggatgttgtcttggtgggcatcggggtggaggtcacgtttgaggttatcaaggcggcggaactgctccgggagatttgtccggcgttgaaggtcagagtggtgaatgttaccgaccttatgattcttgctcctgtgagcaggcaccctcatgcgttgagcaaggagaggtttttggagttgtttacgcgggagaggccggtgttgtttaattatcatgggatgaggcttgaggggtatagggaggaggggacgacgacgactccgattgatatgaagttgttgaatggggtcaatagggaggaggtgttgggggagattgagaagagggttggggaggtgagggggtttgttgagagggaggggaaggatccggatgatatgtatgaggttgctaggtttgagtag

SEQ ID NO: 59 - DNA, 2418 bp, Coprinopsis cinerea okayama7#130
atgccaggacaacaactgtcagaaccaaatcctcctccaggaccttcgcacctccctgactcgacgttggactatgttgtcaggctggatacgaaaaattatcttccagaggatgagctgaaaggacttcaactgtttcggagggcagcggactacatagctgcagctatgattttcctcaagaacaacgtcctcctagaagagaagctgtcccaagagaacattaagccgcgtctacttgggcactggggaacatgtccaggcctcacactaatctacgcacacctcaaccgcatcatccgcaacacaggacaagataccctcttcgtcgtcggtccaggccacggtgcacccggtatcctatccagcctctggctcgaggactccctcagcgtcttcgaaccttccatgacccgtgaccgccccggcctcacaaagctcatctcgcgcttcagcgcccccggtgggttccccagccacatcaacgccgaaacacctggcgcaatccacgaaggtggggagctgggctatgcactgagcgtctccttcggcgctgcaatggacaacccggacctagtggttgcgtgtgttgtaggggatggagaagcagagacgggtccgacggctgctgcgtggcatgggaccaagttcttggacccggcagagtctggagctgttcttcctatcctgcatctcaacgggttcaagatctcggagaggacaatttttggcgttatggatgataaagagatcaattctctcttcagtggatacggataccaagtccgcatcgtttctgaattggacaacctcgataatgaccttgcggcctcgatggactgggctatctccgagatccacaagatccaaaaagcagcgcgctcaggcaagcctatccccaaacctcgctggccattgctcgtggtccgtactcccaagggcctcggagcaccccattcgattcacggctcctttatcgaagggtcgttccactcgcaccaggttccgttgccgaatgctgcgaaagataaggaggaactcaaggcgcttgaggcttggctggagtcgtacaaacccggagaattgttcgacgagaacggtgcccctcgacctgaagttctaaccatcattccgcaagccaacgcaaagaagcttggacagcgcaaggaaagctacggcgcgtacatcccacttaagatccccgactggaggcagttcaccgtcgacaaaggaagtgaagagagctgcatgaaatcagttgggaggttcctcaagcaagtcattgtcgacaaccccaaaacattccgaattttctcccccgatgaactatcctccaacaaactcgacgtcgtcctcgacgaaacgcgacgcaacttccaatgggatatcggcggcaaaggcgggcgcgtaatcgagattctctccgagcacacttgccagggtatgcttcaaggctacaccctcacaggccgcacagggcttttcccctcatacgaagcattccttggaatcatccaaaccatgatggtccaatattccaagttcatcaaaatgggctcagaaacgaaatggcgccagcctcacggatcgctcaactacatcgagacatccacatgggcaagacaagaacataacggcttctcgcaccagaacccggcgtttatcggcgcagtgttgaatttgaaaccaaagtttgcgagggtgtatttgccgccggatgcgaattgctttttgtcgacggtagcgcattgtttgagggcgaagaattatgtgaatttgatggttgggagtaagcagcctacgccggtttggctgagccgcgaggaggcagataggcactgcatcgccggtgcctccatatggaagttcgccagcgtcgacgaaggacttgacccggacgtcgtgctcgttggcatcggcgtcgaagtgacgttcgaagttatcgctgcagctgcgctactccggaagcacgtccctgagcttcgggtacgcgtcgtaaacgtgacagacctgatgattctcggggccactggcacgcaccctcattctctcaacgacgaggctttcgacacgctcttcacaaaggacagacctgtgcacttcaattaccacggataccccatcgaattacgtggattgctgtggggtcgaccgaacatggagcggattaccatcgagggttatcgggaggagggaaccacaacttctccattcgacatgatgctctgcaaccacacgtctcgttacgacgtcgctgtggcggcactccgtggtggagccaagaataaccccaaagtagctctcgtcgcccatgaaatgtccagctactttgaacacatggcaagaaaggagaaggactatatcttggccgagggcaaagatcgcgatgatatgtttgaagttcccaagtttgattag

SEQ ID NO: 60 - DNA, 2478 bp, Schizosaccharomyces pombe
atggctactcaaaacgatatccctaactcgactcccgaggatttagcgaaacaagttgaaattgccgaaaaacaccccgatcctcctgctatgccctcgcgtcttcctgactctttaaaaaccctcgaagctaaaatcgacacttcaaagattaccgacgaagaggttgccaatgtccatcgttttcaacgtgcatgtgattacctcgcagcttccctgattttcctttccaacggtctctacaccggcggtgacctcgaggaaaaagatatcaaaactagactgctaggccattggggtacttgtcccggcttgagcatcgtttactctcactgtaatcgtatcattaataaatatgatctcaacatgctctttgtcgtaggccctggccatggtgctcctgccattttatcggctcttttccttgaagattctttgggccccttttaccctcgataccaatttaccaaggaaggcttgaacaaccttattaacaccttctcccttcccggtggttttccttctcatgtcaacgccgaggtccctggtgccattcacgagggcggtgaattgggttatgcgttgtccgtcagttacggtgcagttcttgatcgtcccgacctgattgtaacttgcgttgtcggtgatggtgaggcagagaccggccccactgccacttcttggcatgctcataaattcttggatcctgctgaatcgggtgctgtgattcctgttttggaacttaatggttacaagatttccgagcgtaccatttacggttgcatggatgatagtgagcttctctctttgtttagcggttttggctatgaagttgccattgtaaacgatacccccgaccaaaacagggttatggctgcaactatggattgggccgttgaacgcattcatgacatccaacatcgcgctcgtgttaacagagaagaaatcaaacccagatggcccatgattatccttcgtacccctaagggtaaaggatgtcccaagtatttgaatggcaaatttttagaaggtaccttccgtgctcaccaagttcctttgaaattggctcgcaccgataccaaccagcgcaatcttctaaaggattggctgaacagctacaactgccaagacttcttagacgaacatggacttcctactaagggcatcaccgagcatcttccgcctcgtgagaagcgcatgggtcagcgtcatgagacatacaattcttatctacctttgaaggtacctgattggaaaaaatacggtgtcaagaagggagaaaccactagtgccacttcggtcgttggtcaatatcttgatgaactcctcgtaaccaacgattcaacccttagaattttctcacccgatgagttggaaagtaataaattagatggcgctttgaagcactcatatcgtaccatgcaaactgatccagagctcatggcaaagcgtggtcgcgttaccgaagtcctttcagagcacctttgccaaggtttcatgcagggttatactttaactggacgtaccgcgattttcccctcatatgaagcctttatgactattgttgttagtatgcttgttcagtactccaaatttttgaagatgggcttggagaccggatggcatggaaaatttggtagcttgaactatgttacttccagtacttgggcaagacaagagcataacggtttctcccatcaatcacccaggtttatcaccactatgctctctctgaaacctggtgttagccgcgtatacttcccaccggatgccaattgcttcttagcaaccgtcgcccgatgcatgaagtctgagaatactatcaaccttatggtttctagtaaaaatccacaaccagcctacctatctgttgaagaggccgaacatcattgcaaggccggtgctagtgtttggaagtttgctagtacagataatggcgaaaatcctgatgttgttattgccggcgtcggaaatgagattatgtttgaagtagttaaagccgcagagatgcttcaaaatgacattcctgagctccgagtgcgtgtcattaacgtcactgacttgatggtactttcgagcttacatccccatggtatgaatcctgcggaatttgattctttgtttaccaaagatcgccatgttcatttcaactatcacggttatgtgatggacttgaaggctctcttgtttgatcgcatacaaggtacacgggtcactatggagggctatcgagaggaaggtactactaccactccttttaatatgatgatgtgtaacaatacctctcgttatcatgttgcaagaatggctttgcaacatgctttacacaatcctaccgtggccgttaattgtaacatgttgtgtgccaaatatgcttggaagctcgaagagattgaaaattatattatggaaaacaaggatgatcctcctgaaatttatgctgctcctgtctttaaaaataagacttccacattatag

SEQ ID NO: 61 - DNA, 2469 bp, Schizosaccharomyces japonicus yFS275
atgaagtttgaagcaacgaaagagttcatgaatgaaagccgtacggaggcagcaaaagctgacccctctccgctacagtctcatttaccagcgacactggacacattgcaagtgcatctcttaaaagattatgttcctgaggatgacctcgtcacgttaaagaattttcagcgtgtctgtaattacatcgctgctgcaatgatttttctgtgcgataatgtcttgctagaaaacaaacttacaagcgatcatattaaacctcgacttttgggacattggggaacttgtccagcgctggcgctggcatattctcattgtaacaggattatctcaaagtataatcttgacatgttgttcgttacaggcccagggcatggtgcacctgcaattttggctgctctgtatattgaaggttcgttacaggcttactatcctcagtatggccacaacatgcaaggtttgcaccgtctcatcacaaaattctccgtgacgggtggctttccttcgcatgtaaacgctgaggttcccggtgccattcacgaaggcggtgagcttggttatgcgttgtccgtaagctatggtgccgtgcttgatcgaccaaatttgattgttgcatgcgttgttggcgatggtgaagccgaaacgggcccaacagctgcttcttggcattgccataagtttatagaccctgctgagtcaggtgccgtcattcctatcctcaatctcaacggcttcaaaatctcggaacggaccgtgtatgggtgcatggacagacgggaactatctgcactcttcagtgggtttggctaccaggtcgtgtttgtcgattaccgaacggctgatgatgtgaatcgtgacatggctgctgccatggactggtgcgttgagattatccacgaaatacaggatgctgcacgggccggaacgcctatcataaaaccacgttggccgatgattattcttcatacgccaaaaggctggggctgtccgaagacgttgcatggcaagccgcttgaaggcacatttcgtgctcatcaagtaccactgaaaaacgctaagacagatgctgaggagctgggtcaattagagaactggctgaaaagctatcatattgaagatttcattgacaaaagtaatggtctcccattgaaaggactcattgagcatcttcctccccgtgttaaacgaatggggcaaaagacagatgcgaataacgatttccaaccactctgtgtcccagactggaatgacttttcgattgaccgtggtatcttggagagtgcaacttctatagtaggaaaatacttggatcgtgttcttcaagcgaaccctaaaactttgcgtttattttcaccggacgaattggctagcaacaaactcgatggtgtattagagcattcgaatcggacattgcagacggatgcaataagtgcatggagtcgcggtcgagtcacggaggtactttcagagcatatgtgtcaaggatttatgcagggctataccttaacaggtcgcaccgccatctttccttcttacgaagcctttctgcctatcattactagtatgaccgtacagtacacaaagtttttaaagatggctttggagacgaagtggcatggcagagtcggaagtcttaattacgtgacgacgagtacctgggcacgccaggaacataatggcttttcgcaccagtcacctcggttcattactacaatgctctcattcaagccaaccttgacacgcgtttattttccaccggatacaaactgtttcctgtcaaccatagctcactgtctttccagcgacaacggtgtgaatctcatggtttcaagcaagaacccaggaccctcatggctgtcaagagaggaagccgaagagcattgcgtagctggtgcgagtgtttggaagtttgccagtacggacggcggactcgatcctgacgtcgtacttgttggcattggcaatgagattatgtttgaagtgattgcagcagcttccattctcgcacatgatttaccaaagctgcgtatccgtgttgtgaacatcacggaccttatgattttggctgacaaccacccgcattctatgtctgaaattgagtttaacgcactctttactccgaaccgccatgttcactttaactatcacggatatgtcatggatctccagtccctcctgttttctcgcatcgatgcttcacgggtgagtatggagggttattgcgaagagggaactacaacgacaccgttcaacatgatgattgctaaccgtacgtctcgataccatgttgcaatggctgccgtcgctggagctacttgcaatccagaggttgccatgaattgtcacaaactcatcagcaattacaagcacagacttacacagatcaagcattacatatatgaaaatggagtggatccagaaggcacctttgatattcccgacaatttgaccaagggacaggtaatttaa

SEQ ID NO: 62 - DNA, 2556 bp, Cryptococcus neoformans var. neoformans JEC21
atgccaactttggacgccgtcacccctcctaaaccctcttctttaccccctgacattgtcacacaactcttgatcaatctcgacggcaaggttgatcagctcaagtcgtctaaaggaggccttgatatagagggtctcattgctttccagagggtagccaattatcttgcagcggcacagatattcttacagcacaatgggcttctcacccagcctcttgaaacaaagcatatcaaaagccgccttttgggtcattggggtacctgtccaggtctcaatttcgtctacgcccacaccaataatctgatcactaaccatgagactgatcctgacgttcccgagtttatgtttcttactggaccaggccatggtgcgccagctttgctttccactttattcatggaaggttcaatcaccagattttaccccgaatatcccatgtctcgagagggtcttgaacatttcattagatcatttagtctccctggtggatttcctagtcatgtcaatgcagagacacccggtgcgcttcatgaaggtggagaactaggttactgtttggctgtcgcttatgggagtatcatggacaagcccaaccatatcactgtcgctgttattggtgatggtgaaagcgagactggccccactgccaccgcatggcacgcacataaattcatcgacccagctgaaagcggggctgtaattccgatccttcatgtcaacggttacaagatcggggaacgtactattccaggaacaatggacgatcttgagcttgcatgcttgtacactggctacggctatcaagttcatattgtcgaatatggaagcaagtcgcccgaaaaagcatctgatcacgagcatgacatagctgtccaatatgacatggcagctgctatagaatgggcgtaccaggagattaagaatattcaacaatgcgcaaggtcgggtcgtcctattactaaacctaggtggcccatgattatcatgagaacccccaaagggtggactggaccgaagaaggcggaaggccacctaatagagggtaactggagagcccatcaagttccacttcctaaagcgggcgatgaaggggaagagtttgaacttctgaagaaatggttgcattcgtatgggcccgaagagcttttccatgtggaagtggattcaaacacttcccaggcccatgaagctgtcaacaaggccaagggaattatcgatagcagggctctccgcattattccgaaagaccaacaaaggaggatgggaatggtcaacgcaacctaccgtgggttcatacctctcaaaactcctgaatggaaggagtacggtcatgatatggaggaagaagtctcaaatatgaaagccgtgggcgactacgtggctaaggtaatcgaaatgaacccgagcaccttcaggatcttttcgccagacgaaatcactagtaacaagcttgatgcggtccttgatgttactcaaaggaatttccagtgggacccagagactgccaataagggtggtagagtcattgagatgctgtcggagcataccctccagggttggatgcaaggttataccctcactggacgccatgctcttttcccctcatatgagagcttccttggcatcgttcagactatgatcgagcaatacgccaaattcttgaagatggctctggagacgaaatggagaagtgatgtatctggcctaacttacattgaaactagcaccttatggcgccaagaacacaatggttattctcatcaaaacccgggcctgattggttctttcatttcccttcctcgtcatctcgctcgaatttatttacctcccgatgccaactcgagcattgccacgattgatcattgccttcggtcaaagaataatatcaatcttgtgatcggatcaaaaaacccaacaaaaggtttcttgactattgaagaggccgagaggcactgcattgctggtgcttcagtttgggaaaagttctcttctaatagaggcattgaccctgatgtggttcttgtgggttgcggtgtagaagtcaccttcgaagtcattgctgctgctgctattctgcggaaccaaggtgtcaaggtccgtgtagtcaacgttaccgacctcctcatccttgggagagacggtgtccacccgcatgcgttagatcaagacgcattcgatagtctgtttactgtggataaaccagtagtcttcaatttccatgggtacccaaaggatgtcgaagcattgttgttctcaaggcgtgcacatgttgggagatcgaggttcgacattttaggctacatcgaggaaggaagtacaacaactgcatactcaatgttgcggctcaacaacacatctcgttactcgctggccgatatcgctgtgcggagagttgggcgaaaccagcccaatcaccctatcaatgttcgatcgcatgagctcagcagctgttggagacaccagcttgtacttcatgacaaatttaccaaggaatatggtaaggacccgcagtggtgtgctgagattccagaactggaaaagaatgctgcgtag

SEQ ID NO: 63 - DNA, 2682 bp, Ustilago maydis 521
atgtcggcgccacttggtttccacctcatcccgtctcgtatcgacgcaaaccaacctttgcgagaccaggagacctatcttgttctgcctgacgtggaccgtaggtcggagcgctatgatctcgagtcgatccaagcttttcaaaaggctgccaactaccttgctgtagcccagatctacttgcaggacaatgtgctcctggaagagccgctcgactataaggctcacgtcaagaagagactgcttggtcactttggcaccgttcctggcctcgtctttgtttatgcgcacgtatcggcccttctagcacgcatcgaaaggaacacagccaccgattcgtatggcagacacagagccatttttatcactggtccaggacatggtgctccagccatcctcagctgcctgtacctcgaaggttctatctcgaaattttatccagaggaatcggtctcgcaccagggtctacatgcgtttgtcaggaactttagctggcccaacacggtacgtccatcgcacgtgacggcgacaacacctggtgcgattcacgaaggaggcgagctcggctatgcgctctcggtagcacatggcgctgtcatggacaagcctgacctcatcgcatttgccgtcatcggagacggagaggcggagaccggtccgactgcaaccgcgtggcattcacacaagttcattgacccttgcgagtcgggtgccgtcttgcccattctgcatctgaaccgcttcaagatcagcgaaaagacgatttttggcacgatggatcgcaccgagctgctggcgctgttcgtcggctacggctatcaggtgcgctttgtcgactactaccaacatctcggtactaagcacacgattcctggtgaccacgaggccacagcgtttgatgtcgatatggcagccagcctcgactgggcgctgagtgagatcgataacatccagaaggcggcacgtcaggccgaagctcaaaagaaaccgcgctggcctatgatcatcttgacctcgccgaaaggatggggtgcgcccgttcaggttgatggtcagcagatcgagggttcgtttcgaagccaccaagtgcctgtcaagctcggcgcttggtcgggcgccgatgagcatctctccatcctcgaaagctggctcgaatcgtataagccacgtagctggttgcagtcggattcgggccaactcaggctgaatcctcttgtgacacgcatgctgcctagtgatgagctccgcctgggtcgtatccgcgagatctacgaaaagagcgctgacttgcaagatgtaagcaccagcgcttacatggtcagctcagagtcgtcggacaacagccgtggcaacacacgatccaaagcttcagccatggagcaatgcggcaaatatctggcagcgctgttgcccaaaaatccggatcgactgctcatcttttcacccgacgaactcgtctcgaataagctcgatgccacgctcaaagtacaaggcttgaaagcacgcaaattcgaacacgattccgagagtattgtgacgccacaagagcgtcagcaggggattcggtctgggcgcgttatcgagatgcttagcgagcacacgctgcaaggctttgcacaggggtacgcgcttacgggtcgaatcggtctctttccgagctacgagtcgtttttgggcattgtgacgactatgatggcgcaatttgccaagtttgtcaaggtggccaagacgacggattaccgatcaccagtaccgtcgatcacgtatgtgatgagttcgacgttgtggcgacaagagcacaatggcgccagccatcagcagccaggtctaatcaactcggtgctggatctcccgcacaatgttgcacgtgtctatttgccgccggatgccaactgtgcggtgtcgacactgtcgcactgcctgcgcagccacaactatgtgaacctggtggtcggcagtaagcatcagaccagggtgtatctgagcgaggacgaggcaaatgcgcattgcaaggcgggcgcatcgatttggcatgcttactcgaccgacggtggtcaagagccggatgtggtgattgtaggcattggtaccgagacgacggcggaagcgattgcggctacagagctgctccgaggagcgcagcttgacgacagtgccaagagcgatggaagtgcaaggcaggcgccggaggatgttttgcgcgtgcgcttcatcaacgttaccgacctcatgatccttagcgaaaactcggtgcaccctcacgcgctgagccaagagctctttgacggcctgttcacacgcgatgttcccatcctgtttaacttccacggctacaccaccgccatcaagggcttactcggcgaccggctgtctggcgagatgggtcgacgtcccatggccgtgcacggctttatcgaggaaggcagcaccactacgccctggaatatgctcaagctcaatggcgtcgaccgcttcaccgttgcatgccgagctgttgagctcatccaacgcgatctcgagcttaagaagcatcgtcgagccaaagtcaacgagcgactccaaaagatggctcagagtcaaagattcgacatgcttgcgagaaagtggaagcagaggcgagaggagtggcagcagtatatcaatcgcaatggtcgagatccagatgaggttgatgccgagtga

SEQ ID NO: 64 - DNA, 2442 bp, Microcoleus chthonoplastes PCC 7420
atgacaataaccacttcaacaccccaagcgtccttctctcaaccggacattcccgttacccaagtccggcaaaatcagggtgcagaactcgacgcgatcgcgaaatatcgccgtgcggctaactacctagcagcgactcaaatttatctcaaagataatgttctcttacgcgaacccttaaaacccgaacatataaaagatcgtttactgggtcactgggggacttgtcccggcattaacctagtctatgcccatctcaaccgactgatccggcgttacgatgccaatatgtttctggtgactggacccggacatggtgcgcccgcgaaccttgccaatctttacctagaaggatcgttacgggattattatcctgaccttagcttcgatgaagctggagtgtatcggttagtcaagcagttttcttggcccggtggctttccctcgcacctgtatccagggattcctggcacgattcacgaaggtggggaattaggctacgccttggcgacagcgtttggggcggtaatggataaccctgatctagtggtagcgtgtatcgttggcgatggcgagtcagaaacgggacccaccgctacagcatggcatggaacaaaattcattgatccggctgaatccggggcagttttaccgattttgcatctgaatgggtacaaaattgccagcccgtcaatttttggcacgatgagtgatgaggaattgctgcatctgtttaccggatacggctaccaagtgcgaattgtcgaagatgaggacttggatgctgatatgtatgcttcaatggattgggcatatcaagaaatctgtcggattcaacaagccgcccgttccgggaaccgtatcagcaaaccccgttggcccctaatcatcttgcgatcgccaaaaggatggacagggattaaagaagccgacggcgtaccgattgaagggaatttccggtctcaccaagttcccctcaaagaggttaaaagtaatcccgaacatctagaactgctagaaaattggttccgttcctaccgtccagaggaactgtttgacgaacaaggacaacccttccccgacattttagatcaatgtccccaaggggaacggcgcatgggcagcaatccccacaccttcggcggacgtatgcgtcaacccttagagttaccggatctgtttaactatgctgtcccggtagaacatcccgaagccgcccaagggtgtcaacgcggcgagagtagcgttagtaatacctatgaagtgggcaaatatctccgggatgtgattcagcaaaatcctaataacttccggattttctgtcccgacgaactcgaatccaaccgcctgtacaaagttctcgatgttacccagcgtaactatcagtggcccaccggaccctttgatggcgagattggacccgatgggggacggattatcgaattactgagtgaacatacctgtcaggcattcttacaagggtatctcctcaccggacgacatggtttattcccttcctacgaggcatttttgggcattgtcaccacgatgatggatcaatatgccaagttcttaaaatactccaaagaattcccctggcgtccccctgtatcgtccctgaattacttagaaacctcaaccctgtggcgacaggaacataatgggttttctcaccaaaatccgggctttattaatagtgtcttggatcagcaggctgactatgcgcgggtgtatttaccccccgatgccaactgtctcctcagtacaattgaccactgcttacagagtacaggctatgtcaacttagtcatcgccaacaaaaatcctctgccacaatggttgtctatggaagacgcgatcgcccattgtcgggcagggggttcagtatggcaatgggcgagtaccgatgatggggttgatccggatgtagtaatggtaggaattggcgattgtcccatgttagaagtgatggcagccgcgcaaatcctcagaaatgaattaccggaattacggatacgagtggttaatgtgacagatctattaattctggaacaaaattccactcatcctcacgggttagatgatgatatgtttgctgccctattcactcccgataaacccgtgattatcaacttccatggttatccctcgctgattaaacaaatgctgtttgggcgtcccacaattgagcgattccaaattaatggctatcaggaagaagggacaaccactacaccctttgatatgcaagtccgcaatggtacgagtcggtatcatttaatcatgcaagcgattcgtttagccgcccagaaaaattctcgtgtatccgcacgggcaaatgatcgggtgcgtcattatgaatatgtgttagcggctcatgggcagtatatctgtgagactggcgaagatccagacgagattaccaattggcagtggtgttaa

SEQ ID NO: 65 - DNA, 2349 bp, Actinosynnema mirum DSM 43827
atgacgaccacgcagacgagcggcaccgaggccgtccagcgctaccgcagggcgtgcgactacgccgccgcggccatgatctacctcagggacaacaccctgctgcgcgagccgctgcgccgcgagcacctcaagccgaggctgctcggccactggggcacctgccccggcatcaccttcctgcacgccggcctcaacggcctggtgcggcgcaccgggcagcggacgctgctggtcaccggtcccggccacggcgcgcccgccgtgcacgcgaacctgtggctggagggcacgcacgccgagctggacccggccctgagccgcgacggcgcgggccttgcggagctggtgcgccgcttctcctggcccggcggcttccccagccacctctcgccggaggtgcccggcgtgatccacgagggcggcgagctgggctacgcgctcgccaccgccttcggtgcggccatggacaagccggacctgctggtggcgtgcctggtgggcgacggcgaggccgagaccggccccacggcgggctcctggcacgcgagcaagtacctgtccccgcgcaccgacggcgtggtcctgccggtgctgcacgccaacggctacaagatctcctcgcccacggtctacggctgcatggacgacgaggagctgaccgcctacttcagcggcgcgggctggtcgccgcgggtggtcgacgtgacccgcgccgacgacccggacgccctgatggccgaggcgctggaccgcgcgcacgccgagatcgccgagctgcgcgagcggtggcggccgggggagcgggcggtgcgcccgatgctggtgctgcgctccccgaagggctggggcgtgcccgagcgcgacgccgggggcgaccccctcgaaggcacgttccgcgcccaccaggtgccgctcggcgcggtccacgaggacgacgacgagctggccctgctggagcgctggctgcggtcctaccgccccgaggagctgttcgacgccgacggccgcccgcacgaggacctcctggcccagctgcccccggagcacctgcgcctcggccgcgtgccggaggccaacggcggacggctgcgccgcgacctgcccctgcccgacgtggcggacttcgccgcgcgggtccccgcgcccggcacgggctcgaccagcccgaccgaggtggcgggccgctggctggccgagctggtgcgggccaccgaggaccggcgcgacttccgcgtgctctgccccgacgagctggagtccaacaagctcggcgccctcctggaggccaccgaccggggcttcacctggccgctgccggacaccgccgagcacgtcgcgcccggcggccgggtgctggaggtgctgtccgagcacctgtgccagggctgggcgcagggctacctgctgaccggtcggcacgcgctgttcccgtgctacgaggcgttcgcctcgatcgtggacagcatggtcgaccagcacgccaagttcctcaagatctccggcgaggtgccgtggcgcgagccggtggcgagcctgaactacctgctcaccagcgaggggtggcggcaggagcacaacggctacagccaccagggccccggtttcctcaacaacctgctcaccaagaaggccgcgaccgcgcgcgtctacctgccgccggacgcgaacaccctgctggtgaccctgcgggactgcctggcctccaccgggcggatcaacctggtggtcgcgggcaagaacgcgggcgctcagtggctggacctggaggcggccgagcggcactgcgcggcgggcgcgggcgtgtgggactgggcctgccacggcgacggcgacccggacgtggtgctggcgtgcgcgggcggcgtccccaccgtggaggcgctggcggcggcggcgatcctgcgcgagcgggcccccgaggtgaccgtgcgcgtggtcaacgtggtggacctgctcgcgctggcccccgccgaccgccacccgcacggcctgcccgacgacgtcttcgccgcgtgcttcccgcaggacgtcccggtggtcttcgccttccacggctacccgtcggccgtgcgcgaggcggtgcacggccgccccggcgccgaccggttccacgtccacggctacctggaggagggcaccacgaccacgccctacgacctgctcgtggccaaccgcatgagccgccacgacctggccgccgacgcgctgcgccgggccggtcgcggcgtcgaccgcgacaccgacctggccgagcggttgctggccgagcgcgacgacctggtcgcggcggcgcaccgcgacggcgtggaccccgaggagatcgccgagtggaggtggggcgcatga

SEQ ID NO: 66 - DNA, 2475 bp, Atopobium rimae ATCC 49626
atggctcagcctgttatcggtacaccttggcaaaggctcaatcagcctgtctctgaggatgaactttccggtgtcgacaagtactggcgcacggcaaactatctttccattggccagatttatctacgcagcaaccctctcatgaaggaaggatttaaccgggaagacgtcaagcaccgactggtaggacactggggaacgacacctggcttgaatttcctgtttggccacgttaatcgctttatccacgatcacaatcagaacaccatttttcttatgggacccggtcatggcggaccggccggcacggctcagtcgctgcttgatggcacgtatcgcgaaacctatccgttcatcaccaacgatgaggcgggtctccagaagttcttccgccgtttctcttatcccggcggcattccttctcactacgcccccgaaactcccggatccatccatgagggcggcgagcttggctatacgctgtctcatgcctatggtgcggttctcgacaatccgtcgcttttggccgttgctgtagtgggcgacggtgagtctgagacaggacctcttgccaccagttggcagacgaacaagtttatggatccgcttaccgatggtattgtgttgccgattcttcacctgaacggttataagattgccaatccaaccattctttcacgcatttccgacggagagcgtgacgagttcttccgcggtatgggatatcatccctatacctttgttgccgggttcgataacgaggatcatgcgtccatccatcgccgttttgccgcacttttcgaggcggtctttgacgagatttgctccatcaaaagtcgcgccgctgcaggcgatgcgtcccgcccgtactatccgatgatcattttccgtacgcccaagggttggacgtgtccgccttatatcgatggcaagaagaccgagggctcatggcgtgcgcaccaggtgcctctggcgtctgcccgtgataccgaggctcacttccagattctgcgcgattggcttgagtcatacaggcctgaacagctctttgacgaggacggcgccattcgtcctgaggttacgtccttcatgcctgccggtgagcttcgcctgggcgccaatcccaacgccaatggcggccttcttcgccagtcgcttgacctgcccgatgctcgcgagtatgagatccccgtgggcgagaagggccacggctttggagctaccgaggcaacccgcgtacttggtgagtacacggccgatcttatcaacaagaaccgctctgacttccgcatttttggtccggacgagacggcatcaaaccgcctgcagccctctttccaagtgacggacaagcagtggtttggcggctttaacgatgactttgaaaatgacgagcacatttcgcctgtaggcaacgtcatcgaacagctttccgagcatcaatgcgaaggtctgctcgaaggctacgtgctgaccggtcgttatggtatctggtccagctacgagtcattcgtacacattgtggactccatgattaaccagcacgcaaagtggcttgaggcaacggtccgccatatcccttggcgcaaacccatctcagccgtcaacgtattgctttccagccacgtgtggcgacaggatcacaacggtttctctcaccaggatccgggctttgtcgatgttttgctcaacaagtgctacaacaatgaccacgtggtaaacatctattacccagccgacgccaatcttctgttggccgtgggcgagaaggcttacacctccactaactgcatcaacgctattttcgcaggcaagcagcccgcgccaacatgggttacccttgatgaggcgcgagaagaactcaagcgcggagccgttgagtggaaatgggcttctaatgtatctgaaggggaagactacgatatcgtccttgcatcctgcggcgacgtgcctaccatggagctccttgcagcccttgatatgctgagcaaactgggcattaaggctcgctttgtcaatgtgcttgaacttctcaagatccagaatgcggaggagaacgaccaagcgctttccgatgaggagttcaccaagctcttctcggcagataagcctgtactctttgcattccatgcgtatgcaggcaccatccatcgtttgatttggaaccgtccgaaccacgacaacttcaaggttcacggatatgaagagcagggttctacgactacgccgtatgacatgctccgcctgaaccatatggatcgctgggcgctggcagccgatgcgctgcgcatgattgatgcggacaagtggtccgagcagattgttgagtgggaacagttccgtaccgacgcatttaactttgccgtcgagaagggctacgatcacccggcgtttaccgattgggtgtggccggatgcgtcggatgccggcgaatcgctttcggcaaccaaggcaacgggcggcgacaacgagtag

SEQ ID NO: 67 - DNA, 2472 bp, Atopobium parvulum DSM 20469
atggctcagcccgtgtacggtacaccttggcagaccctgaatcagcctgtatctgaggaagaacttgccggcgtcgataggtattggcgcgcagctaattacctgtctgttggtcagatttatcttcgcagtaaccctcttatgaaggatggtttttctcgcgaggatgttaagcaccgtctggttggccactggggaaccaccccaggtctaaacttcctgttcggccacgtcaaccgtttcattcgcgaccataaccagaacaccatcttcctcatgggtcctggtcacggtggacctgcaggtactgcacagtccctgcttgacggaacttatcgtgagacctacccatttatcactgacgatgaagagggtctccagaagttcttccgccgcttctcttatcctggcggaattccttcccactatgcacctgagaccccaggttccatccacgagggcggcgagctgggttacaccttgtctcacgcatacggcgctgtcttggacaatccatccctgcttgcagttgctgttgtcggcgacggtgaggcagagaccggtccacttgcaacttcttggcagaccaacaagttcatggacccactgaccgatggtattgttcttccaatcctgcacctcaacggctacaaaattgccaacccaaccattcttgctcgtatttccgatggtgaacgcgacgagttcttccgcggcatgggctatcacccatataattttgttgctggctttgacgacgaggatcacgcatccatccaccgtcgttttgcagctctgcttgaggctgtcttcaatgagatctgcgctatcaagactcgcgcagccgcaggtgacgcatcgcgtccttactacccaatgatcatcttccgcacccctaagggttggacttgccctccttatattgatggcaagaagaccgagggctcttggcgcgcacaccaggttccactggcatcagctcgcgacactgaggctcacttccaggttcttcgtgattggatgagctcctacaatccagagaccctcttcaccgagaagggcgcaatccgtccagaggttacttccttcatgcctaagggtgacctccgtcttggcgctaaccctaacgcaaatggtggtacaatccgtcgcaacctcgttcttcctgatgcaaagaagtacgagattccagttgccgagaagggccacggctttggtgctactgaggcaacgcgcgttcttggcgagtacaccgctgagcttattaacagcaaccgttctgagttccgtatcttcggacctgatgagaccgcttctaaccgtctgcagccttccttccaggtaaccgacaagcagtggtttggtggctttaacgacgactttgagaacgacgagcatatttccccagttggtaacgttattgagcagctttccgagcaccagtgcgagggtctgcttgagggctacaccctaactggccgccacggcatttggtctagctacgagtcatttgtccacatcattgactcaatgatcaaccagcacgctaagtggcttgaggctaccgtccgccacattccatggcgcaaacctatttctgctcttaacctggttctttccagccacgtttggcgtcaggaccacaacggattctctcaccaggatcctggttttgttgacatcatgcttaacaagagcttcaacaacgaccacatcaccaacatctacttcccagcagacgctaaccttctgcttgcagttggcgagaagtgctatacctccacaaactgcatcaacgctatctttgctggtaagcagcctgctccaacgtgggtaaccctcgacgaggctcgcgaggagctttcagttggcgctaaggagtggaagtgggcttccaacgctgaggctggcgaggaggacattgtccttgcatcctgcggcgacgttcctactcaggagctccttgctgctctggacatgcttggtaagctgggcatcaaggctcgcttcgttaacgttgttgacctgctcaagattcagaacgcttccgagaacaacgaggctctttctgacgaggagttcacaaagctcttctccgcagacaagccagttctcttcgcattccacgcttacgctggttctgtccgtcgcctgatttggaaccgtccaaaccacgacaacttcaacgttcacggctacgaggagcagggttccaccacaactccttacgacatgctacgcttgaacaacatggaccgctgggcacttgctgctgacgctctccgcatgattgacgctcagaagtgggcagatcagattgacgagtgggagaagttccgcaccgaagcctttgagtttgctgtcgagaagggctatgatcacccagcatttactgattggtcttggccagacgcttccgatgctgatcagagcatctctgcaactcaggcaaccgcaggcgacaacgagtaa

SEQ ID NO: 68 - DNA, 2475 bp, Atopobium vaginae DSM 15829
atgggtcaaccggtattgggtacaccgtggcataaactcgggaagtctgtatctgaagaagaacttgaagctgttgataagtattggcgttgtgctaattacttgtctattggacaaatttatttacgcagcaaccctttgatgaagggtgattttaatcgtgacgatattaaatatcgtttggtaggccactggggaactacgccaggcttaaactttttgtttggtcacgttaatcgtcttattcacgaccacaaccaaaatacggttttcttaatgggaccaggtcacggcggacctgctggtaccgcgcagtcacttttggacggaacatacaccgaaacctatccgcgcattacaaaagacgaagcaggcttgcaaaagttcttccgtcaattctcatatccaggaggtattccttcgcactatgcgcccgaaacacctggttctattcatgagggtggagagcttggttatgtattgtcacacgcgtatggtgctgttttggacaatccatcgctattggctgtagctgtagtaggcgatggcgaatcagaaaccggtcctttggcaacaagctggcaaaccaacaagttccttgatccactaaccgacggtattgtgttgccaattttacatcttaacggctataaaattgctaacccatcaattttgtcgcgtattagtggcgaagaacgcgatgaattcttccgtggtatgggctatcacccctatgtatttacagctggttttgacgacgaagaccattcatctattcaccgtcgttttgcggcacttcttgagacggtattcgatgaaatttgcaatattaagacgcgtgctcaagcaggcgaagaggctcgtcctgcgtatcctatgatcgtgttccgcactcctaaaggatggacatgcccagcttatatagacggtaaaaagaccgagggttcttggcgcgctcatcaggtgcctttagcatctgctcgtgataccgaagctcactttgaggttttgaaaaattggatgaaatcctataaacccgaagagctttttgatgaaaacggtgcaattaaaagtgatgttgttgcagctatgcctcaaggtgatttaagacttggtgctaaccccaacgcaaatggtggtaagcttcgtcataaccttgatcttccagatgccaaagactttgctattgacgtagaaaaaggtggacatggttgcggtgctgtagaagcaacacgcgttttgggcgatttcacggccgaagttatcaacaagaaccgcgattcgttccgtatttttggacccgatgaaaccgcttcaaaccgtttgcagccgtcctatcgtgtaaccgataaacaatggtttggcgaaataaacgctgatcctcaaaatgatgagcacatggctcctgttggaaacgttatcgagcagctttctgagcaccaatgcgaaggactgttagagggctatgtgttaactggtcgtaatggtatttggtcgagctacgaatcatttgtacacgtcgtagactccatgattaaccagcactgcaagtggctggaagcatgcgttcgccatattccttggcgtcgtcctatctcgggaattaaccttttgatttcaagccacgtttggcgtcaggatcacaatggattctcgcaccaagatcctggttttgtggacattatgcttaacaagagctttaacaatgaccacgtaaccaatatctacttcccagctgacgcaaatcttttgttggctgttgccgagcgtgcatttacatcaaccaactgctttaatgctatctttgctggtaaacaacctgctcctacctgggttacgcttgacgacgcgcgtgaagagcttaaacgcggtgttgttgagtggaaatgggcgtctaccgtacaaaagggagaagagcctgatcttgttattgcgtcgtgcggcgacgtacctacgcaagaagcgcttgccgccgttgagttgcttgataagttgggcgttcatgttcgttttgtaaacgttgttgatctccttaagattcaaaatgctcaagaaaacgatcaagcaatttctgacgaggaatttgtcaaactcttctctgctgataagcccgttttgtttgcgttccacgcatatgctggtagcattcgtcgtttgatttggaatcgtccaaatcacgataacttctgtgttcacggatacgaagagcaaggttctaccacaacgccatatgatatggttcgtcaaaatcatatggatcgctgggctttggctcaagacgctttacgcttggttgacgcagataagtggaaggatcagattgacgcttgggagaagttccgtgctgatgcgttccagtttgcggtcgataagggctatgaccaccctgcctttaccgattggagatggcacgacgcaaaggactctgccgaggttttgtctgcaactaaagcaacgggcggagataacgagtaa

SEQ ID NO: 69 - DNA, 2520 bp, Collinsella stercoris DSM 13279
atgacgcagcccgtgattggcactccgtggaccaaactcgagaacccagtgagcgcagatgctctcgccgccgtggataagtactggcgttgcgctaactacctgtcagttggacagatctacctgcgctccaacccgctgatgcgcgaggactggaccgatgccaagacgggtaagaagcgcgactttggccgtgtggacgtcaagcaccgcctggtgggccattggggcaccacgccgggcatcaactttttgttcgggcacgtgaaccacctaatcgccgaccatggccaaagcacgatcttcctcatgggccccggccacggtggtcctgccggaacggcacagtctctactcgacgggacgtaccgcgagatccgtcccgacatcacggatgacgaggctggccttgagaagttcttccgccagttctcctacccaggtggcatcccgagccacttcgcgcccgagaccccgggctccattcacgagggcggcgagctgggctataccctcagccacgcatacggtgccgtgatggacaacccgagtctgctggctgtggccgtggtgggcgacggtgaggccgagaccgcggcgctcgccacctcctggcagtccaacaagctagtcaaccccaagaccgacggcatcgtcctgccgattctgcacctcaacggctacaagatcgcaaaccccaccatcctggcgcgcatctcggacgaggagcttaccaagttcttcgagggaatgggctacaagccgcacttctttgtggcgggcttcgacaacgagtcgcacgcctccatccacgcgcgtttcgccgcgcagctcgaggtggtcttcggcgagatctgcgatatcaaagcaaatgccgagctgggtgacgagacgcgtcccgtgtaccccatgatcgtgttccgcacgcccaaggggtggacgtgtcccaagcatatcgacggtaagaagaccgaggactcctggcgcgcgcatcaggtgccgctggccgatgcccgcgacacccacgagcacttccgcgtgctccgttcctggcttcgctcgtacggccccgaggagctcttcacctcggaaggccaggttcgcgaggatgtgaccgccttcatgcccaagggcgacttgcgcatcggcgccaaccccaacgcgaacggcgggaaaatccgccgtgagcttgagctgcccgatatccatgcccatgaggtccccgtggcggagaagggacacgggtggggcgccaccgaggcggcacgcgtgtttggcgcctacaccgccgatgtccttgccaaaaacgacaacttccgcatcttcggccccgacgagaccgcgtccaaccgtctgcaggactgctatgccgcgacgagcaagcagtggctcgccggtcactacgccgacgccgacaacgatgacctgctcgccccgagcggccgagtaatcgagcagctctccgagcaccagtgcgagggctttctcgaggcgtacgtgctcaccggccgtcatggcgtgtggtcgagctacgagagcttcgtgcacgtcgtcgactccatggtgaatcagcactgcaagtggctcgaggcgactaagcgcgagattccgtggcgcgctcccatctccggtctgaacatcctgctttcaagccacgtgtggcgccaggaccacaacggcttctctcaccaggatccgggcttcatcgacgtcctgctcaacaaggcaaacgacactcacgtcgtgaacgcatactatccgtgcgacgccaacatggcgcttgcggttgcggagcgcgtgtaccagtcgacggactgcgtgaacgcgattttctgcggcaagcagcccgcgccgacgttcgtgacggtggacgacgcccgtgccgagctcgccgaggggctggccgcatgggagtgggcgagcaccgcttcgagcctcgaagaagccgacctggtgatcgccacgtgtggtgacgtccccacgctcgaggcgctcgccgccgtggacctgctgcgcgagcatggcgtcaaggtgtggttcgtgaacgtggtcgacctgctcaagattcagaacgcctgcgagaacgaccaggcgatctccgatgagcgcttcgccgagttcttcggtgcgggcgacaagccggtcctcttctgcttccatgcctatgccggcacgatccgtcgcctggtgtgggcgcgccccggtcatgacgcctggtgtgtccacggctatgaggagaagggttccaccaccaccccgttcgacatgctgcgcctgaacaacatggatcgctgggcgctcgctgccgaggctttgcgtctggtggactccgcgagctgcgatccggcgcacgccgggcagatcgaggcctgggaggcgttccgtctcgaggcgttcgagtttgccgtcgaggagggctacgatcatcccgcgttcaccgattgggtttggcccgatgccgcgtccaatatggagagtgcgctgagcgccacgcagatgacggcaggcgataacgagtag

SEQ ID NO: 70 - DNA, 2478 bp, Bifidobacterium longum
  misc_feature (1725)..(1725): n is a, c, g, or t
atgacgagtcctgttattggcaccccttggaagaagctcaacgctccggtttccgaggaagccctcgaaggcgttgacaagtactggcgcgttgccaactacctttccatcggccagatttatctgcgttccaacccgctgatgaaggagcccttcacccgcgaagatgtgaagcaccgtctggtgggccactggggcactacccctggcctgaacttcctcatcggccacatcaaccgtttcattgctgaccacggccagaacaccgtgatcatcatgggcccgggccacggtggcccggccggtacctcccagtcctacctggacggcacctacaccgagaccttcccgaagatcaccaaggacgaagctggtctgcagaagttcttccgtcagttctcttacccgggcggcattccgtcccacttcgctccggagaccccgggctccatccacgagggtggtgagctgggttacgctctgtcccacgcttacggcgccatcatggacaacccgagcctgtttgtcccggccatcgtcggcgacggcgaggctgagaccggcccgctggctaccggctggcagtccaacaagctcgtgaacccgcgcaccgacggtatcgtgctgccgatcctgcacctcaacggctacaagatcgccaacccgaccatcctgtcccgcatctccgacgaagagctccacgagttcttccacggcatgggttacgagccctacgagttcgtcgctggcttcgatgatgaggaccacatgtccatccaccgtcgcttcgccgagctgtgggagaccatctgggacgagatctgcgacatcaaggccaccgctcagaccgacaacgtgcaccgtccgttctacccgatgctgatcttccgcaccccgaagggctggacctgcccgaagtacatcgacggcaagaagaccgagggctcctggcgttcccaccaggtgccgctggcttccgcccgcgacaccgaggcccacttcgaggttctcaagaactggctcgagtcctacaagccggaagagctgttcgacgccaacggtgctgtcaaggacgacgtccttgccttcatgccgaagggcgagctgcgtatcggtgccaacccgaacgccaacggtggtgtgatccgcaacgacctgaagctgccgaacctcgaggactacgaggtcaaggaagtggctgagtacggccacggctggggccagctcgaggccacccgtaccctgggtgcctacactcgcgacatcatcaagaacaacccgcgcgacttccgcatcttcggaccggatgagaccgcttccaaccgtctgcaggcttcctacgaagtcaccaacaagcagtgggatgccggctacatctccgacgaggtcgacgagcacatgcacgtctccggccaggtcgttgagcagctgtccgagcaccagatggaaggcttcctcgaggcctacctgctgaccggtcgtcacggcatctggagctcctacgagtccttcgtccacgtgatcgactccatgctgaaccagcacgccaagtggcttgaggctaccgtccgcgagattccgtggcgcaagccgatcgcctccatgaacctgctggtctcctcccatgtttggcgtcaggaccacaacggcttctcccaccaggatccgggtgtcacctccgtcctgctgaacaagtgcttccacaacgaccacgtcatcggcatntacttcgccaccgatgcgaacatgctgctggccatcgccgagaagtgctacaagtccaccaacaagatcaacgccatcatcgctggtaagcagcctgctgccacctggctgaccctggacgaggctcgtgccgagctcgagaagggtgccgccgcttgggattgggcttccaccgccaagaacaacgatgaggccgaggtcgtgcttgccgccgccggcgatgtcccgactcaggagatcatggctgcttccgacaagctgaaggaactgggcgtcaagttcaaggttgtgaacgttgccgacctgctctccctgcagtccgccaaggagaacgacgaggctctgaccgacgaggagttcgccgacatcttcaccgccgacaagccggtgctgttcgcgtaccactcctacgctcacgacgtgcgtggcctgatctacgaccgtccgaaccacgacaacttcaacgtccacggctacgaggaggagggctccaccaccaccccgtacgacatggttcgtgtcaaccgcatcgaccgctacgagctgaccgctgaggctctgcgcatgatcgacgccgacaagtacgccgacaagatcgacgagctcgagaagttccgtgatgaggccttccagttcgccgtcgacaacggctacgaccacccggactacaccgactgggtgtactccggcgtgaacaccgacaagaagggtgccgtcaccgctaccgccgctaccgctggcgacaacgagtga

SEQ ID NO: 71 - DNA, 2586 bp, Bifidobacterium breve DSM 20213
atgacgattgattgggaacgggaatccttggcgccgcaaggaaccaaggcccgcgacctaacggaaataatcaatcgcacgatcacgtgcaggagtacaggagtacacatgacgagtcctgttattggcaccccttggaagaagctcaacgctccggtttccgaggagtccctcgaaggcgttgacaagtactggcgcgttgccaactacctttccatcggccagatttatctgcgttccaacccgctgatgaaggctcccttcacccgcgaagatgtgaagcaccgtctggtcggccactggggcactacccctggcctgaacttcctcatcggccacatcaaccgcttcatcgctgaccacggccagaacaccgtgatcatcatgggcccgggccacggtggcccggctggtacctcccagtcctacctggacggcacctataccgagaccttcccgaagattaccaaggatgaggctggtctgcagaagttcttccgtcagttctcctacccgggcggtatcccgtcccacttcgctccggagaccccgggctccatccacgagggtggtgagctgggctacgctctgtctcacgcttacggcgccatcatggacaacccgagcctgttcgtcccggccatcgtcggcgacggcgaagctgagaccggcccgctggctaccggctggcagtccaacaagctcgtgaacccgcgcaccgacggtatcgtgctgccgatcctgcacctcaacggctacaagatcgccaacccgaccatcctgtcccgcatctccgacgaagagctccacgagttcttccacggcatgggttacgagccctacgagttcgtcgctggcttcgacgatgaagatcacatgtccatccaccgccgcttcgccgagctgtgggagaccatctgggacgagatctgcgacatcaaggccgccgctcagaccgacaacgtgcaccgtccgttctacccgatgctgatcttccgcaccccgaagggttggacctgcccgaagtacatcgacggcaagaagaccgagggctcctggcgcgctcaccaggtgccgttggcttccgcccgcgacaccgaggcccacttcgaggtcctcaagaactggctcgagtcctacaagccggaagagctgttcgacgccaacggcgctgtcaaggacgacgtccttgccttcatgccgaagggtgagctgcgtatcggtgccaacccgaacgccaacggtggtgtgattcgcgacgacctgaagctgccgaacctcgaggactacgaggtcaaggaagtggctgagtacggccacggctggggccagctcgaggccacccgtaccctgggtgcctacactcgtgacatcatccgcaacaacccgcgcgacttccgtatcttcggaccggatgagaccgcttccaaccgtctgcaggcttcctacgaggtcaccaacaagcagtgggatgctggctacatctccgatgaggtcgacgagcacatgcacgtctccggccaggtcgtcgagcagctgtccgagcaccagatggaaggcttcctcgaggcctacctgctgaccggtcgtcacggtatctggagctcctacgagtccttcgtccacgtgatcgactccatgctcaaccagcacgccaagtggcttgaggctaccgtccgcgagattccgtggcgcaagccgatcgcctccatgaacctgctggtctcctcccacgtttggcgtcaggaccacaacggcttctcccaccaggacccgggtgtcacctccgtcctgctgaacaagtgcttccacaacgaccacgtcatcggcatctacttcgccaccgatgcgaacatgctgctggccatcgccgagaagtgctacaagtccaccaacaagatcaacgccatcatcgccggcaagcagcccgctgccacctggctgaccctggacgaggctcgtgccgagctcgccaagggtgccgccgcttgggattgggcttccaccgccaagaacaacgatgaggccgaggtcgtgctcgccgccgctggcgacgtcccgacccaggagatcatggctgcttctgacaagctgaaggaactgggcgtcaagttcaaggttgtgaacgttgccgacctgctctctctgcagtctgccaaggagaacgacgaggctctgagcgacgaggagttcgctgacatcttcaccgccgacaagccggtgctgttcgcataccactcctacgctcacgacgtgcgcggtctgatctacgatcgtccgaaccacgacaacttcaacgtccacggctacgaggaggagggctccaccaccaccccgtacgacatggttcgcgtcaaccgcatcgaccgctacgagctgaccgccgagactctgcgcatgatcgacgccgacaagtacgccgacaagatcgacgagctcgagaagttccgtgacgaggccttccagttcgccgtcgacaagggctacgaccacccggactacaccgactgggtgtactccggcgtgaacaccgacaagaagggcgccgtcaccgccactgccgccaccgctggcgacaacgagtga

SEQ ID NO: 72 - DNA, 2406 bp, Bifidobacterium bifidum NCIMB 41171
gtggacaagtactggcgcgttgccaactacctttccatcggccagatctatctgcggagcaacccgctgatgaaggaacccttcacccgtgaagacgtgaagcaccgtctggtggggcactggggcaccacccctggcctgaacttcctcatcggccacatcaaccgcttcatcgctgaccacggccagaacaccgtgttcatcatgggcccgggccacggtggccccgccggtacctcccagtcctacctggacggcacctacaccgagacgtaccccaacattaccaaggatgaggctggcctgcagaagttcttccgccagttctcctacccgggcggcatcccctcccacttcgctccggaaaccccgggctccatccacgagggtggcgagctgggttacgccctgtcccacgcttatggcgcgatcatggacaacccgagcctgttcgttccctgcatcgtcggcgatggtgaggccgagaccggcccgctggccaccggctggcagtccaacaagctcgtgaacccgcgcaccgacggtatcgtgctgccgatcctgcaccttaacggctacaagatcgccaacccgaccatcctgtcgcgcatctccgacgaagagctccacgagttcttccacggcatgggctacgagccctatgagttcgtcgccggcttcgacgatgaggaccacatgtccatccaccgtcgcttcgccgagctgttcgagtccgtgtgggacgagatctgcgacatcaaggccgcggcgaacacggacaacatgcaccgtccgttctacccgatgatcatcttccgcaccccgaagggctggacctgcccgaagtacatcgacggcaagaagaccgagggctcctggcgcgcccaccaggtgccgctggcttccgcccgcgacaccgaggcccacttcgaggtcctcaagaactggctggagtcctacaagccggaagagctgttcgacgccaacggtgccgtcaaggacgacgtcctggccttcatgccgaagggcgagctgcgcatcggcgccaacccgaacgccaacggtggcgtgatccgcagggatctcgtgctgccggcgctcgaggactacgaggtcaaggaagtcaaggagttcggacacggctggggccagctcgaggccacccgtcgtctgggcgtctacacccgcgacatcatcaagaacaacatgcacgacttccgcatcttcggaccggatgagaccgcttccaaccgtctgcaggcttcctacgaggtcaccaacaagcagtgggacgccggctacatctccgacgaggttgacgagcacatgcacgtctccggccaggtcgtcgagcagctgtccgagcaccagatggaaggcttcctcgaggcctacctgctgaccggccgtcacggcatctggagctcctacgagtcctttgtgcacgtgatcgactccatgctgaaccagcacgccaagtggcttgaggctaccgtccgcgagattccgtggcgcaagccgattgcctccatgaacctgctggtctcctcgcacgtgtggcgtcaggatcacaacggtttctcgcaccaggacccgggtgtcacctccgtcctgctgaacaagtgcttccacaacgatcacgtcatcggcatctacttcgcgaccgacgcgaacatgctgctggccatcgccgagaagtgctacaagtccaccaacaagatcaacgccatcatcgccggcaagcagccggccgccacctggctgaccctggacgaggctcgtgccgagctcgccaagggtgccgccgcttgggattgggcttccaccgcgaagaccaacgatgaggctcaggtcgtgctcgccgccgccggcgacgtcccgacccaggagatcatggccgcttccgacaagttgaaggccctgggcatcaagttcaaggtcgtcaacgtggctgatctgctctccctgcagtctgccaaggagaacgacgaagcgctgaccgacgaggagttcgccgacatcttcaccgccgacaagccggtgctgttcgcgtaccactcctacgcccacgacgtgcgtggcctgatctacgatcgcccgaaccacgataacttcaacgtccacggctacgaggaggagggctccaccaccaccccgtacgacatggttcgcgtgaacgagctggatcgctacgagctgaccgccgaagccctgcgcatgatcgacgccgacaagtacgccgacgagatccagaagctggaggacttccgtcaggaagcgttccagttcgcggtcgacaagggctacgaccacccggactacaccgactgggtgtactcgggcgtcaagaccgacaagaagggcgccgtcaccgccaccgccgccaccgctggcgacaacgagtga

SEQ ID NO: 73 - DNA, 2478 bp, Bifidobacterium angulatum DSM 20098
atgacgaatcctgttattggcaccccttggaagaagctcgacgctcccgtttctgaggaagcccttgaaggcgttgacaagtactggcgtactgctaactacctgtccatcggccagatctaccttcgcagcaacccgctgatgaaggctccgttcacccgcgaagatgtcaagcatcgtctcgtgggccactggggcaccacccctggcctgaacttcctcatcggccacatcaaccgcttcatcgctgatcaccagcagaacaccgtgatcatcatgggcccgggccacggcggcccggccggtaccgctcagtcctacctggacggcacctacaccgagactttcccgaagatcaccaaggatgaagctggcctgcagaagttcttccgccagttctcctacccgggcggcatcccgtcccactacgctccggagaccccgggctccatccacgagggtggcgagctgggttacgctctgtcccacgcttacggcgctgtgatgaacaacccgtccctcttcgtcccggccatcgtcggcgacggcgaagctgagaccggcccgctggctaccggctggcagtccaacaagctcatcaacccgcgcaccgacggtatcgtgctgccgatcctgcacctcaacggctacaagatcgccaacccgaccatcctgtcccgcatctccgacgaagagctgcacgagttcttccacggcatgggttacgagccgtacgagttcgtcgctggcttcgacgatgaggaccacatgtccatccaccgtcgtttcgccgagctcttcgagtccatcttcgacgagatctgcgagatcaaggccaccgctcagaccgacgatgtgcatcgtccgttctacccgatgatcatcttccgcaccccgaagggctggacctgcccgaagttcatcgacggcaagaagaccgagggttcctggcgttcccaccaggtgccgctggcttccgcccgcgataccgaggctcacttcgaggtcctcaagaactggctcgagtcctacaagccggaagagctgttcgacgagaacggtgctgtgaaggctgacgtcaccgccttcatgccggaaggcgagctgcgcatcggcgccaacccgaacgccaacggtggtgtgatccgcaaggacctcaagctcccgaagctcgaggactacgaggtcaaggaagtccaggagtacggccacggctggggccagctggaagctacccgccgcctgggcgtctacacccgcgacatcatcaagaacaacccggacgacttccgtatcttcggaccggacgagaccgcttccaaccgtctgcaggccgcttacgaagtgaccaacaagcagtgggacgccggctacctgtccgagcaggtcgatgagcacatggctgtcaccggccaggtcaccgagcagctgtccgagcaccagatggaaggcttcctcgagggctacctgctgaccggtcgtcacggcatctggagctcctacgagtccttcgtccacgtgatcgactccatgctgaaccagcacgccaagtggctggaggctactgtccgcgagatcccgtggcgtaagccgatctcctccatgaacctgcttgtgtcctcccacgtgtggcgtcaggatcacaacggcttctcccaccaggatccgggtgtcacctccgtcctgctgaacaagtgcttcaacaacgaccacgtgatcggcatctacttcccggtggattccaacatgctgctggccgtcgccgagaagtgctacaagtccaccaacaagatcaacgccatcatcgccggcaagcagccggccgccacctggctgaccctggacgaggctcgcgccgagctcgagaagggtgctgccgagtgggagtgggcttccaccgcgaagtccaacgacgaggctcagatcgtgctcgccgccaccggtgatgttccgactcaggaaatcatggccgctgccgacaagctggacgccatgggcatcaagttcaaggtcgtcaacgttgtggatctggtcaagctgcagtccgccaaggagaacaacgaggccctctccgacgaggagttcgctgagctgttcaccgaggacaagccggtcctgttcgcttaccactcctacgctcgcgacgtgcgtggtctgatctacgatcgcccgaaccacgacaacttcaacgtccacggctacgaggagcagggctccaccaccaccccgtacgacatggtgcgcgtcaacaacatcgatcgctacgagctcgttgccgaagctctgcgcatgatcgacgctgacaagtacgccgacaagatcaacgagctcgaggccttccgtaccgaagccttccagttcgctgtcgacaacggctacgatcacccggattacaccgattgggtctactccggcgtgaacaccaacaagcagggtgctgtctccgctaccgccgcaaccgctggcgataacgagtga

SEQ ID NO: 74 - DNA, 2478 bp, Bifidobacterium catenulatum DSM 16992
atgacgagtcctgttattggcaccccttggaagaagctgaacgctccggtttccgaggaagctatcgaaggcgtggataagtactggcgtgcagccaactacctctccatcggccagatctatctgcgtagcaacccgctgatgaaggagcctttcacccgcgaagacgtcaagcaccgtctggtcggccactggggcaccaccccgggcctgaacttcctcatcggccacatcaaccgtctcatcgctgatcaccagcagaacactgtgatcatcatgggcccgggccacggcggcccggctggtaccgctcagtcctacctggacggcacctacactgagaccttcccgaagattacgaaggacgaagctggtctgcagaagttcttccgccagttctcctacccgggcggcatcccgtcccactacgctccggagactccgggctccatccacgaaggtggcgagctgggttacgccctgtctcatgcctacggcgctgtgatgaacaacccgagcctgttcgttccggccatcgtcggcgacggcgaagctgagaccggcccgctggctaccggctggcagtccaacaagctcgtcaacccgcgcaccgacggtatcgtgctgccgatcctgcacctcaacggctacaagatcgccaacccgaccatcctgtcccgcatctccgacgaagagctccacgagttcttccacggcatgggctatgagccgtacgagttcgtcgctggcttcgacaacgaggatcacctgtcgatccaccgtcgtttcgccgagctgttcgagaccgtcttcgacgagatctgcgacatcaaggccgcagctcagaccgacgacatgactcgtccgttctacccgatgatcatcttccgcaccccgaagggctggacctgcccgaagttcatcgacggcaagaagaccgaaggctcctggcgttcccaccaggtgccgctggcttccgcccgcgataccgaggctcatttcgaagtcctcaagaactggctcgagtcctacaatccggaagagctgttcgacgagaacggtgctgtgaagccggaagtcaccgccttcatgccgactggcgaactgcgtatcggtgccaacccgaacgctaacggtggtgtgatccgcgaagagctgaacctgccggccctcgaagactacgaggtcaaggaagtcgctgagtacggccacggctggggccagctcgaagcaacccgtcgtctgggcgtctacacccgcgacatcatcaagaacaacccggactccttccgcatcttcggaccggacgagaccgcttccaaccgtctgcaggccgcttacgacgtcaccaacaagcagtgggacgccggctacctgtcctcccaggttgacgagcacatggctgtcaccggccaggtcaccgagcagctctccgagcaccagatggaaggcttcctcgaggcctacctgctcaccggtcgtcacggcatctggagctcctacgagtccttcgtgcacgtgatcgactccatgctgaaccagcacgccaagtggctcgaggctaccgtccgcgagatcccgtggcgcaagccgatctcctccatgaacctgctcgtttcctcccacgtgtggcgtcaggatcacaacggcttctctcaccaggatccgggtgtcacctccgtcctgctgaacaagtgcttcaacaacgatcacgtgatcggcatctacttcccggtggattccaacatgctgctcgctgtggctgagaagtgctacaagtccaccaacatgatcaacgcaatcatcgctggtaagcagccggccgctacttggctgaccctggacgaagctcgcgctgagctcgagaagggtgctgctgagtgggagtgggcttccaccgccaagtccaacgacgaagcccagatcgttctcgcctccgctggcgacgttccggctcaggagatcatggctgctgccgacaagctcaacgagctcggcatcaagttcaaggtcgtcaacgttgtggatctggtcaagctgcagtccaccaaggagaacgatcaggctatctccgacgctgacttcgctgagctgttcaccgaagacaagccggtcctgttcgcttaccactcctacgcccgcgacgtgcgtggtctgatctacgatcgcccgaaccacgacaacttcaacgtccacggctacgaggagcagggctccaccaccaccccgtacgacatggttcgcgtgaacaacatcgaccgttatgagctcgttgccgaagctctgcgcatgatcgatgctgacaagtacgccgagaagatcgacgagctcgaagccttccgtcaggaagccttccagttcgcagtcgacaatggctacgatcacccggattacaccgactgggtctactccggtgtcaacaccaccaagcagggtgctgtctccgctaccgccgcaaccgctggcgataacgagtga

SEQ ID NO: 75 - DNA, 2478 bp, Bifidobacterium sp. CFAR 172
atgacgaatcctgttattggcaccccttggaagaagctcgacgctccggtttccgaggaagccctcgaaggtgttgacaagtactggcgcaccgccaactacctgtccatcggccagatttatcttcgcagcaaccctctgatgaaggagccgttcacccgcgaagacgtgaagcatcgtctcgtcggtcactggggcaccaccccgggcctgaacttcctcatcggccacatcaaccgtcccatcgccgatcaccagcagaacaccgtgatcatcatgggcccgggccacggcggcccggccggcaccgctcagtcctacctggacggcacctacaccgagtatttcccgaacatcaccaaggatgaggctggcctgcagaagttcttccgccagttctcctacccgggcggcatcccgtcccactacgctccggagacgccgggctccatccacgagggtggcgagcttggttacgctctgtcccacgcttacggcgctgtgatgaacaacccgagcctgttcgtgccggccatcgtcggcgacggcgaagccgagaccggcccgctggccaccggctggcagtccaacaagctcatcaacccgcgcaccgatggtatcgtgctgccgatcctgcacctcaacggctacaagatcgccaacccgaccatcctctcccgcatctccgacgaagagctgcacgagttcttccacggcatgggctatgagccgtacgagttcgtcgccggcttcgacgatgaggaccacatgtccatccaccgtcgcttcgccgacctgttcgagtccgtcttcgacgagatctgcgacatcaaggccgcggctcagaccgacgacatgacccgtccgttctacccgatgatcatcttccgcaccccgaagggctggacctgcccgaagttcatcgacggcaagaagaccgagggctcttggcgcgctcaccaggtgccgctggcttccgctcgcgataccgaagagcacttccaggtgctcaagaactggctcgagtcctacaagccggaagagctgttcgacgacaagggcgctgtgcgtccggaagtcaccgccttcatgccgaagggcgagctgcgcatcggccagaacccgaacgccaacggcggccgcatccgcgaggagctcaacctgccgaagctcgaggactacgaggtcaaggaagtctccgagtacggccacggctggggccagctcgaggccacccgtcgtctcggtgtctactgccgcgacatcatcaagaacaacccggattcgttccgcatcttcggaccggacgagaccgcttccaaccgtcttgctgccgcttacgaagtgaccaacaagcagtgggatgccggctacctgtccgctcaggttgatgagcacatggccgtcaccggccaggtcaccgagcagctttccgagcaccagatggaaggcttcctcgagggctacctgctcaccggccgtcacggcatctggagctcctacgagtccttcgtgcacgtgatcgactccatgctgaaccagcacgccaagtggctcgaggcaacggttcgtgagattccgtggcgcaagccgatctcctccatgaacctgctggtctcctcccacgtgtggcgtcaggatcacaacggcttctcccatcaggatccgggtgtgacctccgtgctgctgaacaagtgcttcaacaacgaccacgtgatcggcatctacttcccggttgattccaacatgctgctggccgtcgctgagaagtgcttcaagtccaccaacatgatcaacgcgatcatcgccggcaagcagccggccgccacctggctgtccctcgacgaggctcgtgccgagctcgagaagggtgctgccgagtggaagtgggcttccaacgtcaagtccaacgacgaggccgacatcgtcctcgcttccgtcggcgacgttccgacccaggagatcatggctgctgccgacaagctcaacaagctcggcatcaagttcaaggtcgtcaacgtggtggatctgatcaagctccagtccgccaaggagaacaacgaagcgctcaccgatgaggagttcgctgacctgttcaccaccgacaagccggtcctgttcgcttaccactcctatgcccgcgacgtgcgcggcctgatctacgatcgcccgaaccacgacaacttcaacgttcacggctacgaagagcagggctccaccaccacgccgtacgacatggtgcgcgtcaacaacatcgaccgctacgagctgaccgctgaggctctgcgcatggttgatgccgacaagtacgctgctgagatcgacaagctggaggcattccgcgacgaagccttccagttcgcggtcgacaagggctacgatcatccggattacaccgactgggtgtggccgggcgtgaacaccgccaagcagggcgccgtcaccgccaccgccgcaaccgctggcgacaacgagtga

SEQ ID NO: 76 - DNA, 2478 bp, Bifidobacterium pullorum ATCC 49618
atgacgagtcctgttattggcaccccttggaagaagcttgacgctccggtttctgaggaggctctcgaaggcgtcgacaagtactggcgcgcttcgaactatctgtccatcggccagatttatctgcgcagcaacccgctgatgaaggaaccgttcactcgcaatgatgtgaagcaccgtctggtgggtcactggggcaccacccctggcctgaacttcctcatcggccacatcaaccgactcatcgccgatcaccagcagaacaccgtgatcatcatgggtccgggccacggcggccccgccggcacctcgcagtcctacctggacggcacctacacggagtacttcccgaacatcaccaaggatgaggctggcctgcagaagttcttccgtcagttctcctacccgggcggcattccgtcccactacgcgccggagaccccgggctcgatccacgagggtggcgagctgggctacgccctgtcgcacgcctacggcgccgtgatgaacaacccgagcctgttcgtgccggccatcgtcggcgacggcgaggccgagaccggcccgttggccaccggttggcagtccaacaagctcatcaacccgcgcaccgacggcatcgtcctgccgatcctgcacctcaacggctacaagatcgccaacccgacgatcctggcccgcatctccgacgaagagctgcacgagttcttccacggcatgggctaccagccgtacgagttcgtcgccggcttcgacgatgaggatcacatgtcgatccaccgccgcttcgccgacctgttcgagaccgtcttcgacgagatctgcgacatcaaggccgcggcccagaccgacgacatgacccgtccgttctacccgatgatcatcttccgcaccccgaagggctggacctgcccgaagtacatcgacggcaagaagaccgagggttcgtggcgctcccaccaggtgccgctggcttccgcccgcgataccgaggagcacttccaggtgctcaagaactggctcgagtcctacaagccggaggagctgttcgacgagaacggcgccgtcaagcccgaggtcaccgcgttcatgccgaccggcgaactgcgcatcggcgagaacccgaacgccaacggcggccgcatccgtgaggatctggtcctcccgccgctggacaactacgaggtcaaggaagtcgccaagttcggccatggctggggccagctcgaggccacccgtcgcctcggtgtctacacccgcgacatcatcaagctgaacccggattcgttccgcatcttcggaccggacgagaccgcgtccaaccgtctgcaggccgcctacgaggtgaccaacaagcagtgggatgccggctacctgtccgagctgaccgacgagcacatggccgtcaccggccaggtcaccgagcagctttccgagcatcagatggaaggcttcatcgagggctacctgctcaccggtcgtcacggcatctggagctcctacgagtccttcgtgcacgtgatcgactccatgctgaaccagcacgcgaagtggctggaggccaccgtccgtgagatcccgtggcgcaagccgatctcctcgatgaacctcctggtctcctcgcacgtctggcgtcaggatcacaacggcttctcgcaccaggatccgggtgtcacctccgtcctgctgaacaagacgttcaacaacgaccatgtggtgaacatctacttcccgtgcgactccaacatgctgctggccgtcgccgagaagtgctacaagtccaccaaccagatcaacgcgatcatcgccggcaagcagccggccgccacctggatgaccctggacgaggctcgtgccgagctcgagaagggtgccgccgagtggaagtgggcctccaccgccgcttcgaacgacgaggctcagatcgtgctggcctgcgccggcgatgtcccgacccaggagatcatggccgccgccgacaagctgaacgagatgggcatcaagttcaaggtcgtcaacgtggtggatctgatcaagctgcagtccgccaaggagaacgacgaggctctgaccgacgaggagttcgctgagatcttcaccgccgacaagccggtcctgttcgcctaccactcctatgcgcacgacgtgcgtggcctgatcttcgaccgtccgaaccacgataacttcaacgttcacggctacaaggagcagggctcgaccaccacgccgttcgatatggtccgcgtcaacgacatcgatcgctacgagctcgtcgccgaggctctgcgcatgatcgacgccgacaagtacgccgacaagatcgacgagctcgaggccttccgcaccgaagccttccagttcgcggtcgacaacggctacgatcatccggactacaccgactgggtgtactcggatgtcaagaccgacgtgcagggtgccgtcaccgccaccgccgccaccgctggcgacaacgagtga

SEQ ID NO: 77 - DNA, 2478 bp, Gardnerella vaginalis ATCC 14019
atgacgagtcctgttattggcaccccttggaagaagctaaatgctccagtttctgaggcggccatcgaaggcgtagacaagtattggcgcgtagcaaactatctcgcaatcggtcagatttatcttcgcagcaaccctctaatgaaggagccatttactcgcgaagatgttaagcatcgtctggtaggtcactggggcactactccaggccttaacttccttattggacacatcaaccgctttatcgctgatcaccagcagaatactgtaatcatcatgggtccaggccacggcggcccagctggtactgctcagtcctacctcgacggcacatacactgaatattatccaaagatcactaaggacgaagctggcttacagaagttcttccgtcagttctcttacccaggcggtattccttctcacttcgctcctgaaaccccaggttccatccacgaaggtggtgagcttggttatgcactttctcacgcttacggcgctgttatgaacaacccaagcttgttcgttccagcaatcgtcggcgatggcgaagctgaaactggtcctttggccactggttggcagtccaacaagcttgtgaacccacgtaccgacggtatcgtgcttccaatcttgcacttgaacggttataagattgctaacccaactattctttcccgtatttctgacgaagagcttcatgagttcttccacggcatgggttacgaaccatacgagttcgttgctggcttcgacgatgaggatcatctttccatccaccgtcgcttcgctgacatgttcgaaaccatcttcgatgagatttgcgatattaaggctgaagctcagactaacgatgtaactcgtccttactacccaatgatcatcttccgcactccaaagggttggacctgcccgaagttcatcgacggcaagaagaccgaaggctcttggcgtgcacaccaggtgccactggcatctgctcgcgataccgaagctcacttcgaggttttgaagaactggatgaagtcctacaagcctgaagagctcttcgacgaaaagggtgctgttaaggaagacgttctttccttcatgccaaagggcgaactccgtattggtgaaaatccaaacgccaacggtggtcgtattcgtgaagatttgaagcttccaaagcttgaggattacgaagtcaaggaagttaaggaattcggtcacggctggggtcagctcgaagctacccgtcgtcttggcgtttacactcgcgacatcatcaagaacaacccagattccttccgtatcttcggcccagatgagaccgcttccaaccgtttgcaggctgcttacgaagtaaccaacaagcagtgggatgctggctacctttctggcttagtcgatgagcacatggctgttaccggccaggtcaccgaacagctttccgagcaccagatggaaggcttcctcgagggctacttgctcactggtcgtcacggcatctggagctcttatgagtccttcgtacacgtcatcgattccatgttgaaccagcacgcaaagtggcttgaggctaccgttcgtgagatcccatggcgtaagccaatctcctctgtgaacttgttggtatcctctcacgtatggcgtcaggatcacaacggcttctcgcaccaggatccaggcgtaacctccgtgctcttgaacaagaccttcaacaacgatcacgtaatcggcatctacttcccagtagattccaacatgttgcttgctgttgctgaaaaggcttacaagtccaccaacatgattaacgccatcttcgctggtaagcagccagctgctacttggttgactctcgacgaagctcgcgaagagctcgagaagggtgctgctgagtggaagtgggcttccaacgctaagaacaatgacgaagttcaggttgttctcgctggtgttggtgatgttccacagcaggaattgatggcagctgccgacaagttgaacaagcttggcgttaagttcaaggttgttaacgttgttgacttgctcaagttgcagtccgctaaggaaaacaacgaagctttgactgacgaagagttcactgatctcttcactgctgacaagccagtcctcttcgcttatcactcctacgcacatgacgttcgcggcttgatttacgatcgtccaaaccacgacaacttcaacgttcatggctacaaggagcagggctccaccaccacgccatacgatatggttcgcgtgaacgacatggatcgttacgagcttactgctgaagcattgcgcatggttgacgctgctaagtatgccgacgaaatcaagaagctcgaggacttccgcctcgaagccttccagtatgcagtcgacaagggtcttgatcacccagactacaccgattgggtatggccaggcgttaagaccgacaagccaggcgctgtcaccgctaccgctgcaaccgctggcgataacgagtag

SEQ ID NO: 78 - DNA, 2481 bp, Bifidobacterium gallicum DSM 20093
atgacaagtcctgttattggcaccccctggcagaagctgaaccgtccggtttcggaagaggccatcgaaggcatggacaagtattggcgcgcgtccaactacatgtccatcggccagatctacctgcgtagcaacccgctgatgaaggaacctttcactcgcgatgacgtgaagtaccgcctcgtcggccactggggtaccaccccgggcctgaacttccttctggcccacatcaaccgcctgatcgctgaccaccagcagaacaccgtgttcatcatgggtcctggccacggcggtcctgccggtactgcacagtcctatctggacggcacgtacaccgagtactacccgaacatcaccaaggatgaggaaggcctgcagaagttcttccgtcagttctcttatccgggcggcattccttcgcacttcgctccggagaccccgggctcgatccacgaaggtggcgagctgggctatgctctgtcccacgcttacggcgctgtgatgaacaacccgagcctgttcgtgccctgcatcgtcggcgacggcgaagctgagactggccctctggccaccggctggcagtccaacaagctcgtgaacccgcgcaccgatggcatcgtgctgccgatcctgcacctcaacggctacaagatcgccaacccgaccatcctcgctcgcgtgtccgatgaagagctgcatgacttcttccgcggcctgggctaccacccgtacgagttcgtcgccggcttcgacaacgaggatcacctgtcgatccaccgtcgtttcgctgagctcttcgagaccatcttcgacgagatctgcgatatcaaggctgccgccaacacggatgacatgacccgtccgttctacccgatgctgattttccgcaccccgaagggttggacctgcccgaagttcatcgacggcaagaagaccgaaggctcttggcgtgcacaccaggtgccgctggcttccgcccgcgataccgaggctcacttcgaagtgctgaagaactggatggcttcctacaagccggaagagctcttcgacgacaagggcgccatcaaggatgacgtcgtcgacttcatgccgaagggcgatctgcgtatcggcgccaacccgaatgctaacggtggcgtgatccgtgaagagctcgatctgccggccctcgagaactatgaggtcaaggaagtcaaggaattcggccacggctggggccagcttgaggctacgcgtaagctcggtgagtacacgcgtgacatcatcaagaacaacccggattcgttccgcatcttcggacctgacgagaccgcttcgaaccgtctgcaggcttcctacgaagtcaccaacaagcagtgggacaacggctacctgtccaaggacctcgtcgatgagcacatggctgtcaccggccaggtcactgagcagctctccgaacaccagtgcgaaggcttcctcgaggcctacctgctcacgggtcgtcacggcatctggagctcctacgagtccttcgtgcacgtcatcgactccatgctcaaccagcacgccaagtggctcgaggctacggtgcgtgagattccgtggcgtaagccgatctcctcgatgaacctgctcgtgtcctcgcacgtgtggcgtcaggatcacaacggcttctcgcaccaggatccgggtgtcacctccgtcctgttgaacaagacgttcaacaacgatcacgtcatcggcctgtacttcgcaaccgacgccaacgtgctgctggccatcgctgagaagtgctacaagtcgaccaacatgatcaacgccatcgtcgccggcaagcagcctgctgccacctggacgacgctggacgaagctcgtgagctggttgccaagggcgctggcgaattcgagtgggcttcgaacgtcaagaccaacgatgaggccgagattgtgctcgcttccgctggcgatgttccgactcaggagctcatggctgctgctgatcgtctgaacaagctcggcgtcaagttcaaggtcgtcaacgtggtggatctgatcaagctgcagtccgccaaggagaacgatcaggctctgtccgatgccgagttcgctgagctcttcaccgaagacaagccggtgctgttcgcgtaccactcctatgcgcacgacgtgcgcggcctgatcttcgatcgcccgaaccacgacaacttcaacgtggtcggctacaaggagcagggctccaccaccacgccgtacgacatggtgcgtgtcaacgacatcgatcgttatgagctgaccgctacggcactgcgcatgatcgacgccgacaagtacgccgacgagatcaagaagctcgaggacttccgcatcgaggcttaccagttcgctgtcgacaacggctacgacattccggattacaccgactgggtgtggccgggcgtcaagaccgacctgccgggcgccgtttccgcaacggctgccaccgcaggcgacaacgagtga

SEQ ID NO: 79 - DNA, 2478 bp, Bifidobacterium animalis subsp. lactis HN019
atgactaatcctgttattggtaccccatggcagaagctggatcgtccggtttccgaagaggccatcgaaggcatggacaagtactggcgcgtcgccaactacatgtctatcggccagatctacctgcgtagcaacccgctgatgaaggagcccttcacccgcgatgacgtgaagcaccgtctggtcggccactggggcaccaccccgggcctgaacttccttctcgcccacatcaaccgcctgatcgccgatcaccagcagaacaccgtgttcatcatgggtcctggccacggcggccctgcaggtaccgctcagtcctacatcgacggcacctacaccgagtactacccgaacatcaccaaggacgaagctggcctgcagaagttcttccgccagttctcctacccgggtggcattccttcccacttcgctccggagacgccgggctccatccacgaaggcggcgagctgggctacgccctgtcgcacgcctacggcgcgatcatggacaacccgagcctcttcgtcccgtgcatcatcggtgacggcgaagccgagaccggccctctggccaccggctggcagtccaacaagctcgtcaacccgcgcaccgacggcatcgtcctgccgatcctgcacctcaacggctacaagatcgccaacccgacgatcctcgcccgcatctccgacgaggagctgcacgacttcttccgcggcatgggttaccacccgtacgagttcgtcgccggcttcgacaacgaggatcacctgtcgatccaccgtcgcttcgccgagctcttcgagaccatcttcgacgagatctgcgatatcaaggctgcggctcagaccgacgacatgacccgtccgttctacccgatgctcatcttccgcaccccgaagggctggacctgcccgaagttcatcgacggcaagaagaccgaaggctcctggcgtgcacaccaggtcccgctggcttccgcccgcgacaccgaggcccacttcgaagtcctcaagggctggatggaatcctacaagccggaggagctcttcaacgccgacggctccatcaaggaggacgtcaccgcattcatgcctaagggcgaactgcgcatcggcgccaacccgaatgccaacggcggccgcatccgcgaggatctgaagctccctgagctcgatcagtacgagatcaccggcgtcaaggaatacggccacggttggggccaggtcgaggctccgcgttccctcggcgcgtactgccgcgacatcatcaagaacaacccggattcgttccgcgtcttcggacctgacgagaccgcgtccaaccgtctgaacgcgacctacgaggtcaccaagaagcagtgggacaacggatacctctcggctctcgtcgacgagaacatggccgtcaccggccaggttgtcgagcagctctccgagcatcagtgcgaaggcttcctcgaggcctacctgctcaccggccgtcacggcatctggagctcctacgagtccttcgtgcacgtgatcgactccatgctgaaccagcatgcgaagtggctcgaggccaccgtccgcgagatcccgtggcgtaagccgatctcctcggtgaacctcctggtctcctcgcacgtgtggcgtcaggatcacaacggcttctcgcaccaggatccgggtgtgacctccgtcctgctgaacaagacgttcaacaacgaccacgtgacgaacatctacttcgcgaccgatgccaacatgctgctggccatcgccgagaagtgcttcaagtccaccaacaagatcaacgcaatcttcgccggcaagcagccggccgcgacgtggatcaccctcgacgaggcacgcgccgagctcgaggctggtgccgccgagtggaagtgggcttccaacgccaagagcaacgacgaggtccaggttgtcctcgccgccgccggcgacgtcccgacccaggagatcatggccgcttccgatgccctcaacaagatgggcatcaagttcaaggtcgtcaacgtcgtggacctcatcaagctgcagtcctcgaaggagaacgacgaggccatgtctgacgaggacttcgccgacctgttcaccgcggacaagccggtcctcttcgcctaccactcctatgcccaggacgttcgtggcctcatctacgaccgcccgaaccacgacaacttcaccgttgtcggatacaaggagcagggctccacgacgacgccgttcgacatggtgcgtgtcaacgacatggatcgctacgcccttcaggccaaggccctcgagctcatcgacgccgacaagtatgccgacaagatcaacgagctcaacgagttccgcaagaccgcgttccagttcgccgtcgacaatggctatgacattcctgagttcaccgattgggtgtacccggatgtcaaggtcgacgagacctccatgctctccgccaccgccgcgaccgccggcgacaacgagtga

SEQ ID NO: 80 - DNA, 2478 bp, Bifidobacterium pseudolongum subsp. globosum
atgacaaatcctgttattggcaccccgtggcagaagctggatcgcccggtttccgaagaagccatcgaaggcatggacaagtattggcgcgtcaccaactacatgtccatcggccagatctatctgcgtagcaacccgctgatgaaggaacccttcacccgcgacgacgtgaagcaccgtctggtcggccactggggcaccaccccgggcctgaacttccttctggcccacatcaaccgcctcatcgctgaccaccagcagaacaccgtgttcatcatgggcccgggtcacggcggcccggctggcacctcccagtcttacgttgacggcacgtacaccgagtactacccgaacatcaccaaggacgaagctggcctgcagaagttcttccgccagttctcctacccaggcggcatcccgtcgcacttcgcgcctgagaccccgggctcgatccacgaaggtggcgagcttggctacgcgctctcccacgcctacggcgctgtgatgaacaacccgagcctgttcgtgccgtgcatcatcggcgacggcgaggccgagaccggcccgctcgccaccggctggcagtccaacaagctcgtcaacccgcgcaccgacggcatcgtgctgccgatcctgcacctcaacggctacaagatcgccaacccgaccatcctcgctcgtatctctgacgaagagctgcatgacttcttccgcggcatgggctaccacccgtacgagttcgttgccggcttcgacaacgaggaccacatgtcgatccatcgtcgtttcgccgagctgttcgagacgatcttcgacgagatctgcgacatcaaggcagcggcccagaccgacgacatgacccgtccgttctacccgatgctcatcttccgcaccccgaagggctggacctgcccgaagttcatcgacggcaagaagaccgaaggctcctggcgcgcacaccaggtcccgctggcttccgcccgcgacaccgaagagcacttcgaagtcctcaagggctggctggaatcctacaagccggaagagctcttcaacgccgacggctccatcaaggatgacgtcaccgcgttcatgccgaagggcgacctgcgcatcggcgccaacccgaacgccaacggtggtgtgattcgcgaggacctgaagctccccgagctcgatcagtacgaggtcactggtgtcaaggagtacggccacggctggggccaggtcgaagctccgcgctccctcggcgcgtactgccgcgacatcatcaagaacaacccggattcgttccgcatcttcgggcctgatgagaccgcgtccaaccgcctgaacgcgacctacgaggtcaccgacaagcagtgggacaacggctatctctcgtcgctcgtcgatgagcacatggccgtcaccggtcaggtcaccgagcagctctccgagcaccagtgcgaaggcttcctcgaggcttacctcctcaccggccgccacggcatctggagctcctatgagtccttcgtccacgtcatcgactcgatgctgaaccagcacgcgaagtggctcgaggccaccgtccgtgagattccgtggcgcaagccgatctcttcggtcaacctcctcgtctcctcgcacgtgtggcgtcaggatcacaacggcttctcgcatcaggatccgggtgtcacctcggtcctgatcaacaagacgttcaacaacgatcacgtgacgaacatctacttcgcgaccgatgcgaacatgctgctcgccatctccgagaagtgcttcaagtccaccaacaagatcaacgcgatcttcgccggcaagcagcctgccccgacgtggatcacgcttgacgaggcccgtgccgagctcgaagccggcgccgccgagtggaagtgggcttccaacgccgagaacaacgatgaggtccaggtcgtcctcgccgccgctggcgacgttccgacccaggagatcatggctgcttccgacgccctcaacaagatgggcatcaagttcaaggtcgtcaacgttgttgacctcctcaagctgcagtcccgcgagaacaacgacgaggccctcacggacgaagagttcaccgatctcttcaccgccgacaagccggtcctgttcgcgtaccactcctatgcgcaggacgttcgtggcctcatctacgaccgcccgaaccacgacaacttcaacgttgtcggctacaaggagcagggctccacgaccacgccgttcgacatggtccgcgtcaacgacatggatcgctacgcgctccaggccgctgccctcaagatgatcgacgccgacaagtatgccgacaagatcgacgagctcaacgcgttccgccagaaggcgttccagttcgcagtcgacaacggctacgacatcccggagttcaccgactgggtctacccggacgtcaaggtcgacgagacgcagatgctctccgcgaccgcggcgaccgctggcgacaacgagtga

SEQ ID NO: 81 - DNA, 2469 bp, Atopobium vaginae DSM 15829
ttggctcagcccgtgcttggaacaccttggtataagccgctcggcatacgtaaacaggagtgttcgtcggcgcaaaccttagcgtcacttgacgcgtattggcgatgtgcaaattatataagcgcaggtcaaatctatcttttcagcaatcctttgatgaagggcggcttaagcccacgcgacataaagcataggcttatggggcattggggaaccattcccgggcttaatttcttatatgcgcacatcaatcggtttattcgtgatcatggtcaaaacacggttgtacttatgggaccaggtcatggtggacctgcaggaaatgcagaggcttttatcgatggtagcctgtcggaagtgtatcccgatatccctcaaaacgagcaaggtttggagcggctttgtcgcgcgtattcatttcctttgggctttccttctaatcatggtccgcatacgccaggttcaattcacgaagggggagagctcggctatgttctttcccacgcctttggtgccgttttggataatccttcgctgttggcaattcctattattggcgatggagagtgcgaaacaggccctttagctgcaagttggcaaaccaataaatttataaatccacaaactgatggcctcgtattgccaattgtgcacctcaatggttacaaaatttcaaatccgtccattttggcgcgtgtttcactgcaggaacgcgatgattattttaaaggtatggggtatcgcccatatacgtttgttgcgggttttgatgaagaagacgcactgtcaattcataaacgctttgtagcgttatttgaagaaatttttgctgagctctgttcaataaaagagcatgcaaagcaggggtttcacgagagaccatcatatccggtgcttatttttaaaaccccaaagggatggacgtgtccaacatatattgatggtcaaaagtttgaagattcttggcgttctcatcaagtgccctttgccgcggcagatgaaacgcttacgcattttgatgatttttgtgcatggatggcttcgtatcgtccacaagagatttttgaaaaagatggtaccttatctaagcaagttactcgtattttgccacaaggtgacctgcggataggttccaacccttgcgcagacgcaggacgtgttcggtgtgcgcttacgctgccatcgcttgatttgtataagctagcgcctgatacatcgcagcgtggagcgctctgcgcttcgccaacgtatgtacttggtttgtataccgccaagcttttgcaaaacaatccacagatgtttcgcgtatttggccccgatgagattgcttctaatcgttttcagtcaatttatcgtgcaactcataaacaatggtacgtggatatagataaagacctcgaaaacgacggagaactttcgcaaacaggtagtgttattgagcaactttccgagcaccagtgcgaaggtttattggaaggctatgtgcttacaggtcgtcatggaatttgggtgagctatgaggcgtttgcgcagattacagcctctatgatcagccaacatattaaatggcttgaagcactaaggcgtgaggtttcttggcgaaagcccatttcttcgctcaatattttgcttacctctcacgtttggcgtcaggaacataacggctttacacatcaagatccaggtattgtggacacgcttctcaataaatcttgtaataacgagcatgttatacatatatattacccatgtgacgccaatcttttgttggcggtggcgcaacaagcctatactgccaccgattgcgtcaatgtgatatttgcaggaaagcagcaaattcctgtttggcttacgcttgacgaagcgcgtttggaacttgcacgcggtgtgcttgaatggacgtgggcatcgcatacagacgcgcatggcaactttgatttggtacttgcaacctgcggtgatgttcctactatcgaaactttagcagctgcagatatacttcgccgtcaaggtgttcattttaagtttgtgaatgtgcttaatttatgcgcacttcaaagacatgaagaaaatgacactgcgcttaccgatgaggaattcaccgagcttttttcagctgataaacccgttttgtttgcgtttcacgcgtatgtaggcaccatatatcgcctcatatggggtcgtcctcatagtagtaatttttacgtacacggctatcaagacctaggttcaacaacaacgttttttgacatgcttcatatgaaccagatggatagatttgcgcttgcagctcatgcgttacaaattcttaatgcacaaagagcgttggttcacagctgtgcaaaaccgttgtggaaaactgcgcgccaagaaattcttgcatatcgagaacaactgtatcgttttacccttgaacatggttacgatgatcctgcagctacgtcttatccaagcgtggctaaagattag

SEQ ID NO: 82 - DNA, 2436 bp, Frankia sp. EAN1pec
atgaccgccccggccgtccacgaccaggaacaaggcgaccaggaacaaggcggcctggagcacgggctcgacgaggcccagctggacgggctgatcgcctactggaacgcggcgaactacctgaccgcggcgcagatctacctgatggacaacccgctgctgcgccggccgctgcgccgcgacgacatcaagccgcggctgctgggccactgggggacgtccccggcgctgaatctggtctacgcccacctgaaccggctggtccgccggaccggccaggatgtgctctacgtggccggccccgggcacggcgggccggcgctggtcgccaacacctacctggagggcacgtactcggagatctacccgagcgtgtcgcgggacgtcgccgggctgacccagctcgtgcggaggttctcgacccccggtggtatcccgagccatgtcagcgtcccgacgccggggtcgatccacgaaggcggcgagctcggctacgcgctcgtccacgcgttcggcgccgtgttcgaccaccccgatctgctggtcgccgccgttgtcggcgacggcgaggccgagaccggcccgctggagggcagctggaagggcgtcgacttcctcaacccgtcccgcgacggcgcggtgctgccgatcctcaacctcaacgagtacaagattgccaacccgacggtgctcggccggctctcccgggaacggctgaaccacctgttcgccggccacgggtacgacgtcctgtgggtggagggggacgacgtccgcgcggtgcaccgtgcgttcagcgccgcgctcaccacagcacacagccgcatccgcgacatccagcggacggcccgacgtccaggtgccaccgtcaccgaggcgccgatctggccgatgatcgtgctgcggacccctaagggctggaccggcccgcacgaggtggacggcgtccttgtcgaggggacgttccgagcgcaccaggtgccgctgtcgggggtgcgggacaatcccgagcatctcgcccagctcgaggcctggctgcgttcctaccagcccgagcggctgttcgacgccgacggccggctggtccccgagctggcggcgctcgccccggacggcccggcccggctgggcgccacgagctacgccaacggcggcgtgcgcaccgagccgctgcggctgcgcgactggcgggcccacgccctcgacgtcgacccggcccgccgcggcagcctcgtccacgagacgacccggccgctgggcgagctgctggccgacgtctaccgggacaatccgaccaccttccgggtcttcagcccggacgagctggccagcaaccgcctcggggcgatcctggacgtcaccgaccgctgcctggtcgcgccgatcgacccgcgcgacgaccgggtcagcccggccggccgggcgatggaggtcctctccgagcacctgtgcgagggctggctggagggctacaccctgaccggccggcacggcctgttcgccacctacgaggcgttcgcgatggtgtcggcgtcgatggtgatccagcacaccaagtggctccaggaggcgagccggctggcgtggcgcgcccccgtcccgagcctgaacgtcctgctgaccagcacctgctggcgcaacgaccacaacggcttctcccaccaggggccggggctcatcgacacggtcgtgccgctctcgcccggggtcgcccggatctggctgccgccggacgcgaacagcctgctctcggtcgccgaccactgcctgcgcagccgcgaccacgtcaacctgctcgtcgccgacaaacagccgcacctgcagtacctgaccgccgacgaggccgccgagcacgccgcccgcggcgggtcggtctgggactgggccggcaccgagaccgacctcgaccgtgagcccgacgtggtcctcgccgggatcggcgacgtgccgacactggagatcctcgcggccgcggacctgctccgccggtacgtgcccagcctggccgtccgggtcgtcaacatcatcgacctgatggccctgctgcgctcggacctgcacccgcacgggttctccacgccgatgttccgcgcgctgttcaccgactcgacggacgtcgtcgtcggattccacggctacagccgggccgtccaccagttgctgcacggccgggcgaacccgcagcggttccacgtccgcgggttcaccgagcagggcacgaccacgacgccgttcgacatggtcgtccgcaacggcctgagccggtaccacctggcccagctcgccgtggagttcacccggaccacccgtcccggcaccgaccgcctggtcagccactgccaggaccagctgacccgccacgacgcccacgtcaccgagcacttcgaggacctgcccgagatccgggagtggacctggccgggccgcgatacctga

SEQ ID NO: 83 - DNA, 2469 bp, Frankia alni ACN14a
gtggtgggcggaacaggtgggagtcttggcagcatgactgccacggtggatgtcgaggagctcgacagtcccgttccggagctggacgagccgtcgctggaccggctgatcgcctactggaatgccgccaactacctgacggtcgcgcagatctatctgcgggccaaccccctgctgcgggagccgctgcgccccgagcacatcaagccgcggctgctcgggcactgggggacgtcaccggcgctgaacctcgtgtacgcgcacctcaaccgcctggtcggcctgaccggccaggacgtgctgtacgtggcgggccccgggcacggcggcccggccctggtcgcgaacacctacctggagggcacctactcggagatctacccggcggtgtccgcggacacggccgggctgaccaggctggtcgagcagttctccaccccggggggcatccccagccacgtcagcgtgccgacaccggggtccatccacgagggcggcgagctcggctacgccctggtgcacgccttcggcgccgccttcgaccatcccgacctgctggtcgccgccgtcgtcggcgacggggaggccgagaccggcccgctggagggcagctggaagggcatcaccttcctcaacccggcccgcgacggcgcggtcctgccgatcctgaacctcaaccagtacaagatcgccaaccccaccgtgctcggccggcgcagccgcgaccaggtgaccgcctacctcgccggccacgggtacgaggtcctgtgggtcgagggcagcgacgtccgccaggtccaccgggacttcgccgccgccctcgccacggcccaccaggcgatccggcgcctccagcacgccgcccgccgcccgggcggtacggtcaccgacaccccggtctggccgatgatcgtgctgcgcaccccgaagggctggaccggcccgcacgaggtcgacggcgtgcaggtggagggcaccttccgcgcccaccaggtgccgctggccacggtccgcgagaacccggagcacctggcccagctcgacgcgtggctgcggtcctaccagcccgagcggctgttcgacgccgacggccggcttgccgccgaactggccgccctcgccccggccggggacaagcggctgggggccaccagctatgccaacgggggcaggcgcaccgaaccgctgcgcctgcccgactggcggacacacgcgctggacatcgacccgctccaccgcggccgcgactcctacgagacgacccggccgctcggcgagctgctgcgcgacgtctaccgcgacaacccgaccaccttccgggtcttcagcccggacgagctcaccagcaaccggctcggcgccatcctggaggtgaccgaccgctgcctggtcgccccgatcgacccgcacgacgaccgggtctccccctccggccgggtcatggaggtgctctccgagcacctgtgccagggctggctggaggcctacaccctcaccggccgccacggcctgttcgccacctacgaggcgttcgccatggtgtccgcctcgatgctcatccagcacacgaagtggctgcaggaagcggcccggctcggctggcgcgagcccgtccccagcctcaacgtgctgctgaccagcacctgctggcgcaatgatcacaacggtttctcccaccagggacccggcctcatcgacaccgtcgtcccgctgtcccccggcgtcgtgcgggtctggctgccgccggacgccaacagcctgctgtccgtcgccgaccactgcctgcgcagccgcgaccacgtcaacctgctcgtggccgacaagcagccgcacctgcagtacctcaccgccgccgaggccgacgagcatgcggcccggggcggctccgtctgggactgggcgggcaccgagaccccgctcgggcgcgatcccgacatcgttctcctcggcatcggtgacgtccccaccatggagatcctcgccgccgcccagctgctacgccggttcgtgcccagcctctccgtgcgtgtcgtcaacgtcatcgacctgatggccctgctgcgcagcgacctgcacccgcacggtttctccaacccgatgttccgggccctgttcaccgacgagaccgacgtcgtcgtcgggttccacggctacagccgcggcgtgcaccagctcctgcacggccggcacaacccccagcgcttccacgtccgcggcttcatcgagcaggggacgacgaccaccccgttcgacatgctcgtccgcaacgaggtcagtcgttaccacctcgcgcgcctcgccatcgagttcgcccgcaccacccgtcccggcaccgaccgcctcgtcacccactgcgaaactcagctcagccgccaccacggctacattcgcgaccatctggaggacctgcccgagatccgcacctggacctgggacgatcccccgccggccgcggagccgtccgcctag

SEQ ID NO: 84 - DNA, 2403 bp, Rhodococcus opacus B4
atgaccgaagtacggcagccggggtcgcaggactccgacgggcactattccgacgccgacctcgagtcggacctgcggtggtgggcggcggccaactatctgacggttgcgcagatctacctgcaggacaacacgcttctgcgtgaaccgctgcgcccggaacacatcaaaccccggctgctcgggcactgggggacgagcccggggctgtcgatgatctacgcgctgctgaaccgtctcatccgccggaccgacacggactgcctgtacgtgaccggtcccggtcacggtggtccggcgctcgtcgccgccacgtacctcgagggaacgtactcggaggtgtatccgggcgtgtcccgcgacgccgccggtatccaccggctgtgccggcagttctcgacgccgggcggcatcccgagtcacgtcagtgtgcagaccccgggcagcatccacgagggcggcgagctcggctacgcgctcgcacacgccgccggggcggcattcgaccacccgaatctgttggtggcgtgcgtgatcggagacggggaggcggagacgggaccgctgtccgcgtcgtggaaactgcccgcattcctcaacccggaacgcgacggtgcggtgctgccgatcctgcacgtcaacggtgcgaagatcgccgggcccaccgtccacggccgcagcagcgacgccgacgtcgaagcgttcctcggtggtcaggggtgggcgccggtcgtcgtctccggtgacgatccgcggcaggtcttcccggcgctgcatcgcgccctgaccgacgcccataccgcgatctccgaccttcagcgggaggcacgggccgaccggcgcagcgccgccaagtggccggcgatcgtgctccggacccccaagggctggaccggtccgcgcaccgtcgacggcgtgctcgtcgagggcacgcaccgggcgcatcaggttccgctgtcgggagtccgcaccaacgaggcgcatctgcgtcaactcgaggagtggatgcggtcgtacggcccggaccaactgttcgactcgtcgggcgcactcgtgccggacctggtgcggctggcgccgcagggcgacaagaggatggggtcgtcgccgtacgcgaacggcggccgcctgcgcgcggatcttcccgtcccgcccctggagaagtacgcgctccccatcgagaaacccggcaccacccaccacgagaccacccgggtactcggcgaattgctccgcgacctctatgccgccaccaccacacaagacggcggtggatacttccggctgttctgtcccgacgaaacgtccagcaaccgattgggcgccgtcttcgaggtgaccgaccggtgctggcagctgccggtcaccgactacgacgacggactggcggcccgcggccgggtgatggaggtgctcagcgagcacctctgcgagggatggctggaggggtacctgctgtcggggcggcacggactgttcgcgagctacgaggccttcgcgatggtgagcgtgtcgatgctcgtccagcacaccaagtggctgcagcatgcggtggatctgccgtggcgggcgccggtggcctcgctgaacgtcctgctcaccagcacctgctggcgcaacgaccacaacgggttcagccaccaggggccgggcatgatcgacgccgtgatcccgctcgcaccggatgtggtccgggtgtggctcccaccggactcgaacaccctgctctcgatcgccgaccactgcctccgcagcaccgatcacgtcaacctcgtcgtggtcgacaaacagccgcacctgcagtacctgtcccttgcggaggcgcacgcgcactgcgcggccggggcgtcggtgtgggagtgggcgggaacggagtcttcggcgggcaccgaaccggatgtcgtgctcgctgccgccggggacgtcccgacccaggaaattctcgccgccgcgcagttgctgcgcgaacacaccccggaactggtcacccgggtggtcaatgtcgtcgacctgatggggctgctcacgccgaccgagcacccgcacggattcgacgcgcgcacattcctcgacctcttcaccgcggacacggacgtggtgttcgcgttccacgggtactcgcgcgccgtccacgagttgctacacggacgtcccgcaccggaccgcttccacgtccgcggcttcagcgaacagggcactacgaccacaccgttcgacatggtcgtgctcaaccggatgagccgataccacctcgcgctcgccgcgctgcgccgcacgcggcgggagccggccggtgccacggagttggccgatcactgcctccggcaactcgaacggcacggcgaatacgtcgtcgcgcacctcgaggacatgcccgaggtgcgcgactggacgtggtcgtga

SEQ ID NO: 85 - DNA, 2553 bp, Rhodococcus jostii RHA1
gtgccgattgggctggccaatcgtagcgcatgggtagtgggatcgaccaaatcggtccccctacttcgtggactcgccccggtagcggcccggacacgcctagtgtcgggaggacgtggacgctcgcgaactcccggggaggcgtcgagaatgaccgatggaccgcagttggggtcgcaggaccccgacgggcactattccgattccgacctcgagctggacctgcggtggtgggcggcggccaactatctgacggtcgcgcagatctacctgcaggacaacgcgcttctgcgtgagccgctgcgcccggaacacatcaaaccccggctgctcgggcactgggggacgagcccgggtctgtcgatgatctacgccctgctgaaccgtctcatccgccggaccgacaccgattgtctctacgtgacgggtcccggacacggtggtccggcgctcgtcgccgccacgtacctggaggggacgtactcggaggtgtatccgggtgtgtcccgcgacgcagcgggtatccaccggctctgccggcagttctcgaccccgggtggcatcccgagtcacgtcagtgtgcagacaccgggcagcatccacgagggcggcgagctcggctacgccctcgcgcatgccgccggggcggcgttcgatcacccgaatctgttggtggcgtgcgtgatcggagacggcgaggcagagacgggaccgctgtccggttcgtggaaactccccgccttcctcaatccggaacgcgacggtgcggtgttgccgatcctgcacgtcaacggagcgaagatcgccgggcccaccgtctacggccgcagcagcgacgcggacatcgaggcattcctcggcggtcaggggtgggcgccgaccgtcgtctccggcgacgacccgcggcaggtcttcccggcgctgcatcgcgcactcaccgacgcgcacaccgcgatctccgaccttcagcgggaggcgcgggccggcaggcgcagcgccgccaagtggccggcgatcgtgctgcgcactccgaagggctggaccgggccgcggaccgtcgacggcgtgctcgtcgagggcacgcaccgggcccatcaggttccgctgtcgggggtgcggaccgacgaggcgcacctgcgtcagctcgaggagtggatgcggtcgtaccgcccggacgcactgttcgactcgtccggcgcactctttgcggacctcgagcggctggcgccgcagggcgacaagcggatgggttcgtcgccgtacgcgaacggcggccgcctgcgtgcggatcttcccgtgccgccgctggagaagtacgcgcttgcgatcgagaaacccggcaccacccaccacgagaccacccgggtgctcggggaactgctccgcgacctgtacgccgccaccaccacgcccgacggcggcggctacttccggctgttctgcccggacgaaacgtccagcaaccggttgggcgccgtgttcgaggtgaccgaccgctgctggcagctgccggtcaccgaccacgacgacgggctgtcggcccgcggccgggtgatggaggtgctcagcgagcacctctgcgagggatggctcgaggggtatctgctgtcggggcggcacgggctgttcgccagctacgaggcgttcgcgatggtgagcgtgtcgatgctcatccagcacacgaagtggttgcagcatgcggtggatctgccgtggcgggcgccggtggcgtcgctgaacgtcctgctgaccagcacctgctggcgcaacgaccacaacgggttcagtcatcaagggccgggcatgatcgacgccgtcatcccgctcgcaccggacgtcgtccggatctggctgccaccggactcgaacactctgctgtccatctccgaccactgcctccgcagcaccgaccacgtcaacctcatcgtcgtcgacaagcagccgcacctgcagtacctgaccctcgcggaggcgcacgcacactgcgcggccggggcgtcggtgtgggcgtgggcggggacggaagccgcggcgggcgccgacctggacgtcgtgctcgcggccgccggggacgttccgacccaggagatcctggcggcggcgcagttgctgcgcgagcacacgccggaactggtcacccgggtggtcaacgtcgtcgacctgatggggttgctcacacccacggaacatccgcacggattcgacgcgcgcatgttcctggacctgttcaccgcggacacggacgtggtgttcgcgttccacgggtactcgcgcgccgtccacgagctgatccacgggcgtcccaccccggaccgtttccacgttcgcggcttcagcgaacagggcaccacgaccaccccgttcgacatggtcgtgctcaaccgtatgagccgctatcacctggtcctcgaggcgctgcgacgcacgcggagggaaccgtccggtgccggggaactggccgacttctgcctccggcaactcgaacggcacggcgaatacgtcgtcgcgcacctcgaggacatgcccgaggtgcgcgactggacgtggtcgtga

SEQ ID NO: 86 - DNA, 2370 bp, Rhodococcus erythropolis SK121
atgaccgatcaccactattccgaagaccagctcgcgctcgacctgaagtggtgggcagcggccaactacctgaccgtcgcgcagatctatctgaaggacaacacgcttctgcgggaaccgttgcgtgccgagcacatcaagccccgactgctcgggcactgggggaccagccccggcttgtcgatgatctacacgctcctcaatcggcacatcgtcgccaccggcgcagactggctttacgtgaccggtcccgggcacggcggtccggcgctggtcgcgtcgacgtatctcgagggaacgtactcggagatctatccggaagtctcggacgacgccgagggcatccaccggatgtgtcggcgattctccgctcccggcggagtgcccagccatgtgagtgtgcagacacccggaagcatccacgaaggcggcgagctcggctacgcccttgcccatgcggccggcgctgccttcgatcatccgaacctcgtggtggcctgtgtgatcggcgacggcgaagcggagaccgggccgttgtccggttcgtggaagctcccggcgttcctgaatccacgacgcgacggcgcggtgctgccgatcctgcacgtgaacggtgccaagatcgccgggccgacggtctacggacgcagcagcgacgaagacatccaggcttacctcggtggacaggggtgggcgccgatcgtcgtctccggtgacgaccccgacgcggtgtttccccagctgtatcaagcgatctcgcaggcgcacgagaagatccgcgagatgcagggtgccgcacgccgcggagaggagtggacgggttcgtggccggcaatcgtgttgcggacgccgaaaggatggaccggtccacacaccgtcgacggaatcttggtcgagggcacacatcgtgcgcaccaggtgccgttgtccggcgtgcgaagcaacgaatcacatctgcggcaactcgaagagtggatgcggtcgtaccgtccggacgagttgttcgacgccaacggatcactcgtcgcggaactggcggcgctgtcgccgacgggggacaagcgcatggggagcactccctacgcgaacggtggacgacttcgcgtcgatctcccgatgccgccgctcgaaaagtatgcgcttcccatccaatccccgggttcgaccttccacgagacgacgcgagttctcggcgagcttctgcgcgacatctacgccgccacggaaaccgaggacagcggcgggatcttccgactcttctgtccggacgagacgtcgagcaatcgcctcggcgccgtattcgagacaaccgatcgctgctggcaactgccgatcaccgactacgacgacgggctgtccgcggacggtcgtgtcatggaggtcctcagcgagcacctctgcgagggatggctcgagggctatctgctgtcgggccgacacgggatgttcgcgagctacgaagcatttgcgatggtgagcgtgtcgatgctcatccagcacgccaagtggctccaacatgccgtcgacctgccgtggcgggcgtctgttgcttcgctcaacgtgctgctgaccagtacgtgctggcgcaacgatcacaacggattcagtcatcagggccccggcatgatcgacgccgttattcccttggcacccagtgtgatccgcgtgtggctgccgccggattccaacaccttgctctcgatctcggaccactgcctgcgtagtaccgaccacgtcaacctgatagtcgtggacaagcaaccgcacctgcagtacctcacgctcgagcaagcgcacgagcactgcgcggcgggcgcttcggtctgggaatgggccggaaccgaagcacgcggacaggaaccggacgtggtcctggccgccgcgggagatgtgccgacgcaggagatcctggctgctgcacagttgctgcgcgatcacacacccgaactgatcacccgcgtcgtcaacgtcgtcgatctgatggccttgctgacgccaaccgagcatccccacggattcggggagcgggtcttcctcgatctgttctccgcgcagaccgacgtcgtgttcgcattccacggatactcgcgtgccgtgcacgaactgattcacgggcgtccgagtcccgagcgcttccacgttcgcggattcagtgaacagggaacaaccacaacaccgttcgacatggttgtcctcaacaagatgagccgctaccacctggtgatcgaggcgctacgacgctccaagcgtcggccggccggggcgtccgagttggcggagttctgccgcacacagctcgaaaagcactcgcggtacatcgtcgagcacctcgaagacatgccggaagtagaaaactggacctggtcctga

SEQ ID NO: 87 - DNA, 2382 bp, Arthrobacter aurescens TC1
atgatcagtaccctccaactccaagatttactcccagtctcaaccctgaatcggcgccgccaacagagtccgaggtcccggttcaatcgcccgtgccgccaaccgctgcaagcagcgcacatcaaacccagacttctaggtcactggggcacaagccccgggctgtccctgatctatgcacacctcaaccgccttatccgtcgcacgagtgtggaagttctgttcgtggccggtcccggccacggaggtcccgccgtcgtcgccaatacctatctggaaggcagctactcggaggtttacccggccgttggcaaagacctgaaagggcttcggaggcttgtccggcagttttcgacgccgggaggcatcgccagccacgtcggccccgccacgcctggctccattcacgagggcggggaactgggctactccctgatgcatgctaccggtgcggctatggacaatccggacctgatcgttgcctgcgtcgtcggtgatggggaggccgaaaccggtccgctcgaaggctcttggaaggcgccctcgttcatcaacccgctcagggatggggcagtacttcccatcctccacctcaatgggcataagatctccggccccacggtccttggcaggcgctcgaacatggccgttgcgtcgcttttggaagcgcacggctgggatcccgtgattgtctccggcgacgatcccgcccttgtccaccccgccctcgcctcagctctggattcagcctacttatcgatccggaccattcagtcccatgcccgcacagagggagtcaccgggcccgcacgatggccggccatcgtcctgcgcacccccaaaggatggacaggaccggtgacagtagacggaaagcccgtagagggaacccaccgttcccaccaagtcccgctggccggagtcagagagaatccggcgcacctggcgcagcttgaagcgtggatgcgttcctaccggccggaagaactcttcgacgccgacgggcggcttatcgccgagctgacggcgctcgcccccgacggcgatttacgcatgggcgcactgcccgccagccgcgggatgggaagccgcgacctggcaataccatcgctcgatcgatatgccctcgaagctgttccccgcggaggcgtgatgcacgggagcaccaagccattaggggagatgctgcgcgatatctacatcgatactgccgatgaccccaggttccgcctcttctgccccgatgaaaccaacagcaacagactcggtgcagtctttgaagccaccgacagatgcctcctcgaaccagccgcgaccacagaagccgcgctcgcagacgatcatgtttccgccagcggacgcgtgatggaagtcctgtccgaacacttgtgccaagggtggctggaaggatacgtgctgacaggccgccacggcctattcgccagctatgaggcgtttgcgatggtcagcgcttccatgaccgttcagcacgccaaatggttgcagcattcacgggagctggagtggcggcggcccgtgcccagcttgaacatcctgctgacctccacttgttggcggaacgatcacaacggtttcagccatcaaggccctggtcttattgacacggttctgtccctgtccagcagcgtcatccgtgtctacttcccacccgatgcgaacaccctgctggtcactgccgaacacatgctcgaaagcaaggactatgtgaatctggtagtgatcgataagcaggaacatccgcagtacctgacgctcgaagaggcgcgggcgcatgcagccgtcggtgcatccatctgggattgggctggacatgaaatactcgggacctcggccggtaaggtcccggacatcgtccttgcatgtgccggagatgttcccacgcaggagacgttggcggctgcgtggctcctcaggcggcatgttcctgagatgtccgtccgggtagtcaatgtcatggatgccatggtcttgccgccgccagaggcgcatccgcatgggctgtctggtgagaagtttgaagaactcttcaccgctgatgtggatgtcgtgatggcctggcatgggtacgcgagggcactgcaccagctcctgcatggtcgcccgcatcccgagcggttccatgtccggggatacaacgagcaaggcaccaccaccacaccattcgacatggtggtactgaacaaggtcagccgataccacctggtgatggaagccctgcgccggactcgcggtcaattcccgggggcagagcaactgctggagcattgccggcagcagttggacgcccattccctctacatccgcgagcactttgaggacctacccgaaatcagggattgggtgtggacgcagcagcagtag

SEQ ID NO: 88 - DNA, 2625 bp, Propionibacterium freudenreichii subsp. shermanii type strain CIP103027T
atgagttctgttccgagcctgagtatcgacgagatgcaccaggtggatgcctggtggcgcgcgtgcaactatctggtcgccggccagatctacttgcaggaaaacccgctgctgaagcgtccactgacccccgaggacatcaagccacggctgctgggccactggggcaccagcgctggcctgggcttcatctatgcccacctcaaccgactgatccgccacacgggtcaggacatgatctacatcgccggccccgggcacggcggaccggcactcgttgcggccggctacctggagggcacttacaccgagatctatccgcgggtcacccgcgacgaggagggcatgcggcggctgttccggcagttctccacgccgggcgggatcccctcccacgcctcggtcaccaccccggggtcgatccacgagggcggcgaactcggctacgccctgtcacacggcttcggtgccgtcttcgacaaccccgacctcatcgcggccaccgtcgtgggcgacggggaggccgagacgggcccggcggagggcggctggaagggcatcagcttcctcaacccggtcaccgacggggccgtgctgccgatcctccacctcaatggcgccaagatctccggacccaccgtgcaggcccgcaaggagccggtggagctgcaggagctctacgagggccacggctacgaggtggtgtgggtcgagggcagcgacctgccctggatgcacgcccgctttgccgacgccctgacctattgctacgaccggatcaaggagatccaggccgaggcacgcggcgggagctgggacggcgaaatgccggcatggccgatgatcatcctgcgcagccccaagggctggaccggaccccggatcgtcgacggcaaccaggtggagggtacctggcgtgcccaccaggtaccgctggcgggcgtcaagaccaacgcggcccatcgtgagcagctcgaggactggatgcggtcctaccgcatcgacgagttgttcggtcccgatggcaccccgaccgagctcgtgcgcgccaacaaccccgagggcaccaagcgcatgagcgcctccccctatgcgaacgggggagtgctctcccaggagctcgacctgcccgatttccacgactacgccgtggacgtcacgccgggaacacgcgccaccgagcggctcgaatcgacccgcaagctcggcgagtacatgcgcgacatctacacgaggaatccgacgaacttccggctcttctgccccgacgagacaaactccaaccgactcggcgcggtcttcgaggtcagcgaccgcaccttcatggagcccaccgacatgctcgacgtcaagctgtcgaacaccggacgcgtcatggaggtgctctcagagcacaactgccatggctggctcgacgggtacaccctcaccggacgccacggcatgttcgccacctacgaggccttcgcgatggtctcggcgtccatgacgatgcagcaggccaagtggctggagggggcctacaacctggagtggcgggccaaggtgcccagcaccaacatcctgctgagctcgacctgctggcgcaatgaccacaatgggttcagccaccagagtcccgagttgctgtcgctggtgttgaacatgcgcggcacggtcagccgcatctacctgccaccggacgcgaactgcctgctcgacattgccgaccactgcttcaagtcgcgcagctatgtgaacctgatcgtgcaggacaagcagccccaaccccagtggctgtcaatgcccgaggccgtcgagcactgcacccgtggctacggcatctgggattgggcgggcaccgacgggctgggcgacaccaagcccgacatcgtgatcgcctgtgccggcgacgtggtgaccatggaggccatcgcggccgctgagatcctcaaggtggccctgcccgaactcaaggtgcgggtggtgaacgtggtggacctcatgagcctctaccggcccaaggaccatccgcacggcatgagcgtgaaggacttctccgacaccttcaccgacgacgtggacgtgatcttcgccttccacggctatcccggagcgatccaccagctcgtgcacggacgccccgatgccgaccgcttccgggcacgcggcttccgcgagcagggcaccaccacgacccccttcgacatggtggtgcgcaacaaggtggaccgctatcacctggtgatggatgcgatcaacaacgcccattaccgtcccgagggcagccacgagctgtaccagtggtgcgaatcccagctggtgcgccacagcgagtacatcgtggagaacctgcaggacatgccggagatccgtgactggcaactgggtgatgacgcctccggcacggtcacccagttcggtggcaagcaggtcgcgccacgtcccggtgccgggacggtggcccggcgcgccgggggcaagggcaccgtggccaaggcacaggccgccgacacgcccgcagcccgcggtgccgatgtcggggacaccggtaagcaggcccagcccggagcggacgccccgtcgaagaaggacgcggatgtgaagaagggcactgatttgaagaaggacacagggccgaagaag

SEQ ID NO: 89 - DNA, 2508 bp, Pseudomonas syringae pv. tomato str. DC3000
atgtatctcttcaactcaacgctttccagcgccgaacaatcggacgccgaatcggttataccccctgaacggccaggcagcgaagtcggaccgctggacgccgatctgctgtcacggctgcatcgttactggaatgccgccaattacctgtgcgtcgggcagatctacctcaaggccaatgcgctgctgcgcgagccgttactggccgagcacatcaagcctcggttgctggggcactggggcacctcggttgggcagaattttatctatgtgcacctcaaccgcttgatctgcgagcggcggatcgagacgattttcatctccggtccaggtcatggcggcccgaccatgaatgcctgcgcctggcttgaaggcacttacagcgaggtgcaccccgagatctcttcggatgaagagggcatgctgggtttctttcgcagcttctccacacccggtggcatccccagtcattgcggcccgcatacgcccaactcactgcatgaaggcggagagctgggctattcgctgatgcacgcctatggcgcggcctttgacaatccccacctgctggtcgcctgcgtgattggtgacggggaagctgaaacctgcccgctggaaggcagctggaaaagtgttcactttcttgaccctcgccgggacggtgccgtgctgccgatcctgcacctcaacggctacaagatttccgggccgacggtcgaagcgcgcttgccggacgagcagttgctcgagctgtaccgggggcggggttatcagccgattatcgtcgcgggtgatgacttgccaggcatgcatcaacggtttgccgccgcactcaatacctgtcacgacgcgatccgcgaacaacaggcgcgctccagaaaggacggtggcgctgcgcgtgcacgctggccgatgattatcctgcgcagccccaagggctggaccgggccgaaagtggttgatggtgtgccggtggaaggcacgtttcgcgctcatcaggtgccgctggccaatgtcatcggtaacccgcaacacctccagcaactggagagctggatgcgcagttactcgcccgagacgttgttcgatcagaagggccggttgttgcccgagcttcaggcgctgaccccgccatcggcgttgcgcatgggcgccgtaccaagtgtgaatggtggccgcgtgctggtagcgctggagctaccgaactttgccgactatggcctggaggtgccaggccccggccaggtcatcgccgaagcaccgcgccgcctgggcgagtacctgcgcgatgtgatgcgtaacaacccgcataacttccgagttttcgggcctgacgagaccaactccaatcgactcaacgctgtgttcgaggccagcaaccgtaccgcggcagggccctgcctggagattgacgaacacctggccacggagggccgggtgatggaagtgctcagtgagcacttgtgcgaaggatggctggagggttacctgctgactggccggcacggcatgtggtcgacctacgaagcgttcgcccaggtggtcgactccatggtcacccagcatgccaagtggctgcagcaaagccgcgagtttgcctggcggcgtccgttggcttcgctcaacattctgatcagcagccacgcctggcgtaacgaccacaacggtttcagccatcagtccaccgggttcgtcgataacgtgttgcaacgccgggccgatgtggtgagggtgtattacccgccggattccaattgcctggtcaacgtcttcgaccactgtctgcgcagccgcaactacgtaaacgtcgtgacctgcggcaagcagccggactttcaatggctggatttcgacgcagcgctcaagcattgctcccagggtgcgtcgatctgggacttcgcaggcagtgacgacggtgagcagccagatgttgtgctgggctgtgccggcgatgtaccgaccaccgaggcagtagccgcagcctggttgctgcaaaaacacgtgccgggtattcgggtaaggctggtcaatgttgtcgacctcggcattttaagcgcgccagaagatcggccgcatggcatggaccatgtgtcgttcgaggcattgtttacccgagacgcgccggtgatgttcgcgtttcacggttcgacctgggtgatccattccatggtgcatggccgcgccaatgaggcacgctttcacgttcgtggtttcagtgatcgtggcaccacgacgacgccattcgacatggtggtgctcaaccgcctgagccgttatcaactggccatcgacgcattgagccatgtaccccggttacgcgcgcagagtctggatgcagtgcattttttcgaaagtcagttacgcaagcatcacacctggatacgcgaacattttgaagacatgccggagatccgcaactggagctggacggccgatttcagcgaatctcagacaccgccgccattggccaaggggcacagccgagggcagacatttaccgatgcgtga

SEQ ID NO: 90 - DNA, 2364 bp, Chitinophaga pinensis DSM 2588
atggcaacactcactaacgaacaagtacataacatacaggcttactgggaagcatccaattatctcgcagcagcacagatctatctgcaggataatccattgctgaaagatccgctgctgaccggccacatcaaaccaaggctcttaggtcactgggggacttctccaggtttgaactttatttatgtgcatcttaacagactcattaaatccagcgatgcagatatcctgttcatctgtgggcccggacacggcgcaccagcagttcttgcacagacctggctggaagggacctatacggagacctatcctgaaattacacaggatgaaaaaggaatgagacagttcttccggcaattctccacacctggaggtattcccagtcatgtgagtgcacatacacccgggtctgttcatgaaggcggtgaactaggctattccctggcacacgcagcaggtgcggtaatggataatccccatctcatagcagcctgcgtagttggtgacggagaagctgaaaccggtccgctggcaggtagctggaaacagaactgtttcctcaatcctgcacgcgatggagctgtattaccaatactgcatctcaacggttataaaatatccggtcctacagtaatggggcgtatgccggatgatgcactcgccaccttatttaacggatacggttacgcgcctttatttgtacgcgcggcagatacgatcggcacacatcaggaaatggccatggcgctcgacacagcttatgaacgaattagagcaatacagcaatatgccagagatggaaagaaaacagacgaacgtaccttatggccgctcattatactccgttcccctaaaggctggacaggtcctgtcatgtggaaaggtaaaccggtagaaggaacgttccgctcccaccaggtaccactgcccgatgtcagggaagatcaggaccagctggccctgctggaacaatggttacgcagttatacaccggaaaaacactttacagcaaatggcgctccacaggctgcactgaaggccctcgctcccattggtgacaaacgtatgagcgctacgccatacgccaatggcggcaaagatgcgcaagcgctggtgatgccggatttcaaaaactatgcggtaaccgtgaatgctcctggtgttattattgccgaaggcacacgtgaactgggaaagatgctacgcgatattttcgaactgaatgaacagcagcaaaacttccgtgtgttctgtcctgatgaaacgacttccaacagactgaacgcggtgtttgaagtcactaagcgctgctttatggagcacctgattgatatagatgatcatttatcccctgatggcagggtcatggaagtattgagcgaacatctctgtcagggctggctggaaggttatctgctgaccggcagacacggtgttttcccttgttatgaagcctttatcaccattatcgactccatgtttaatcaacatgcaaaatggttgaaaacatgccgggaaatcccctggagaaaagaccttccctcgctgaattacctgctgacttctcatagctggcgacaggatcacaatggatatagtcatcagggaccaggttttattgataccgtcgccaataagaaaagcaacgttatccgtatctatctgccccctgacgcaaactgtctgctgtctgtcatggatcactgcctgaaaagcaggaactatgtcaatctggtggtagcaggtaagcaacctgccctgcaatggcttaatgtggaagacgcagcgaaacattgcgcacagggtgcttctgtgtgggaatgggccagtaatgacaatggtcagcaacctgatgttgtactcgcctgtgccggagatgtgcctacacttgaaattatcgcagcagcatggttacttaggaagcatttacctgacttaaaagtaagagttgtgaatgtagtggacctgatgtcgctctctccgaaagattaccatccgcatggactggaggctgcattatttacctcacttttcacggacgatacacccgtagtatttgcctttcatgggtatgtaaggattgtacatgacctcgtacatggacggccgcatccggcaagattccacctgagaggattcatggaagaaggcacgaccactaccccgtttgatatggtcgtgctcaataaaatgagccgcttccatctggccattgccgccatccagcggacagaaagacagctggaaaaagcagacgaagtgatcggctattttgaagataaactgagtatgcacaacatctacatcagggaatgcctggaagatatgcctgatatcagtaactggaaatggagtgatgaataa

SEQ ID NO: 91 - DNA, 2430 bp, Methylacidiphilum infernorum V4
ttggggacattcaaaaacaaattcgaggcaagaacaccgaagacaaggaggcatcccatgagcgctgagctggaaaacatcgatctctacgtggagtattggaatgcggcaaactatctttcagcagcccaattttatttaaaagaaaacccccttttgcgcgtccctttaaaatccgaacaccttaaaccccggatccgtggacattggggatctgctcccggtcttaatctcatttacgtccagctcaaccggttaatccagaaaaccaactcccaattccttttcataaccggtcccggccattgttcatcggcaatactcgccaatctctacctggaagggacctatacggaattttacccggaaataacccaggatatcgatgggcttaccctcttttgcaggcaattctcgtctcctggaggggttcccagccacgtgagcgcgatgacacccggatcgatccatgaaggaggggagttgggttattctcttctgcacgcctttggagcggcctttgatcatccagagcttattgttgctgcagtggtaagcgatggggaagcggagacgggacccctagccgcaagctggcaatcgatcaattttctgaatccttccagggatggagccgtccttccctttttccacgtcaatgacggtaaactctcgggtccaaccctttttggaaggatggaggatcaagatatagccctctatttttccggtttaggatacgagcctttctttgtttgcggcagtgatccctacaaggtccacacagagctagcccaggttctcgataaagcttacttggccattcgacaaatccaaaacgaagccaaggaaaagaggctgaagggtaagcccaaatggcccatcatcatattcaggactcccgacggatggacgggaccaaaagaagtagatggagtacggatcgaaggcacctaccgttctcataggagcccgctcatggacgtgcgagaaaatcctgaacatttaaaaattctcgaatcttggctcaaaagttaccatcctgaaaagctttttgatgaaaaaggaaagctcagagaggatctgcaagccctcgccccaaaaggaacccttcggatgggatcaaatccctatgctaatggaggtggcttgctcgtagacttggcgttgcccgatttcaccgaatacagggtgcccgtcaagcaaccggggagctccttttctgaacccacccatgtcttgggaaaatacattcgtgacgtgatgcggagaaatcccaacaacttccgcctattttgtcccgatgaaaccgattccaaccggctctccgcggtattcgaggtaacaaaccgctgttttgtttccaagacgtatccagaggatgaccatctttctccagatggaagagtaatggaaattttgagtgaacactgctgtcaaggatggcttgagggctatctgctcagcggaggacatggcttgttagtctcttacgaagcttttgccatgatcctcgattccatggccagccagcatgccaaatggctaaaactctaccgagagattccttggagaaagcccatagcttccttaaactatcttttgtcttcccacgtttggcggcaggaatatgatggttatactcaccagggaccgggatttatcgataccctgatcaacaaaaagggccatgtaatcaggatatatctccctgccgataccaataccctgctcgccgtgatggatcactgcctaagaagcagaaactatattaacctggtcatcgccgaaaaacaaccttccctggactggttagacatgaacgaggctcgggcccattgcgcccggggagcttctctatggtcgtgggcaagcaatgacaggggcaatccagacattatcctcggatgtgccggggatgtccctaccctcgaaaccgttgctgcttcttggcttttgcaaaagcattttcccgagctcaaggtaagagtcgtgaatgtcgttgacctcatgaccctttctcccccagcctaccatccccatggaatggatgatatcaatttcattaatctctttagcgcttctcaacccgtacttttcgcatttcatgggtatccccggatggttcacgatcttgttcatggaaggcccaatcccggcagatttcacgttcgtggctaccaagaagaagggacaaccactacatctttcgacatggttatattaaacaagatgagtcgatacaatttggctattgacgccatcaagtatgctctcaaggggattccccatcttcgaagcaaagccgaagaattaatcggtttctttgaacagaagatcgtcgaacactcgacctttgtccggacgcatctcgatgacatgcccgagataaaaaattggacatggtctaacccggcggcggagcagtag

SEQ ID NO: 92 - DNA, 2409 bp, Cyanothece sp. PCC 8801
atggtagccacacccgaaagaccaactttagaacaaactcccctttctgcggaagaattgcgtcaaattcaggcttactggcgagcttgtaattatcttgctgttggtatgatctatttgcgggataatcctttacttaaagaccctttaacagaagaccacgttaaaaaccgcttattaggccattgggggtctagtcctgggttaagcttcatttatattcacctcaaccgactgattaaaaaatacggacttgatgttatttatatggcaggacctggacacggtgccccaggaatattaggacccgtttatcttgaaggaacctactccgaaacttaccccgataaaagcgaagacgaagaggggatgaagaagttctttaaacagttttctttccctgggggtattggtagccattgtaccccagaaacccctggatcaattcatgaagggggagaattaggctatagtctttcccatgcttacggtgctgccttagataaccccgatctcattgtagctgcggtggtcggggatggagaagccgaaaccggaccgttggccactgcctggcattctaacaaattcattaaccctatccgtgacggtgcagttttaccgattttacatctcaatggttataaaattgctaatccaactattttagcccgtattagtcacgaagaattagaatatctcttcaaagggtatggttataaaccctatttcgttgaagggtctgaccccgaagtgatgcaccaaaaaatggccgcgactttggaaactgcgatcgcagaaattaaacacattcaacaagaagcacgcaccagtggagtcgctaaacgtcccatctggccgatgattgtgctacgctctcctaaaggatggacaggacctgcctcagtggacggcaaaaaaaccgaagatttttggcgatcgcaccaagtccccttatcaggaatgcacggcaaccctgcacacatcaaagtcctcgaagactggttaaagagttacacacctgaagaactctttgatgagaacggaacccttattcccgaattgaaagaactcgcacccacgggacaccatcgcatgagtgccaacccccacgctaacgggggtttattgcgtaaagacctaaaaatgcctgattttcgtaattatggggtagaagttgccaaaccaggaaccgtagaagtgggaaatacggctttattggggaattttctacgggatgtcatggccaataatatgaccaatttccgcgtttttggtccggatgaaaccgcatctaaccgtctcaatgctatctacgaaatcagtaaaaaagtctggatgggtgagatcttacctgaagatgcggacggaacggaaattactaccgatggacgggtcatggagatgttaagcgaacataccctccaaggatggttagaaggctatttattaacgggtcgtcatgggtttttccatacctacgaagcatttgctcatgtagtggactccatgtttaaccaacacgcaaaatggctggatatctgtaaaaatgaggttccctggcgtgcttctgtctcttctttgaatatcttactctcttcgacagtttggcgacaagatcacaacgggtttagtcatcaagatccagggtacgttgatctggttactaataaaagtgcagacgtggttcgcgtatactttccccccgatgctaactgtttattatcagtagctaatcactgtttaaagagcaaagactacgttaatgtcatcgtctctgataaacaggtacatctccagtatttgaacatggatcaagccatcaaacattgtaccaaaggcattgggatttgggattgggcgagtaatgatgattgtggcacagaaccggatcatcctgatgtgattatggcctcttgtggtgatgttgccacgaaggaagctttagcggcaacggctattttacgcgaagaatttcctgatttgaaagtgcggtttattaacgtcgtagacttgtttaaattacagtctgaaatagaacatcctcacggactttcagatcgagattttgataacttgtttaccaaagataagcccattattttcaattttcatggctatccttggttaattcataagttaacctatcgtcgcaccaatcaccataatctccatgtacgcggttacaaggaaaaggggaatattaatactcccttagaattggcgattaataatcaaattgaccgctttaatttggtgattgatgttattaatcgtgtgcctaaattgggatcagcagcagcctatgtttatgaacgcatgaaaaatgcgattattgaacatcgcgcctatgcctatgaacatggtatcgataaaccagagattaataactggaaatggcctcattaa

SEQ ID NO: 93 - DNA, 2409 bp, Cyanothece sp. ATCC 51142
atggttgcaaccccgaataaaccacaaatacaagaaactcctttatctcccgaagaattgagaaaaatccatgcttactggcgagcttgtaactacctagccgttggtatgatttatttaaaagataatcctttactcaaagaaaccttaaccgaagaccatgttaaaaaccgtttattaggtcattggggttcaagtccaggattgagttttgtctatatacatcttaatcgtcttatcaaaaaacatgacttagatattgtttatatggcaggtccaggtcatggtgcgccaggtattttaggaccggtttatttagaaggaacctactcagaagtttaccccgataaaagtgaagatgaagaaggaatgaaagcctttttcaaacaattttctttccctggtggtatcggtagtcattgcaccccagaaacccccggctcgatccatgaagggggagaattaggttatagtttatcccatgcttacggttctatcctagataacccggatctgattacggttgctgtggtgggagatggagaagcagaaaccggacctctggctacggcttggcattctaataaatttattaatcctatccgagatggtgccgttttacccgttttacacctgaatggttataaaattgctaatcctactattttagctcgtatttctcacgaagaattagaatgtctctttaaagggtacggttataagccttattttgtggaagggtctgagcctgagattatgcaccagaaaatggctgcaaccctggaaaccgccatttcagagatcaaagccattcaaaaagaagcccgtgacacaggcgtggccaagcgtcctatgtggccgatgattgtgttacgttctcctaaagggtggactggaccgaaagaagtggatggtaaaaagaccgaagacttctggcgatcgcaccaagtccccttatcgggaatgcacaacaaccccgaacacatcaaaatcttagaagactggttaaaaagctataaacccgaagaactctttgatgaaaacggtacattaatcccagaattaaaagacttagctcccacaggacaccgtcgcatgagtgccaccctttacgctaacggtgggttattaagaaaagacctgaaaatgcccgattttcgggagtatggcgtagaagtggaccaaccgggtgcagtagaagcggaaaatactcgacccttgggtgtgtttttacgggatgttatgagaaataacatgaccaccttccgagtatttggacccgatgaaaccgcttctaaccgtcttaatgctatttatgaagtcagcaaaaaagtatggatggctgatatcattgatgcagatgcagacggcacagaaatcaccaccgatggccgggtgatggaaatgttaagtgaacataccttacaaggttggttagaagggtatttattaaccggtcgtcatggctttttccacacttatgaagcgtttgcccatgtggttgattcgatgtttaatcaacacgcaaaatggttagatatctgcaaaaatgaagtgccttggcgtgcgcctatttcttctttaaatattctcctttcttcaacggtttggagacaagatcataacggtttctctcaccaagatcccggatatgtggacttagtaacgaacaagagtgctgaggtggttcgggtttattttcctcctgatgtcaactgtttattatccgttgctaatcactgtttaaagagtaaagattacgtcaatgtaattgttgctgataaacagaaacatctgcaatatttaagcatggatgaagctattaaacactgtaccaaagggattggtatttgggaatgggccagtaacgatgattgtggaaaagaaccagatgaaccggatgtcattatggcttgttgtggagatgttgctaccagagaagcgttagcagcaaccgctattttaagggaagaatttcctcagttaaaagtccgctttgttaatgtggttgacttgtttaaattacaatcagaatcagaacatcctcatggactttcggatcgttcttttgatactttgtttacggttgataagccgatcattttcaacttccacggctatccttggttaattcataagttgacttatcaccgcactaaccatgataatcttcatgttcgtggttacaaagaaaaagggaatattaatacccctttagagttagctatgaataaccaaattgatcgctttaacttggttttagatgtcattgatcgagttcccaagttaggatcagcagcagcttatgttcaacaacggatgaaaaatgccattattgaacatcgcgcttatgcttatgaaaatgggattgataagccagagatgactaactggaaatggccgttttaa

SEQ ID NO: 94 - DNA, 2409 bp, Cyanothece sp. CCY0110
atggttgctactccaaataaaccacaagtcgaaaaaacccccttatctcccgaagaattgagaaaaatccatgcttattggtctgcttgtaattatctagccgttggcatgatatacctacaagataatcccttactcaaagaacccctaaaagaagaacatattaaaaaccgtttattaggtcactggggatcaagtcctggattaagtttcatctacattcatatcaaccgcctcatcaaaaaatacgatttaaacactatctatattgccggtcccggtcatggtgcgccaggagtattaggacctgtttatttagaaggaacttactcagaaatttacccagataaaagcgaagatgaagaaggaatgaaagcctttttcaaacaattttctttccctggcggtatcggtagtcattgcaccccagaaacccccggatcgatccacgaagggggagaattaggctatagtttatcccatgcctacggttctgttttcgataacccggatcttattagcgttgctgtagtgggagacggagaatctgaaaccggtccattggccacagcttggcattccaacaaatttcttaatcccatccgagatggtgctgttttacctattttgcaccttaacggttataagatcgctaatcctactattttagcccgtgtttctcacgaagagttagaatgtctcttcaaaggatacggttataaaccctattttgtcgaaggttctgatcctgaacagatgcaccaaaaaatggctgcaaccctcgaaactgtgatttcagagatcaaagccattcaaaaagaagcccgtgacacaggcgtagctaaacgtcctatgtggcccatgattgtgttacactctccgaaaggatggacagggccgacagaagtggatggtaaaaagaccgaagacttctggcgatcgcatcaagtccctttatcgggaatgcacaacaacactgaacacctgaaactcttagaagagtggttaaaaagttacaaacccgaagaactctttgacgacacaggaaaactcatccctgagttaaaagacttagcccccactggcaaacgtcgcatgagtgctaaccctaattctaacggtgggttattgcgaaaagacctccgattacccaattttcgggactatgccgtagaagtcgatcaacctggcgcagtggaagcaggaaacacccatcgcttaggagtctttttacgggatgtcatggccaataacatgaacatctttcgtgttttcggtcctgatgaaaccgcttctaaccgcttaacgccgatctacgaagccagtaaaaaagtctggatgggtgagatcatcgatgctgatgcagacggtacagaaattacccccgatggccgagtgatggaaatgttaagcgaacataccctacaagggtggttagaagggtatttattaaccggtcgtcacggctttttccacacctacgaagcctttgcccatgtagttgattcaatgtttaatcaacacgcaaaatggctcgatatttgcaagcatgaagtcccttggcgtgtccccattccttctttaaatattcttctttcttcgacagtttggcgacaagatcataacggattttctcaccaagatccaggctatgtagacgtagtaaccaataagagtcctgatgtggttcgggtctattttccgccggatgctaactgtttattgtctgttaccgatcactgtttgaagagcaaaaactacgttaatgttattgttgctgataaacagaaacatctgcaatatttaagcatggaagaagcagttaaacactgcactaaaggcatcggtatttgggaatgggccagtaatgatgactgtggaaaagaacccgatgaacctgatgtaattatggcttcttgtggagatattcctaccagagaatctttagcagcaacagctattttacgggaagaattccctcacttaaaagtccgctttattaatgtagtggacttgtttaaattacaaccagaatcagaacaccctcacggtttatccgataaagattttgatactttatttaccacaaataagcctatcatgttcaattttcatggctatccctggttaattcataaattaacttatcgtcgtaccaatcatcataatcttcatgttcgtggctacaaagaaaaaggcaatataaacacgcctttagagttagcgattaataaccaaattgatcgttttaacttagtgatagatgtgattgaacgagttgataagttaggatcagcagcagcttatgttcagcaacggatgaaaaatgccattatcgaacataaagcctatgcttatgaacatggtcttgacaaaccagaaatttctaattggaaatggccactttag

SEQ ID NO: 95 - DNA, 2409 bp, Planktothrix rubescens NIVA-CYA 98
atggtatctgcaccagatagacccatggagacgagtaaccctctgagtgaggatgaactgcgtaagattgatgcctactggcgagcttgtaattatctagccgttggcatgatttatttacgagaaaatcctttgttaaaagaatccctaaagccctcagatgtcaaacatcggctgttaggacattggggttccagtcccgggttgagctttatctacattcacctcaaccgactgattaaaaaatacgacctggatatgatttatctagctggcccaggtcacggtgcacccggggtattaggcccggtttacttagaaggaacctattcagaaatttaccccaatatcagcgaagacgccgaggggatgcaaaaattctttaaacagttctcgtttcctggtggtattgggagccactgtaccccagaaacccccggttccatccatgaagggggcgagttaggatatagtttatcccacgcctacggttctgtatttgataaccccggcttaatctccgtttgtgtagtgggagacggagaagctgaaaccggagctttagcaactgcttggcattctaacaaatttctgaacccgattcgggatggggccgtattgcctgttctgcatttgaatggctacaaaatcgctaaccccactattttatcgcggattagccatgaagaattggaagccttatttaaaggttatggctataaaccctattttgtcgaagggtgtgaccccgcattgatgcaccaaaaaatggcagatatcctggaaacagccatttctgaaattaaagccattcaagctgaagcccggtcaacgggaattgctaaacgtcccctgtggccgatgattgtattgcggagtcccaaaggctggactggcccaacggaggtcaatggccataaagttgaaggtttttggcggtcgcaccaagtgccgatggctgatgtcaccaccaaccccacccatctcaagttattagaagattggatgcggagttataagcccgaagaactgtttgatgccaatggccgtttaattcctgaactgaaggatttggcccccaaaggtacaaaacgaatgagtgccagcccccatgcaaacgggggtgtgctgcgtaaagacctgcgattgtcggactttcgggactatggtgtgcctgtggaataccccggtaagtccgaggtggaaaataccaaccccctaggaaaattcctccgggatgtgatgcgaaataatctgcaaaatttccgcgtatttggccccgatgaaacggcttctaatcgcttaaatgcgatatatgaggtcagtaaaaaaacctggatgggggactttttaccagaggatttagatgggagtgaactggcaaccgatggccgggtgatggaaatcctgagtgagcataccttagaaggatggttagaaggctatttactcaccggacgtcatggatttttccatacttatgaagcctttgctcacgtgattgattcgatgttcaaccaacacgcgaaatggttggatatttgccgaaatgaagtgtcttggcgatcgccaatttcttctttgaatattctcctatcttcaacggtttggcgtcaagatcataacgggtttagtcatcaagacccgggctttttagatgtggtaacaaataaaagtgccagtgtcacccggatttatttaccacccgatgctaactgtttattatccgttgccgaccattgtttaaagagtaccaattatatcaatgtgattgtggcagataaacagaaacatctgcaatttttgacaatggatgaagccattaaacattgtacaaaagggattggaatttgggaatgggccagcagtgatgactgtggaaaagatcctgatattcctgatgtaattatggcgggttgtggtgatgtggcgacgatggaatctctcgcagctacggcaattttacgcgaagaaattccagatctaaaagttcgatttgtcaacgtggtggatttatttaagttacaacccgatacggaacatccccacggtttatccgaccgagattttgatagtttgtttacgacagataaaccaattatctttaatttccatggctatccttggttaattcacaagttagcctatcgtcggaaaaatcacgcgaatatgcacgtcagaggctataaagagaaggggaatattaatactcctttagagttggcaattaataaccaagttgaccgttttaacctggttatagatgtaattgaccgagtgcctaaattgggttcggcggcggcctatgtccgggaacggatgaaaaatgcgatcatcgaaaatgtcaattatgcccatgaacatggcattgacaaagatgaaatagttgactggaaatggccgttttaa

SEQ ID NO: 96 - DNA, 2418 bp, Arthrospira maxima CS-328
atggtggcagcaccctctcaaacgttagagacaacctatcctctcagtgacgaagagatccggaaaactcatgcctactggcgtgcctgcaattatctttgtgtagggatgatctacctgcgagataatccgttactaaaagaacccttaaaacctgaacatatcaaatatcgccttctgggtcattgggggtctagtcccggtttaagttttatctacattcacctaaatcggctaatcaaaaaatatgacctgaatatgatctatattgcgggtccaggacacggcgcaccgggtgttctcggtccagtatatttagaaggaacttactcggaggtttacccggataaaagtcaagatgctgaagggatgggaaaatttttcaaacagttttcattccctggcggtatcggtagccattgcaccccagaaaccccaggttctatccacgaagggggggaactaggttatagcctctcccatgcttatggtacagtatttgaccatccagaactgattaccgcggctgtggtgggagatggagaagcggaaacgggacccctagcaacggcttggcattccaataaatttatcaatcctatccgtgatggtgcggtgttgccgatactacacctaaacggctataaaatcgctaaccccaccattctctcaagaattcccaacgaggaacttaaaaacctattccgaggctatggttatactccctatttggtggaatgtagccaagatgaggattatgggtcggctcatcggaaaatggctgcgaccctagaacattgtatcaacgaaattcgcgatattcaacaacaggctcgtagcagtggcaaggctacccgtccccaatggccgatgattattttgcgatcgcctaaaggttggacaggtccgaaggaagtagacggtcgcaaagttgaaggtttctggcgcgcgcaccaagtccccatgtctaatgtcattgggaacccccatcaaatgaaaatcctagaagactggatgcgaagttaccagccagaagaactctttgatgaaaacggaactcttattcctgaactcaaggaactagcgccaacgggtgtccgtcgcatgagtgctaacccctttgctaacggtggtatttggcggcgtgacttaaatatgccagacttccgtaagtatgctgtagaggttcctaaaccaggtcaaagtgaggcggaaaacactcgacctctcggcaatttcctccgggatgtcatgggtaaaaatatgacgaattttcggatgtttggacctgatgaaactgcctctaatcgccttaatgctgtctatgaagtcagtaaaaaaacctggatgggtgagtttttagaggaagacttagacggtagcgaattagccgctgatggtcgggttatggaaatgttaagtgagcataccctccaaggctggttagaaggctatttgctgactggatgtcatggtttcttccatacctatgaggcttttgctcatgtggtcgattccatgtttaaccaacacgctaaatggttggaagtctgtaaaaaagaggtgccttggcgttctccgatcgcctctctgaatatcctactctcttctacggtttggcgacaagaccacaatggttttagtcaccaagatcccggttatgtggatttggttactaataagagtcctgatgtggttcgggtttattttccccctgatgctaattgtttactgtcctgtgctaatcattgtctccaaagcaaagattatgtcaatgtcattgtggcagataaacaaaaacatctacaattcctgaatatggatgatgctattaagcattgtactaaaggaattgggatttgggaatgggctagtaatgatgattgtggtaaagaccccgatattcctgatgtggtgatggctggttgtggtgatgtcgccactaaggagtctttggctgcgaccgccattctccggtcagaatttccggagttgaaaattcgctttattaatgtggtcgatctgtttaagttacaaccggatactgaacatccacacggtttgtctgattgggattttgatagtttgttcactactgacaaacctattatctttaatttccatggctatccttggttgattcataagttggcttatcgtcgcactaatcaccccaatttgcacgtgcgcggctataaggaaaagggtaatattaatacacccttggaattggcgatcgaaaatcaggtcgatcgctttaatttggtgattgatgtcattgacagagttcccaaattgcgatcggcggcggcttatgttcgggaacgcatgagaaatgctatcatcgaaaatgtcgcctatgcctacgaacatggtcaggatcaggaggaaattagtaattggaagtggcctttttag

SEQ ID NO: 97 - DNA, 2409 bp, Cyanothece sp. PCC 7822
atggtagcagcaccagagaaacccattttagaacagcagcccttatctgctgaagaactgcggaaaatagatgcttactggcgtgcctgcaattatttagccgttggtatgatttatcttaaagacaaccccttgctcaaaagacccctgcaaccagaagatattaaagctcgtctgttgggacactggggaacctcacccggcttaagctttacctacgttcatcttaaccgcctaattaaaaaatatgacctagatatgatcttcttagccggacccggacatggcgcacccggggtactcggcccagtgtacttagagggaacctattcagaaatttaccccgataaaagcgaagacgaagaagggttgcaaaaattcttcaaacagttctcttttccgggccacattggaagtcactgcacccctgaaacccccggctcaattcatgaaggcggggaattaggttatagtgtttctcacgcctacggtgctgcctacgataacccgaatttaattgtatcagtggtggtgggtgacggagaagccgaaaccggacctttagcgacggcttggcactccaataaatacctcaaccccattcgagacggggctgtattaccgatattgcacctaaacggctacaaaattgctaaccccaccattctcgcccgcattagtccagaagaactcgaaagcctctttattggctatggttacactccttatgtagtagaaggagatgaccctcacatcatgcaccaaaagatggcagctaccgtagaacagtgtattacccaaattcgcagcatccaagaagaagcccgcagtagcggcgtggcaaaacgtcctcgctggccgatgattatcttgcgtactcccaaaggatggacaggacccaaagaagtcgacggcaaaaaagtagaagggttttggcgggcgcatcaagtcccgatgggagaaatgcaaaataaccctgaccatttaaaaatgctagaagactggatgagaacttataaacccgaggaactctttgacgagacgggtaaactcattcctgaactcaaagaactcgcacccaaaggcatacggcggatgagtgctaacccccatgctaacgggggaattctgcgaaaagatttaaaattaccggattttcgcgattatgcggtgagtgtctcagcagccggtaaagaggaagtggctaataccggcttactgggtgaatttttgcgggatgtaatcaaaaataaccctacctctttccgtctttttggtcctgatgaaacagcctctaaccgtcttcaagccgtctatgaagtaacccaaaaagcttggttagccaactacttagccgaagatgagggcggcagtttattatcacctgatggtcgagtcatggaaatgctcagtgagcataccttagaaggatggttagaaggctatcttctgacaggtcgtcatgggttatttcatacttatgaagcctttgctcacgtcatcgactccatgtttaaccaacacgctaaatggttagatatctgtaaacatgaagtaagttggcgagtgcccatttcttctttaaatattctcctatcttcggtggtttggcggcaagaccataacgggttcagccatcaagaccccggttttatcgatctagtgaccaataaaagtgcagaagtagtgcgggtatatttgccccctgatgctaattgtctgttatctgtggccgatcactgcctacgcagtaccaattatgtcaatgtcatcgtctctgacaagcagaaacacctgcaatatctgagcatggatgaagccattaaacactgcaccaaaggcataggcatttgggaatgggccagtaatgatgatcgtgataaagaaccggataatcccgatgtaattatggcttgctgtggtgatattcccacgatggaatctttagccgctactgccattttacgcgcagaattccctgacctaaaagtccgttttatcaacgtcgttgatctattcaaattacaatcagaaagcgaacatcctcacgggttatctgagcgagattttgatggtttatttacccaagataaaccgatcattttcaactttcacggttatccctggttaatccacaaattaacctatcgccgcagtaaccaagaacgcatccatgtgcgaggttacaaagaaaaaggcaatattaacacccccctagaattggccattaataacgaaatagaccgctttagcttggtgatcgatgtgatcgatcgcgttcctaaactcggttcggcggcggcttatgtcaaagagcgcatgaaaaacgagatcatcgataacttacactatgcccgcactcacggcatggataaagcggaaattttggattggaagtggccttattaa

SEQ ID NO: 98 - DNA, 2409 bp, Cyanothece sp. PCC 7424
atggtcgcagcaccagaaaaaccaaccatacaacaagaccccttatctgctgaagaactccgaaaaatagatgcttactggcgagcttgcaactatttggctgttgggatgatttatctcaaagataatcctttactcaaaagacccctacaacccgaagacattaaaccccgcttgctcggacattggggaacatcgcccggattaagtttcacttatgttcacctcaatcgactgatcaacaaatatgatttagacatgatttacatggccgggccgggtcatggtgcgcctggggtactcggccctgtttacttagagggaacatactcagaaatttatcccgataagagcgaagatgaagaaggaatgcaaaaattctttaaacagttttcctttcccggtcatatcggaagtcactgtacccctgaaactcccggctctatccatgaagggggagaattaggatacagcgtttcccatgcttacggtgcagcttatgataatccagatttaattgtatcagtagttgtgggagacggagaagcagaaaccggagccttagccacctcctggcactccaacaaataccttaacccgattcgagacggggcagtcttacccattttgcaccttaacggctataaaattgctaatccaacgatcctcgctcgtattacccctgaagaactcgaaagcttatttattgggtatggatacaccccttatgtggtcgaaggggatgatccccacctgatgcaccaaaaaatggccgccaccctagaacactgtatcaaccaaattcgccatatacaacaagaagcccgcagcagtggagtcgtacaccgtcctcgctggccgatgattattcttcgcagtcctaaagggtggacagggccaaaagaagtcgatgggcacaaagtcgaagggttttggcgggcgcatcaagtgccaatgggaaatatgcaaaataatcccgaacacctgagaatgttagaagagtggatgaaaggttatagaccggatgaactcttcgacgagaacggtaaactcattcccgaactgaaagaacttgctcccaaaggacatcggcggatgagtgctaacctccatgccaacggtggggtattacgaaaagatttaagaatgcccgattttcgggattatgcggtggagatttctacccctggcacagaagaagtcgaaaatactcgcttattgggtgagtttttacgggatgtgatgagaaataacatgacctccttccgtctctttggccctgatgaaaccgcctccaaccgtcttcaagcggtatatgaagtgagtcaaaaaacctggatggctgagttttaccctgaagatttagacggaagctacttatcccgtgagggtcgagtgatggaaatgctcagtgagcataccctagaaggatggttagaaggatatctcttaaccggaagacatggatttttccatacttatgaagcttttgcccacgttattgattcgatgtttaaccaacacgccaaatggttagatatttgtaaacatgacgttcattggcgagcttcagtttcttccttaaatattctcctgtcttctgtcgtttggcgacaagatcataacgggtttagtcaccaagatcccggttttatcgatttagtaactaataagagtgcggaagtggtgcgggtttatctccctcccgatgccaattgtttgctctcagtagcgaatcactgcttacggagtaaagactatgttaacgtcatcgtggctgacaaacagaagcacctgcaatatctcagcatggacgaagccattaaacactgtactaaaggaattggcatttgggagtgggcgagtaatgatgaccaagggaaagaaccggacgaacccgacgttatcatggcttgttgtggtgatattcctacaatggaatctttagcggctactgctattttacgggaagaatttcctgagcttaaagtgcgttttattaacgtagttgacctatttaagttacaatctgaaagcgaacaccctcacggattatctgaatgggattttgatagtctctttactcacgataaaccgatcatctttaactttcatggttatccctggttaattcataaactaacctatcggcgtagtaaccaagaacggattcatgtaagaggttacaaagaagaagggaatattaacacccctctagaattagccattagaaaccaagtcgaccggtttaacctcgtaattgatgtgatcgatcgagttcctaaattaggatcagccgccgcctatgttaaagagcggatgaagaacgaaattatcgacaaccttcaacacgcttttgaacagggtagcgataaacccgaaatcgttgaatggaagtggccttattag

SEQ ID NO: 99 - DNA, 2421 bp, Microcystis aeruginosa NIES-843
atggtattcacaccagaaagacccttaacagaacaaaatcccctttctcaagacgaactctacaaaacccatgcctattggcgcgcttgtaactatttagctgtaggtatgatttatctgcgcgataatcccctgctcaaagaacatcttaaacccgaacacgttaagtatcgtttacttggtcactggggagcaagtccggccttaagttttacctacgttcacctcaaccgtttaatcaaaaaatacgacctcgatatgatttttatggccggtccgggccatggggcgccgggggtactcggtccggtttatctagaaggaacctattcggaaatttaccccgataaaagtgaagacgaggaaggattacaaaaattctttaaacaattttcttttcccggtcacatcggtagtcacgtcacccccgaaacccccggttctatccatgagggcggcgaactgggttatagtgtttcccatgcctacggttctgtttttgacaatcccgacctaattacggccgtggtggtgggtgatggggaagctgaaaccggtcccctggccaccgcatggcactcgaataaattccttaacccgattcgcgatggtgcggtactgccaattttaaacttaaacggttataaaatcgctaatcccaccatcctctcccgtatttcgacccacgagttagaaagtctctttgtcggttacggttacactccctacatcgtcgaatgtaaggaagatgaagacctcatgcactgccatcaaaaaatggccgctaccctagaacactgtatcaatcagattcgctcctatcaacaggaagctcgcagcacgggagtggctaaacgttacccctggccgatgattatcctccggtctcccaagggttggacaggtccgaaaaacgttgatggtcataaagtagaaggattctggcgcgctcaccaagtccccatgggtgccatgcaggaaaaccccgaacacttgagaaaattagaggagtggatgaaaagctataacccggaggaattatttgactataccacgggtaaatttaagccagaatttaaagaactggctcctaggggtcatcgtcgcatgagtgctaatccgcacgctaacggcggattgctgcgtaaagacctaaaaatgcccgattttcgtcagtatgccgtagatgtcacccacccgggccaagtggaagcagaaaacacgggagtgatgggggtatttttgcgggatgtaatgcgaaataatatgactaattttcgcgtttttggtcccgatgaaactgcttccaatcgtttagcggctctctatgaagtgactaaaaaagcttggttagctgatacctatccagaggatttagatggtagtcaattatctcccgatggtcgggtgatggagatgctgagtgaacatactttagtcggttggttagagggttatttattatccggtcgtcacggtttatttcactcctacgaagcttttgcccacgttatcgattccatgttcaaccaacacgctaaatggctcgatatctgcaaaaatcatgtgccttggcgcgcttctgtttcctcttggaatctgttattatcctcggtggtttggcggcaggatcacaatggttttagtcaccaagaccccggttttatcgatttagtaaccaataaaagtgccgacgtggtgcgggtttatcttccccccgatggtaactgtttattaagtgtggctaatcactgtctcaagagcaaggattacactaatattatcgttgctgataaacagaaacacctgcaatacttgaccattgaagaagcaattaaacactgcaccaaaggtatcggtatttgggattgggcaagtaacgatgatgatggaactaatcccgatgaaccagatgtaattatggcttgctgtggggatattatcactaaagaatctttagcagcaacggcaattctgcgggaggaattcccttacttaaaagttcgctttatcaacgtggttgatctgtttaaattacagtcggaaagtgaacaccctcacggtttatcagaacgggattttgatagtttatttaccactgataagccaattatctttaatttccacggttatccttggctgattcataaacttacctaccgtcgcagcaatcaagaacgtattcatgtgcgcggttacaaagaagaggggaatattaatactcccctagaattagccattcgtaaccaagttgatcgttttcatttagtaatcgatgtcattgatcgcgtgccgaaattaggttctgctgccggtcatgtgaaagaacgaatgaaaaatgccattatcgataatctcgattatgcttttaccaatggtatcgataaggacgagattactaactggaaatggccttattaa

SEQ ID NO: 100 - DNA, 2415 bp, Lyngbya sp. PCC 8106
atggtaacagcaccaaacattcctacagaaatcaccaatccactcaacgatgatgagttacgcaagacccaggcttactggaatgcttgtcattacctcgcattggggatgatctatttgatggataatcctctgctaaaggaacctctgagacccgaacataccaaaccgcgtttattaggtcactggggcgccagtaccgctctgagcttcatctatatccatctcaaccgcctgatcaaaaaatacgatctcgatgtgattttaatggcaggccccggtcatggtgcgcccggaatattagctccaacctacttagaaggaacctattctgaggtctatcccgacaaaagtgaagactatgaaggactgcgaaaattcttcaagcagttttccttccccggccacattggcagccactgcaccccagaaacacccggttccattcacgaaggcggagagctaggctatagcctttcccatgcttacggggctgcttttgataaccctgacttgattgttacggcagttgtcggagatggagaagctgaaaccgggccactggcaaccgcttggcactccaacaaattcctcaaccctgtccgtgatggtgcagttctccccattctcaacctaaacggatacaaaatcgccaacccgactattttggctcggatttccccagaagaactcgaaagcctgtttgtcggttatggttacacgccctacgtggttgaacacgttgatggagatgatgccagtatcacccatcaaaaaatggccgccacaatggaacattgcgttaaccaaattcgttctatccaagaagaagcccgtcgcaccggagaagccaaacgcccgcgttggccgatgattattctccgcactcccaaaggttggacagctcccaaaaaaattgatggtcataaagtcgaaggcttctggcgggcgcaccaagttcccatgtccgatgtcggcaaaaaccccgatcatctgcggattttagaagattggttactcagctacaaacccgatcaactctttgatgacaacggtaaactgattcccgaactccgagaacttcctcccactggacaccgccgaattagtgctaaccttcatgccaatggcgggatgttgcggaaagacctcaaaatgccagatttccggaaatatggcgtagaagtgcgcgatcccggacggtcagaagcgggaaacacccaaattttaggtgaattcctccgggatgtcatgcggaacaacatgaccaatttccgagtctttggccccgatgaaacggcttccaaccgtctacaagccatctacgaagtcagtaaaaaaacctggttagcagacttcaaagaagaagatctcgatgggagcgaactgtctcccgatggtcgtgttatggagatgttgagtgaacataccctcatcggttggttagaaggctatatccttaccggacgtcatggcttcttccacacctacgaagcctttgctcatgtgatcgactccatgttcaaccaacacgccaaatggttggatatttccaaagaagtaccttggcgagcgccgatttcttcttggaatattttgttatcttcgacggtttggcgtcaagaccataacggcttctctcaccaagatccgggttttgttgatctcgttaccaataagagtgccagtgtgactcggatttacttcccacccgatgttaactgtttactctcagttgcaaatcactgtctccgcagtaaagattatgtcaacgtgattgtggcagacaaacaaaagcacctgcaatacttgacgatggaggatgctgtcaaacactgcacgaaaggaattgggatttgggattgggccagtaacgatgatcgaggcgtagaacccgatattcccgatgtcgtcatggctagttgtggagatatcaccacccgcgaagcgttagccgcaaccgccatcatgcgcgaggagtttccagaactgcgggttcgctttattaacgttgtagatctgttcaaacttcagtcggagtcagaacaccctcacggtttatcaaatcgggattttgacactctgtttactgccgacaaacccgtaatctttaacttccacggctatccctggttaatccataaattggcttatcgtcgcacgaagcaagaacggattcatgttcggggttacaaagaaaaaggtaacatcaatactcccctggaactggcgattaaaaaccaaattgaccgctttaacctagtgattgatgtgattgatcgggttcccaaactgggttctgctgcggcccacgtcaaagaacggatgaaaaacgccattatcgaaaacctcaactatgcctttgaaaacggcaaagacaaggaagatgtcgataactggaaatggccctattaa

SEQ ID NO: 101 - DNA, 2427 bp, Nostoc sp. PCC 7120
atgactatttctccttctaagccaaagtcttcagacgtgaaacaagacaaatctgctccacttagtactgaagaattgtatcaaatcaatgcttactggcgtgcttgcaactatctagctctaggtatgatctatttgcaagataatccactgctcaaacaacccctcaagccaggacacatcaaaaatcgcctgttaggacactggggttcaagtcccggtttgagctttatttacgtccatctcaaccgtttaatcaagaaatatgatttggatgtgatttacattgcaggcccaggtcatggcgctccgggtattcttggacctacatacttagaaggaacctattctgaggtttatcctgataagagcgaggacgaggaaggtatgctgaagtttttcaaacagttttcctttcctggtggcattggtagccactgcacaccggaaacccctggctcgattcacgaaggcggcgagttaggctacagcctctcccacgcttacggtgcggctttcgataacccagatttgattgtgacggcagttattggtgatggtgaagcagaaactgggcctctggcaacagcttggcattccaataaatttatcaaccccattcgggatggtgctgttttaccaatcttgcatttgaatggctacaaaattgctaacccaactatcctagcccgcatcagccatgaggaactagaggacttattcaaggggtatggctatacaccgtactttgtggaagggcatgatccagcgcaagtgcatcaattgatggcagcaaccctagaaacagtgattctggaaatcaaaaaaattcaaaccgaagctaggacttcgggtgtagcaaagcgtcctcgttggccgatgattgtccttcgcacccccaaaggctggactgcgccggcagaaatagacggtcataaattagagggattttggcgatcgcaccaagtaccaattacagatgtagctactaatcctgaccatctgaagattctcgaacaatggatgaaaagttacaagccagaagaattatttgatgagcatggcagtctaattcctgaactcaaagaactagctcctattggtcatcgtcgcatcagtgccaatcccgttgctaatggtggaattctgcggaaagaattgcgcctatccgacttccgcaacaatgcagttgaggtatctaaacctggtgcagttgaggtggaaaacactaagcctctagggaacttcctgcgagatatcatgcgtaataacatgactaatttccgcatattcggcccagatgaaaccgcctccaatcgactcagtgctgtctacgaagtcagcgagaaaacctggttggcagatattctgcctgaagatgcagatggtagtgaactatctaccgacggtcgggtgatggaaatgctcagtgaacataatctgttcggctggcttgagggctatcttttatctgggcgacatggtttgttccacagctatgaagcttttgctcacattgttgactctatgtttaaccagcacgccaaatggctggaaatcagtaaaaatgaagttgcttggcgatcgccgatttcttcagaaaatatcttgctatcctctactgtttggcgacaagacaacaatggctttagccaccaagatccaggattcatagatttggtgacgaataagagtgccaatgttacccggatttatctgcctcccgatgctaactgtctactttctgtagccgatcattgcctgcgtagtaccaactacgtcaacgtcatcgttgcagacaagcaaaaacacctccagtttctcagcatagaagaagcgatcgcacattgcaccaaaggcatcggcatctgggactgggcaagcaatgaccatcatgggcaagaacccgatcttcctgatgtcatcatggcatcttgtggagatgttgtgactatggaagcgttagctgcaactgccatcttaagagatgagttccccgatctcaaggtgcggtttattaatgttgttgacttgtacaagttgcaaccagatacagaacatccacatggattatcagactgggatttcgatagtcttttcaccacagataagcctgtaattttcaacttccacggctatccttggctgattcacaaacttgcttaccgtcgcactaaccatgaaaatattcatgtgcgcggctacaaggaaaagggcagcattaacacaccacttgagttagctatcaacaaccaagttgatcggttcaatctggtgattgacgtaattgatcgagttccgaagctgggttctgctgctgtctatgttagagagcgcatgaaaaaagaaattattaacaaccggaattatgctcacaagcacggtatagatcagccagaaatcctcaactggaagtggccttactaa

SEQ ID NO: 102 - DNA, 2427 bp, Synechococcus sp. PCC 7335
atgactgctattgtctcctctcaatcttctgagtcgattgcttcactagatatcacgccaccatccgaagatgaactgaacaagatagatgcttattggcgggcttgccactatttggcagttggcatgatctatttgcgtgataatccactacttaaggaatctctcaccaaaaagcacgtcaagcacaggttattaggccactggggtgcttctcctgctttgagctttacctatgttcactgcaatcgcctgattaagaagtacgatctagatatgatctttgtcgccgggccaggtcacggtgcgccaggggtactaggtccggtatatctagaagggacttactcagagacctatccagataaaagtgaagatgaagagggcatgcagcgcttctttaagcagttctctttcccgggcgatattggtagccacgtgaccccagagacgcctggatcaatccacgaaggtggcgagctaggctatagcctctctcacgcctatggttcagttttagataatcctgatttaatcacttgctgtgtggtcggtgatggggaatctgaaacaggtccgctcgcaaccgcttggcactctaacaagttcattaatccagctcgtgacggcgctgttctaccggttctgaatttgaacgggtacaagattgcgaaccctaccatcttcgctagaatctcccacgaggagctggagtatatgttcaggggctatggctatacgccctatttcgtagaaggcagcgacccagcccagatgcacaggaagatggctgaaaccatggaagcgtgcatcatcaagattaaggaagtccagcgagaagcaagagttaatggcaatgtcaagcgtccgcgctggccgatgattgtattgcgatcgcccaaaggatggacaggacccgatcaagtcgatggcaaaaaggtagaagatttctggcgatcgcaccaagtgcccatgggcggtatgcacagcaacgaagaccacctgcgaaggctagaagcctggatgcgtagctacaagcccgaagaactctttgacgaaaacggcacacttgtccctgagctaaaagagcttgcgcctaaaggaagccgccggatgagcgcaaatccccatgccaacggtggcctgctccgcagagcgctaaagatgccgcgtttccaagactatgccatccaaatggaacggcacggcgtagaggaatacgagaatacgaaagtgttgggccagctcatgcgcgatatctttcgcgataatcctaacaacttccggctaatggggcctgatgagacagcctccaatcgattgcaagacgtctacgataccactaagaaagtgtggatggcagagctatacccagaggacgaagacggtggcaacctcgcccgagatggccgggtgatggagatgctgagcgaacacaccttacaaggctggctagaaggctatctgctaaccggacggcacggactctttcatacctacgaagcctttgcccacgtagtcgattctatgttcaaccagcatgccaaatggttggatatctgcaaaaatcacgtcccctggcggcagtcggtctcatcgctaaatatcttgctctcttctctagtatggcggcaagaccacaatggatttagccaccaagatccaggctatgtagatctcattacgaacaaaagcccagaggttgttcgtgcctatttcccaccagatgcgaactgcctactttcagtcgctgatcactgctttcgcagcgttgactatatcaacgtcatcatctctgacaagcaaaagcatctacagtatctaccgatggatgaggcgattcggcactgtaccaaaggtattgggatctgggactgggctagtaatgatgactgtggtaccgagccagatgttcctgatgtagtgatggcttgctgtggcgatatccctacccaggaggctttagcagcaactgctatcttacgagaagagtttccctccttgaaagtgcgttttatcaacgtggttgatttgtttaagctgatgtcagagggcgaacatcctcatgggctatcaaacagagactttgactctctgtttaccccagacaagccagtcatcttcaactttcacggttatccctggctgattcacaaactggtgtatcgtcgctctaatcaagatcgcattcatgtacggggctacaaggaagaaggcaatattaatacgcctttggagctagccattaataaccaaattgataggtttggcctcgtgattgatgtaattgacagagtaccgtctctaggatcggcagcgggccatgtaaaagagcgcatgaagaacaaaatcattgaatgtttaagctacgcgcatgagcatggtacagacccagaagagctggtgaactggaagtggccctattag

SEQ ID NO: 103 - DNA, 2421 bp, Acaryochloris marina MBIC11017
atggttcacactcctgttgcccccacatccagacccctcagcgaattagagctgcacaatattgatgcctactggcgagcctgcaactatctggccgtgggcatgatctacctacgcgataaccccttgttgaaagaaccgctccaatctgcccatgtcaagcatcgcttactgggacactggggtgcctctccagccctgagctttacctatattcactgcaatcgactgattaaaaaatatgctctggatatgatctttatggcgggtccaggccacggtgcaccgggtgtcctggggcctgtctacttggaagggacctattcagaaatttatcccgataaaagcgaagattcagaagggatgcggcggttctttaagcaattttctttccctggctttatcggcagtcatgtcacccctgaaacccctggttccatccatgaggggggagagctgggctatagtgtttcccatgcctatggtgctgtcttagataatcccgatctcattgtgacttgtgtagtgggggatggtgaagcggagaccggccccctagcaacgtcttggcattctaataaatttatcaatcctgctcgggatggggcagtgttgcctgtactcaacctcaatggctacaagattgccaaccccacccttttggcccgcatctcccatgaagagttggaatatttattccgaggctacggctacactccttattttgtcgaaggcaagaatccagcggaaatgcatcaaaagatggccgccgtgatggaggaatgcattctcacgattaaaaaggtgcagagagaggcccgtatcaacggcaccctggagcgcccccgctggccgatgattgtcctacgcacccccaagggctggaccggtcccaaagaagtcgatggtaaaaaagtcgaagatttttggcgatcgcaccaggttcccatgggtggtatgcaggataaccccgatcacctgcaacagctggaagcttggatgcgcagctacaagccggaggagctgtttgacgaacacggaaccttaattcctgaattgaaagccctaaccccggtcggtaatcggcgcatgggatcgaatccccatgccaatgggggtttattgcggaaggccctaaaacttcccagcttccaggatctagcgattgatattggggagcaacatggcaccgtcacctttgaaaacaccaaggctttagggatatttatgcgggaaattatccgtaagaatcccaacaactttaggttgatgggtcccgatgaaacggcctccaatcgtctccaagatgtgtatcaagtcacgaagaaagtctggatggcagacctatatccagaagatgaagatgggaccgaactgtctcgggacggtcgggtgatggaaatgctcagtgagcatacgctacagggctggctagaaacctatttattaacgggacgccatggtctattccatacctatgaagcctttgctcatgtcgtggactcgatgtttaatcaacatgcgaagtggctggatatctgccgcaatcatgtcccttggcgacggtcggtatcgtcgttaaatattttgctctcctccctggtttggcgtcaggaccataatggctttagtcaccaggatccaggctatgtggacttggtaaccaacaaaagtccagatgtggtgcggctttactttccaccggatgctaactgtttgctgtcggtcgccgatcactgttttcggagtgtggactatatcaatgtgatcatttcggataaacaaaaacatctacagtatctgtccatcgatgaggcggttgctcactgcactaagggcatcggcatttgggactgggccagcaatgatgactgtggcactgaacccgatgaacccgatgtggtgatggcttcctgtggcgatattcccaccatggaggcgttagcggcaacggccattctgcgggaagaatttccttggctgaaggtccgctttgtcaatgtagtggacctatttaagttagtgtctgaaggcgaacatccccacgggttatctgatcgggacttcgattctctgtttacgcccgataaaccaatcatttttaactttcatggctatccctggctgatccataagttggtctatcgccgttctcaccaagagcgcattcatgtgcggggctacaaggagcagggcaatatcaatacgcccctggagttagcgattaaaaatgaggtggatcgctttaacctggtgattgatgtgattgatcgggtgccaaagctggggtcggcagcgggccatgccaaggaacggatgcgcaacaagatcatcgaatgtctcgcctatgcccatgagcatggtaaggatcaagatgagattgtcaactggacctggccctatgttggagtctgtgaataa

SEQ ID NO: 104 - DNA, 2478 bp, Synechococcus sp. PCC 7335
atgactgcttcagtccctgctcagatcagcgttgaaaatttaccactttctactgaggaactgcgaaaaatagatgctttctggcgagcctgtaactatcttgcaatcggcatgatttatctgaaggataatccgctgctaagagcaccgctggccgcagagcatatcaagccgcgcctgctagggcattggggcaccagccccggtttgagtctgatgtatgtccactttagtcgcctgatcaaaaaatacgatctaaacgctattttcatggccgggccgggacatggtgcgccaggtgtgctggcgcctgcctacttagaaggaacctactctgagatttatccggatataagtgaagatgctgagggaatgcaaaagtttttcaagcaattctcttttccaggacacattggcagccactgtacgccagagacgccgggatcgattcatgaggggggcgagctaggttatagcctctctcacgcttatggatcggtgtttgacaatccagatttgattacgctggtggccgtaggcgatggcgaagctgaaacgggagcgctggccacttcctggcactctaataagttcttgaaccctgctcaagatggcgcagtgctgccagtattgcacctcaatggctataagattgcgaacccgaccattctctctcgcatttctcatagagagctatcgtctttgttcgtgggctacggctatacgcctcactttgtagaaggagattgtcctgagctggtccatcagcaaatggcaagcgtgatggaagactgcgtgagccaaattcgcgcgatccaggccgaggatcgcagcatccagcatgatgatattcacgccggcgaccagtccggtagccagtccaagactcatcgacccgagcgtcccctctggccgatgattgtcatgcgcacaccgaagggatggacggggccagatgaggtagacgggcaccaggtggcagatttttggcgatcgcaccaagtcccactctcaggcgtaaaagacaacccagagcatttgcagatgcttgaaaactggctacgcagctatcgcccagaagagctattcgacaaatcgggccgattgatcgaagaacttagggaactgccgcccaagggtgatcgccgtttgagcgccaatccggtggccaacggtgggctattgcgtaagccgctaaagctaccgaactttagagactacgcagtgacggtgggtcatcctggtaagactcaggtagaaaacacccgcttgataggccgctttcttaaagacgtcatcgctcaaaatctgactgacttccggctattcggcccagacgaaaccctctctaaccggttgggtgaggtctttgaggtaactagccgcgtatggatgggcgactatctgccagcagatgccgacggcggctttttgtcgccgacgggtcgggtgatggaaatgctgagcgagcatacactacaaggctggctagaaggctatttgctcacaggtcgccatgggatgtttcatacctatgaggcctttgctcacgtagtcgattcgatgtttaaccaacatgcgaaatggctagacatttctaaaaacgtcgtcccctggcgcgccccagtagcatcgcttaacattttgctctcttcggtagtttggcggcaagaccacaacgggtttagccatcaagatccgggctttattgatctggtgacgaacaagagtccagatgtgacgcgcatttatttgccacccgatgccaactgtttgctgtcggtagtcaaccactgcctgaagagtacggactatatcaacgtgattgtctctgataagcaaaagcacttgcagtacttgacgatggacgaagcggtgcgacactgcaccaaaggcatcggcatttgggaatgggccagtaatgacgacagaggcaaagcacctgatgaacccgatttgatcatggcctgctgtggtgatattccaacaatggagtcgctagcggcgacagcaatcttacgagaagagtttcccgacttgcgtgtgcgctttatcaacgtggtcgatttgtacaaactcattcatcccaaagaccatgatcatgggttatctgacccagacttcaatacgctatttacgactgacaagccagttatcttcaactttcacggctatccttggctgatccataaactggtttatagccgcgctaatcaggagcgaattcatgtacgcggatacaaggaaaaggggaatatcaacacgccgctagagctggcgatcaacaatcaaatcgatcggtttaacctggtaattgatgccgttaaccgagtgcccaagctcggatcgagaggtgcctatgtgaaagaaagaatgcaaaacgagattattgaccatgtgagctacgctcgtctgcatggagaagataagcctcagactagcagctggacatggccagcatgggcggtaggacaataa

SEQ ID NO: 105 - DNA, 2397 bp, Burkholderia graminis C4D1M
atgagcagcaatcgagcatcggactcctcgtacccaaccgcgctctccaacgacgaactaaggcggatcgacgcctggtggcgcgcgtgcaattacctctcggtcggcatgatttacctcaaggacaacccgcttttgcgcgaacccctcaaagtcgatcatgtaaagcaccgtctgcttgggcactggggcgcaagtcccgcgctttcgttcgtctgggcgcatctgaatcgcgtgatcaagcgcgacgacctggacatgattttcatggccgggcctgggcacggcgcgcctggcgtactcggcccagcctatctcgaaggcacctattcggaggtctacccggacaaaagcgaggacgccgaaggtatgcagaagttcttcaagcagttctcgtttccgggacatatcggctcgcatgtgacgcccgaaacgcccggctctattcatgagggcggtgaactcggttacagcctggcgcacgcttatggcgctgcgctcgacaaccctgatctgatcgtggcctgcgtggtcggcgatggtgaggccgagacaggtccgcttgcgaccgcgtggcattcgaacaagttcatcaatcccgcgcgcgacggcaccgtactgccaattctgaacctgaacggctacaagatcgccaatccgacgatcctctcgcgcatcagccacggagaactcgcggcgttactcgaaggctacggctatatgccgtatttcgtcgaagggtccgacccgtcgcagatgcatcagacaatggccggcacgctcgatactgtgatcgccgacatccgcgcgattcacgaaagagcgcgcgcggatggcaatgccgagcgtccacgctggccgatgatcgtgttgcgcacgcccaagggctggacggggccgaaggaaattaacggccataaggtcgaggggtcatggcgttcgcaccaagtgccgttctcggatgtaaggggaaaccccgcgaacctcgacctgctcgaaagctggatgcgcggctacaggcccggcgaattgttcgatgactccggaaggttgcttgcggaactgcgcgagcttgcgccgcaaggcccgcgccgcatgagcgcgaacccgcatgcaaacggcggattgttgcgccgcgatctgaagctgcccgactttcgcgactacgcggtcgaagtttcacgcgccggcaatgtgctgcgcgaaaacacgcagccgcttggccagtttctgcgtgacaccatgcgttgcaacatggacaccttccgcgtcttcggccccgacgagaccgcgtcgaaccggcttcagtcgatttacgaagtcagcaagaaagcgtggatggcagacatgctgcccgaagacgacgacggcggcgaactgtcgcgcgatggccgcgtgatggagatgctctcggagcacacgctgatggggtggctcgaaggctatctgctttccggccgccacggcttctttcacacgtatgaagcgttcgcgcacgtggtggactcgatgttcaaccagcacgcgaaatggctggacgtatgcaagaaccatgtgccgtggcgggcttcggtggcctctgaaaatatcctgctttcgtcgacggtatggcgtcaggatcacaacggcttctcgcatcaggaccccggcttcatcgacctcgtgactaacaagagtccctcggtcacacgggtttatttgccgccggacgccaatacgctgctcgtcgtggcggatcagtgcctgcgctcgaccgactgcatcaatgtcatcgtcgccgacaagcagaagcacctgcaattcacgactatcgacgaagcggtcgtgcattgcgcgaaaggcatgggtctttggcggcgcgcgagcaatgacgaagacatggagcccgacgcggtgatggcttcatgcggcgacgttgccacgcaggaagcgctcgcagcaacggccattttgcgcgagcgtctgcccgagttgaaactgcgcttcgtgaatgtagtcgatctgttcaaaatgcagccggtgacagagcatccgcacggctcgacggagcgcgaattcgacagcctgtttaccgtcgataagcccgtgatattcaattttcacggctacccgtggctgattcacaagcttgcgtatcgattccgcaatcacgagaatctgcacgttcgcggctacacggagaagggcaacatcaatacgccgctcgaactcgcgatactcaacaaggtcgaccgcttcaatctggtgctggacgtgctcgatcgtgtgccgcgcctgcagggcagaaccgcacatctaagagaagacatgaggaacgcgatcatcctcaacatgaattacgcgcatgagcacggtacggataatccggagttgtcggaatgggtgtggccgtattga

SEQ ID NO: 106 - DNA, 2397 bp, Burkholderia sp. H160
atgggccaacattccgcggcggatgcttcgcagcagaccgcgctcggcagcgacgaacttcgtctgatcgacgcgtggtggcgggcatgcaattatctttcggtcggcatgatctatctgctggacaacccgctgctgcgcgagccgctgaaagtcgaccacgtcaagtatcgccttctcggacactggggcgcgagcccggcgttatcgttcgtctgggcgcatctgaaccgcgtgatcaaacgtgacgatctcgatgtcattttcatggcaggtcccggacacggcgcaccgggcgtgctcggcccgacctatctcgaaggtacctactcggagatctatcccgacaagagtgaagatgccgagggcatgcagaagttcttcaagcagttctcgtttcccggccatatcggttcgcatgtgacgccggagacgcccgggtccatccatgagggcggcgagcttggctatagcctgtcacacgcgtatggcgccgcgctcgacaaccccgacctgatcgtggcctgcgtggttggcgacggcgaggcggagaccgggccgcttgccaccgcttggcattcgaacaagttcatcaatccggcccgggacggcaccgtgctgccgatcctgaatctgaacggctacaagatcgccaacccgaccatcctcgcgcgcatcagcaaccgggaactggaagcgctcttcgtcggctatggctacaccccgcatttcgtcgaaggatcggatcacgcggagatgcatcagaagatggcgcacacgctcgataccgtgctcggcgaaattcatgaaatccacgagcaggcgcgtgtgaagggcaatctcgaacggccgctctggccgatgatcgtgctgcgctcgcccaagggctggaccggaccgaaggagatcaacggccacaaggtcgaaggctcgtggcgctcgcatcaggtgccgttttcggatgtgcgcaacacccccgcaaatctcgaagtgctcgagcagtggatgcgcagctaccggcccgacgaactcttcgatgccgacggcacgctgatccccgaactcaaggcgctctcgcccgcaggcccgcggcgcatgagtgccaatccgcatgcgaacggcggcgtgctgcgccgcgaactgaagctgcccgacatccgcgagtacgccgtggatgtgcaccacgcgggcaaggtgctgcatgagaacacgcggccgctcggcgaatttctgcgcgacacgatgcgcgcgaacatgaacaccttccgcgtgttcggcccggacgaaacggcgtcgaaccgtctgcaggcgatctacgaggtcagcaagaaggtctggatggccgatatgctccccgaggacgatgacggcggcgagctggcgcgcgacggccgcgtgatggagatgctgtcggagcatacgctgatgggatggctcgaaggctatctgctgacgggccgccacggcttcttccatacctacgaagcgtttgcgcacgtggtcgattcgatgttcaaccagcacgcgaagtggctcgacatcagcaggaatcacgtaccctggcgcgcgtgggtgtcggcggaaaacattctgctgtcgtcgaccgtgtggcggcaggatcacaatggcttctcgcatcaggatcccggcttcatcgacctcgtcacgaacaagagcccctcggtcacccgcgtctaccttccgcccgacgcgaacacgctgctggtggtcgccgaccactgcctgcgcaccaccgactgcatcaacgtgatcgtggccgacaaacagaaacacctgcaattcgccaccatcgacgaagccgtcgtgcactgcgccaaaggcatcggcgtgtggcgccgcgcgagcaacgacgaggacgccgaaccggacgtggtgatggcctcgtgcggcgacgtcgccacccaggaagcgctggcggcgacggcgatcctgcgcgaacgcctgcccgagctcaagctgcgtttcgtcaacgtggtcgacctgttcaggatgcagccggcgagcgagcacccgcacggctcgaccgaacgcgaattcgatagcctgttcacaaccgataagccggtgatcttcaatttccacggttacccgtggctgattcacaagctcgcctatcgctttcgcaatcacgagaatctgcacgtccggggctacaaggagaaaggcaacatcaacacgccgctcgaactggcgattctcaatcaggtggaccgcttcactctggtgatcgacgtgctcgaccgcgtgccgcgtttgcaaggcagatcggcgcatctcagagaggacatgaggaacgcgatcgtcagcaacctgaactatgcgcatacgcacggcacggaccgcgctgatgtcgccgactgggtctggcccttctga

SEQ ID NO: 107 - DNA, 2424 bp, Synechococcus sp. WH 5701
atggtgtccaccacccagtcctcagatccggcggccacccccgccgattccgatcaggagctcactctcctcgacgcctggtggcgcgccgccaactatctggcggtggggatgatctacctgcgcgccaaccccctcctggccgaacccctgcgccatgagcacatcaaggcgaggctgctggggcactgggggtcatcgccgggccaggccttcctgtgggcccatgccaaccgggtgatccgtcgccacgacctcgacatgatctacctgtcgggtccgggccacggcgcgcccggcgtactgggtccgacgtacctcgacggcagctacagcgaggtgtatcccgacaagagtcgggacaccgaagggatgcagcgcttcttcaagcagttctccttccctggccacatcggcagccactgcaccccggaaacccccggttcgatccacgagggcggcgaactcggctacgtgctctcccatgcctgcggggcggtgttcgacaaccccgacctgatcgccctggcctgcgtgggcgacggcgaggccgagaccggccccttggccacctcctggcacatcaacaagttcctcaacccgatcggcgacggggcggtgctgccggtgctgcacctcaacggctacaagatcgccaaccccaccctgctggcacggattccgcgggaggaactggccagcctgatgcggggctacggctgggagccgctgttcgtggagggccatgagcccatggccatgcaccgggccatggcgtcggccatggacgaggcggtggcccgcatcctgcagatccgggccgaggcccgccgcagcggcgaggcggtgcgtcccgcctggccgatgatcgtgctgcgctcccccaagggctggaccggtcctgcggaactccacggcaagaagctggaggggttctggcggtcccaccaggtgccgctgccggccccgaacaaggaccccgagcaattggcgatgcttgaggcctggctgcgcagctatcgccccgaagagctgtttgacgccgacggaaccctccgctccgagctccaggctctctcgccccagggaccgcggcggatgggctccagcccccacgccaacggcggcctgctgcgccgcaagctgcggctgccgccgatcgagagctacgccgtgccggtggagcgtccagggcaatcggagcacgagaacaccgccccccttggggccctgctgcgcgacatcatcggcacgaaccccgattcgatgcgggtgttcggccccgatgagaccgcttccaaccgcctgcaggccatctacgaggtgagcaagaaggtctggatggaggagctgctgccggaggacgcggggggcagcgagctggcccgcagcggccgggtggtggagatgctcagcgagcacaccctggtgggaatgatggagggctacctgctcaccggccgctacggcttcttccacacctacgaggccttcgcccatgtgatcgcctcgatgttcaatcagcacgccaagtggctggaatcctgcatccaccacgcaccgtggcgggcacccatcggcccctggaactgtctgatctcctccaccgtctggcgccaggaccacaacggcttcacccaccaggatcccggcttcatcgatctggccggcaacaagagcggcgaggtggtgcgcgtctatctgccgccggatgccaactgcctgctggcggtggccgaggaggcgctgatggagaccaacgtctgcaacatcatcgtctccgacaagcagaagcatctgcagtacatgaccctcgagcaggcccgcgcccatgtgagcaagggcatcggcatcgtgtcctgggccagcaacgacgactgcggcaccgaccccgatgaaccagatgtggtgatggcctgcgccggcgacatcccctccaaggagaccctggcggcggtggagatcctgcggagggagattccccagctcaagatccgtgtgctcaatgtggtgaagctgtttgccctgacccagccgagcgagcatccccacggcctctccgaccgtgatttcgacaccctgttcaccaccgacaaaccggtgatcttcaatttccacggctatccctggctgatccaccggctcacctaccgacgcaccaaccatgcgaacctgcacgtgcggggctacaaggaaaagggcaacatcaacacgccgctggagctggcgatgaacaaccagatcgaccgcttcaatctggtgatggatgtgatcgatcgtgtgcccgcgctcggctacagggtcgcccacgtgaaggaacggatgaaggatgccatccatcgccaccgtgagtacgcccacacccacggccaggactcgccggaggtgaccgactggcgctggactcttccgctcgagagctag

SEQ ID NO: 108 - DNA, 2442 bp, Cyanobium sp. PCC 7001
atgggcgagctcaccgacaccgccatcccccttctcgcgagcagcctgccggccccctcctccaccccttcggagcaggagctggagctgatcgaccgctggtggcgggccgccaactacctggcggtggggatgatctacctgcaggacaatcccctgctcaccgagccgctccagagcgcgcacatcaagaaccgcctgctcggccactggggttcgagccccggccaggccttcatctgggcccacgccaaccgggtgatccgccagcgggacctggagatgctctacctctccgggcccggccacggcgcccccggggtgctggcacccacctatctcgacggcagctacagcgaggtgtaccccgacatctccctcgacgccgaggggatgcgccgcttcttcaagcagttctccttcccgggccacatcggctcccactgcaccccggagacccccggctcgatccacgagggcggtgagctcggctacgtgctctcccacgcctgcggcgcggtgttcgacaaccccgagctgatcgccctggcctgcgtgggggatggcgaggcggaaaccgggcccctggccacctcctggcacatcaacaagttcctcaacccgatcagcgacggcgccgtgctgccggtgctgcacctgaacggctacaagatcgccaaccccaccctgctggccagaatcccgcgggatgagctggccagcctgctgcggggctacggctgggagccgatcttcgtggagggccatgagccgatggccatgcaccgcgccatggccgccgccatggaccaggccgtcgacgcgatccagcgggtgcagcggcagtgccgcgccagcggcgaggcggtgcggccggcctggccgatgatcgttctgcgttcccccaagggctggaccggcccccatgacctgcggggccagaagctggagaacttctggcgtgcccaccaggtgccgctgccggggccgaagcacgacgccgagcagctggccatgctcgagggctggatgcgcagctaccggccgcaggagctcttcgatggcgagggcaccctgctgccggagctgcaggccctctcccccgaggggccgcggcggatgggctcctgcccccatgccaacggcggccagctgcgccgcagccttcgcctgcctccgatcgaaacctatgcggtggcggtggaccagcccggccatggcgagcacgagaacacggccccgctgggggctctgctgcgcgacaccatcgcccgcaaccccgattccctgcgggtgttcgggcccgatgaaacggcctcgaaccggctgcaggccatctacgcggtgagcaagaaagtgtggatggaggacttcctgccggaggacatgaacggcagcgagctcgcccgggaggggcgggtggtggagatgctctccgagcacaccctcgtggggatgatggagggctacctgctcaccggccgctatggcttcttccacacctacgaggccttcgcccacgtgatcgcctcgatgttcaaccagcacgccaagtggctggagagctgcatccaccacgccccctggcgggctccggtggggtcgtggaactgcctgatctcctccacggtgtggcgccaggaccacaacggcttcacccaccaggacccgggcttcatcgacctggccggcaacaagagcggcgaggtggtgcgggtgtatctgccgcccgacgccaacaccctgctggcggtggccgaggaggcgctgctggagacgaacgtgtgcaacatcatcgtgagcgacaagcagaagcacctgcagtacctcagcctggaggaggcccgtcgccacgtggccaaggggatcagcctgatcagctgggccagcaacgacgaccacggcaccgagcccgatgaccccgatgtggtgatggcctgcgccggcgacatccccaccaaggagacgctggcggcggtgcagatcctgcggagggagtgcccgcagctgaagatccgggtggtgaacgtggtgaagctgttcgccctcaccgaacccagcgagcatccccatggcctcagcgatcgggatttcgacagcctgttcaccaccgacaggccggtgatgttcaatttccacggctatccctggctgattcaccggctcacctaccgccgcaccaaccaccgcaacttccacgtgcgcggttacaaggagaagggcaacatcaacacacccttggagctggcaatgaacaaccagatcgaccgcttcaatctggtgatcgatgtgatcgaccgcgtgccatccctgggctcacgagcggcccacgtgaaggaacgcatgaagaacgccatcctggcgaaccgcgcccatgcccatgaacacggcatggatgcccctgaaatcaccaactggcgctggagcacccccgaggcatga

SEQ ID NO: 109 - DNA, 2436 bp, Synechococcus sp. WH 7805
atgacggttacacccttcctgcatgtctcaggcgcggacaacctccaggcgccctcggatcacgaactgcagcgccttgatgcctactggcgggccgccaactacctggcggtgggaatgatttatctgcaagacaatccgctgctgcgggagccgctccggcccgagcacatcaagaaccgtcttctgggccactggggctccagcccaggccaggccttcatctggacccacgccaaccggctgatcaacacctacgacctggacatgatctacatgtccggtcctggccatggggcccctggcgcccgcgggccggtgtacatcgacggcagctacaccgagcgctatcccgacaagtcgctggatgaagacggcctgaagaagttcttcaagatgttttccttcccaggacacatcggcagccactgcactgcggagatgcccggttcgattcacgagggtggtgaactcggctacgtgctctcccatgcggctggatcggtgttcgacaacccggagctgatcacggtcgcctgcgtgggtgatggggaagcggagaccgggcctctggccaccagctggcacatcaacaaattcatcaacccgatcaaagacggtgccgtgctgccagtgctgcacctcaacggttacaagatcgccaaccccacgatcctcagccgcatcgatcacgacgagctggaaagcctgttccgcgggctgggctggacgccgatcttcgtggaaggctccgatccaatggagatgcaccgcaagatggccgtggccatggagcaggccgtgctcgaaattcgggcgatccaggaggaggcccgcggcagtggtgaagccttccgcccccgctggccgatggtcgtgctgcgctcccccaagggatggaccggtccgcaggaacttgatggcaagaagatcgagaacttctggcgcgctcaccaggtgccgatcggtgatgtgaaagccaacccagatcacctgcgcctgctcgaggactggatgaagagctatcgcccctgggagctcttcgatgacaacggcgccgtgcgcgaggagatcagggcgctgtctcccacgggtgatcgccgcatgggctccaacccgcacaccaacggtggggtgctgcgcaaagatctgcgcttcccggagctgcgcaactacgaagtcccggtcgagagccccggtaccaccgaaaaggagaacacttacccccttggggaactgatccgcgatttgatcaaccacaaccccggtgcctatcgcctcttcggcccagacgaaacggcctccaaccgcctccaggctgtctatgagacgaccaagaaggcctggatggcgaatttcctgcccgaagacctcaacggcagcgaattagcccgcgacggcgccgtggtggagatgctctctgagcacaccctggtggggatgatggatggctatctgctcaccggcaggaacgctttcttccacacctacgaggccttcgcccacgtcgtggcctcgatgtacaaccagcactgcaagtggctggagcactgcgaagagatcccctggagagcgccgatcggtccttggaactgcttgatctcatccaccgtgtggcggcaggatcacaacggcttcacccaccaggaccccggtttcatcgacctggcggggaacaagaagggaagcatcacccgggtgtatctgccggctgacgccaacagtttgctggcggtgtctgaaaaggccctcaccgaaaccgatgtggccaacatcattgtgtcggacaagcagaagcacctgcagtacctcacccttgacgaggctcgccgccacgttgccaaaggcgccggcatctgggagtgggcctgcaacgacaactgcggtgttgatcctgatgaacccgatgtggtgctggcctccgctggagacatccccaccaaggaatgcctcgcagcgatcgaaattctgcgttcacaaactccccatctcaagatccgctacgtgaacgtggtgaagctgttctccctgggtaaccccaaagaccatccccatggcctcagcgacagggacttcgaaagcctgttcactccagacaaaccggtgattttcaacttccacggctatccctggctgatccaccgcctcacctacaaccgcccgaaccacagcaacttccacgtgcgcggttacaaggaacaaggcaacatcaatacgcctctagaactggccatctgcaaccagatcgaccgcttcaacctggtgatcgatgtaatcgaccgcgtggactctctcggctcccgggccgcccacgtgaaagaacagatgaaggacgaaatccacaagcaccgcgcttacgcctatgagcacggcaccgatgcacctgagatcaacaactggcgctggagcctgggccgcagctcctgtgctgtctga

SEQ ID NO: 110 - DNA, 2436 bp, Synechococcus sp. WH 7803
atgacggtcacccccctcctgcatctctcaggctctgaacaccttcaggcgccagcggacgacgaactgcagcgccttgatgcctactggcgggccgccaactacctggcggtgggaatgatctatctgcaggacaatccgctgctgcgggagccgctgcggcctgagcacatcaagaatcggcttctgggccactggggctccagcccaggccaggccttcatctggacccacgccaaccgcctgatcaaggcctacgacctggacatgatctacatgtctggtccaggccatggcgcccccggcgcccgcgggccggtgtacatcgacggcagctacagcgagcgctatcccgacaagtcgctggacgaaaccggcctgaagaagttcttcaagatgttctccttcccgggacacatcggcagccactgcaccgcggagatgcccggctcgattcacgagggtggtgaactcggctacgtgctctcccatgcggctggatcggtgttcgacaacccggagctaatcactgtcgcttgcgtcggtgacggcgaggcggaaaccggccctttggccaccagctggcacatcaacaaattcctcaacccgatcaaagacggtgccgtgctgccggtgctgcacctcaacggctacaagatcgccaaccccaccatcctcagccgcatcgaccacgaagagctggacagcctcttccgcgggctgggctggacgccgatcttcgtggaaggctgcgatccaatggagatgcaccgcaagatggcggtggccatggagcaggccgtgctcgagatccgggccatccaggagcaggcccgcagcagcggtgaggccttccgcccccgctggccgatgatcgtgctccgctcccccaagggctggaccggcccgcaggaactcgacggcaagaagatcgaaaacttctggcgctcccaccaggtgccgatcggcgatgtgaaaaccaaccccgatcacctgcagctgctggaggactggatgaagagctaccgcccctgggagctctttgatgacagcggtgccgtgcgcgaagagatccgggcgttatcccccaaaggagaccggcgcatgggttccaacccccacaccaacggtggggtgttgcgcaaggatctgcgcttcccggagctgcgcaactacgaagtgcccgtggagatccccggcacaacggagaaggagaacacctaccccctgggtgaactgatccgcgatctgatcagcaacaaccccggcggttatcgcctcttcggcccggacgaaacggcctccaaccgccttcaggccgtgtacgaaaccaccaagaaagcgtggatggcgaacttcctgcctgaagacctcaacggcagcgagctgtcccgcgacggcgccgtggtggagatgctctccgaacacaccctggtgggaatgatggatggctacctgctcaccggccgctacggcttcttccacacctacgaggccttcgcccacgtggtggcctcgatgtacaaccagcactgcaaatggctggagcactgcgaggagattccctggagagcgccgatcgctccctggaattgcctgatctcttccaccgtgtggcgtcaggaccacaacggcttcacccaccaggatcccggcttcatggatctggccggcaacaagaagggcagcatcacccgcgtgtatctgccggccgatgccaacagcctgctggccgtggccgaaaaggcgctcaccgaaactgatgtggccaacatcatcgtgtcggacaagcagaagcatctgcagtacctcacgctcgatgaggcccgccgccatgtggccaaaggcgccggcatctgggagtgggcctgcaacgacaactgcggcatcgatccggacgagcccgacgtggtgctcgcctccgccggcgacatccccaccaaggaatgcctggcggcgatcgagattctgcgttcagaaatcccccatctcaaggttcgctacgtgaacgtggtgaagctgttcgccatggccaacccgaaggaccacccccacggcctcagtgaccgggacttcgaaagcctgttcacacccgacaaaccggtgatcttcaacttccacggctatccctggctgatccaccgcctcacctacaaccgcccgaaccacaacaacttccacgtgcgtggttacaaggagcagggcaacatcaacaccccgctggagctcgccatctgcaaccagatcgaccgcttcaacctggtgatcgatgtgatcgaccgggtggaatcgctcggatcccgggccgcccacgtgaaagagcaaatgaaagacgagatccataagcaccgcgcctatgcccatgagcacggcaccgatgcgcccgagatcaacaactggcgctggagcctgggccgcagctcctgcaacgtctga

SEQ ID NO: 111 - DNA, 2430 bp, Synechococcus sp. RS9917
atgaccaccacgccctatcaggccgccgccgcgcacgtgcaggcgccgatggaggaggaactccagcgcctggatgcctactggcgcacggccaattacctggccgtgggcatgatctacctgcaggacaatccgctgctgcgcgagccgctgcaaccggaacacatcaagaatcgcctgctcggccactggggatccagccccggccaggccttcatctggacccacgccaaccggctgatcaacaaatacgacctcgacatgatttacatgtcgggccccggtcacggtgctcctggcgcccgcggccccgtgtacatcgatggcagctacaccgagcgttaccccgacaaatcactcgatgaggcggggctgaagaagttcttcaagatgttctccttccccgggcacatcggcagccactgcaccgccgaaatgccgggttcgatccatgaaggcggcgagctcggttatgtgctctcccacgcctgcggctcggtgttcgacaacccggagctgatcacgatcgcctgcgtcggcgacggtgaagccgaaaccggccccctcgccaccagctggcacatcaacaagttcatcaacccggtgaaagacggtgccgtgctgccggtgctgcacctcaacggttacaagatcgccaacccgacgatcctcagccgcatcccccacgaggaactcgacagcctgctgaagggttatggctggagcccgatcgtcgtcgaaggttccgacccgatgaccatgcatcgccagatggcggtggcgatggagcaggcggtgctggagatccgggcgatccgcgaccaggcccgcagcagtggcgaggccttccgcccccgctggccgatgatcgtgctgcgctcccccaagggctggaccggcccccaggagatcgacggcaagaagatcgagaacttctggcgctcccaccaggtgccggtggccgatgtgaagagcaacgagagccacctgcgcctgctcgaagactggatgaagagctaccgcccctgggaactcttcgatgacaacggcgctgtgcgcgaagagatccgcgccatggctccgaagggggatcgccgcatgggctccaacccccacaccaacggcggtgagctgcgcaaggagctcttcttccccgatctgcgcaactacgaggtgccggtcacgagtcccggcaccaccgagaaggaaaacacctatcccctgggcgaactgatccgcgacctgatcagcctcaaccccggtggctatcgcctcttcggccccgacgaaaccgcctccaaccgtctgcaggccgtgtatggcgccaccaagaaggtgtggatggctgatttcctgccggaagacctcaacggcagcgaactctcccgcgatggggccgtggtggagatgctctccgagcacaccctggtgggcatgatggatggctatctgctcacagggcggaacggcttcttccacacctatgaggccttcgcccatgtggtggcctcgatgtataaccagcactgcaagtggctggagcactgcgaagagatcgcctggcgtgccccgatcggcccctggaactgcctgatctcctccaccgtgtggcgtcaggaccacaacggcttcacccatcaggatcccggtttcatcgatctggccggcaacaagaagggcagcatcacccgggtgtatctgccggcggatgccaacagcctgctggcggtggccgaaacggcgctcaccgaaaccgatgtggccaatatcatcgtgtcggataagcagaagcatctgcaatacctcaccctggatcaggcccgccgccatgtggccaagggtgcgggcatctgggagtgggcctgcaacgacaactgcggcgttgaaccggatgatccggatgtggtgctcgcctccgccggcgacatccccaccaaggagtgtctggcggcaatcgagatcatgcgggagcggattccttacatcaagatccgctacgtgaatgtggtgaagctgtttgccctggcggcacccaaggatcacccccacggcctcagcgatgtggatttcgccagcctgttcacccccgacaagccggtgatcttcaacttccacggctatccctggctgatccaccgcctcacctacaaccgccccaaccacaacaacttccatgtgcgtgggtacaaggaaaaggggaacatcaacacgccgctcgagctggcgatcagcaaccagatcgaccgctacgacctggtgatcgatgtgatcgatcgggtggagaagctcggctcccgcgccgcccatgtgaaggagcagatgaaggacgagatccagatgcaccgcgcctacgcctacgagcacggcaccgatgctccggagatcaacaactggcgctggagcctcggccacggctcctgcaaggcctga

SEQ ID NO: 112 - DNA, 2394 bp, Burkholderia phytofirmans PsJN
atggctgaagcaaccgcccatcccacgccgccgcaaactttagacgccgacacgttgcgcaacatggatcgctactggcgggcctgcaactacctctcggccggcatgatctatctgcgcgacaatccgctgctgcgcgaaccgctgaagcccgaacacatcaagaaccgcctgctcggccactggggttcggacccggggcagagcttcctgctcgtgcatctgaaccggctgatcaagaagcttgatctaaatgtgatctacgtagccggtcccggtcatggcgcaccagccacgctggccaattgttatctcgaaggccactactcggaaatctatcccgaccgcagtcaggacgtcgccggcatggagcgcttcttccggcagttctcgtttccgggcggcatcggttcgcactgcacgccggagacgccgggctcgattcacgaaggcggcgagctcggctatagcctctcgcacggctacggcgccgcgttcgacaatcccgatctgatcgtcgcggtgatgatcggcgacggcgaagcggagaccggtccgctcgccacctcgtggcactcgaacaagttcctcaatccgatccgcgacggcgcggtgttgccggtgctgcacctgaacggctacaagatcgccaatccgaccattctcgcgcgcattccccgcgaagaactcgaagccttgctaaccggctacggccacaaaccgtatttcgttgaaggcgaggatcccgccgtcatgcaccagcagatggccgcgactttggagcaatgcatcggcgaaatccgcgcgatccagcagcatgcgcgcgagagcaacgacgcgtcccggccgcgctggccgatgatcgtgctgcgctcacccaaaggctggaccggtccgaaggaagtcgacggacacaaggtggaaggctcgtggcgcgcgcaccaggtgccggtgctcgatccggcgaccaatagcaagagcctgaaactggtcgagaactggctgcgcagttacgagcccgaaacactgttcgacgaagcagggcgcctcgtgaaagaactgcgcgaactcgcgcccgaaggcgcgcgccgcatcagcgccaatccgcatgcgaacggcggtgtgctctgcaagacgctcgccatgccgccgtttcgcgattacgcggtggcggtgaaaaagccagccggctcgtacacgtcgccgaccgaggtgctcggcaagttcctgcgcgacgtgatgcgcaacaacatgacgaacttccgcgtgttcggccccgatgagacttcgagcaacaagctgaccgcgatctatgaggcgtcggaaaaaacctggctcgcgcaaaccgtgccgagcgacgcggacggcggcgaactcgcggtagacggccgcgtgatggaaatgctcagcgaacacacgctcgaaggctggttcgaaggctacgtgctgaccggccgccacggtctgttcgccacgtacgaagccttcgtccacgtgatcgactccatgttcaaccagcacgccaagtggctggagaaagccaaacgcgatctcggctggcgccagccggtgccgtcgatcaacctgctgatcacgtcgctcgtctggcgtcaggatcacaacggcttcacgcaccaggatcccggctttctggatgtcgtcacgaataaaagcccggacgtggtacgtatttatctgccgccggacgcgaactgcctgctgagcgtcgccgatcattgcctgcgttcgcgcgattacgtcaacgtgatcgtcgccgacaagcagccgcatctgcagtatctcgacatggacgcggccgtcacgcattgcaccaagggcatcggtatctgggactgggcgtcgacggaccaaggcgtcgagccggacgtggtcatggcttgcgcgggcgatatcccgaccatggaggcgctcgccgccgtgcagatcctgaaggagcagttcgccgacctgaagatccgcttcgtcaatgttgtcgacctgtttcgcctgatgcccgagcatgcgcatccgcacggcctgtccagccgcgatttcgattcgttgtttaccactgacaagccggtgattttcaacttccactcgtatgcgtcgctggtgcacaagctgacctataaccgcacgaaccacgacaacctgcatgtgcacggctatcacgagaagggcaacatcaacacgccgctggagttggcgatcatcaatcaggtcgaccgtttttcgctggcgatcgacgtgatcgaccgcgtgccgaggctgcgcggcgttggcgaccacgccaaggaatggctgcgtggccagatcatcgagcatctggcttatgcgcacgccgagggcatcgataaggaagaaatccgcaactggacgtggaaaggctga

SEQ ID NO: 113 - DNA, 2394 bp, Burkholderia xenovorans LB400
atggctgaagcaagctcccgtcccacaccgccgcaagtcctggatgccgacacgttgcgcaacatggatcgctactggcgcgcctgcaactacctctcggccgggatgatctatctgcgcgacaatccgctgctgcgcgagccgctgaaacccgagcacatcaagaaccgtctgctgggccattggggctcggacccggggcagagtttcctgctcgtgcatctgaaccggctgatcaggaagctcgatctgaacgtcatctacgtggccggtccgggtcatggcgcgcctgccacgctcgcgcattgctatctggaaggacattactcggaaatctatcccgaccgcagcgaagacgaagccggcatgcagcgcttcttccggcagttctcgtttccgggcggcatcggttcgcattgcacgcccgagacgccgggctcgattcatgaaggcggcgaactcggctatagcctctcgcatggttacggcgccgcgttcgacaacccggacctgatcgtcaccgtgatgatcggcgacggcgaagcggaaaccgggccgctcgccacctcgtggcactcgaacaaattcctcaatccggttcgcgatggcgcggtgttgccggtgctgcacctgaacggctacaagatcgccaatccgaccattctcgcgcgcattccccgcgaggagctcgaagcgttgctgacgggttacggccacaagccgtatttcgtcgagggcgacgaccccgccgtcatgcatcaacagatggcggcgacgctcgaacaatgcatcggcgaaatccgcgcgatccagcagcatgcgcgcgcaaacaacgacgcgacgcgcccacgctggccgatgatcgtgctgcgttcgccgaaaggctggaccggcccgaaggaagtcgacggccacaaggtggagggctcatggcgcgcgcaccaggtgccggtgctcgacccggtgaccaatggcaagagcctgaagctggtggaaaactggatgcgcagttacgagcccgagtcgctgttcgacgaagccgggcgtctcgtcgaagaactgcgcgagctcgcgccgaagggagcgcgccgcatcagcgccaatccgcatgcgaacggcggcttgctgtgcaagacgctcgacatgccggcgtttggcgactatgcggtggcggtgaagaaaccgggcggcacgtacacgtcgccgaccgaggtgctcggcaaatttctatgcgacgtgatgcgcaggaacatgacgaacttccgcgtgttcggtcctgacgaaaccgcgagcaacaagctcaccgcgatctatgaagcgtcggaaaaaacctggctcgcgcaaaccgagccgagcgacgcggacggcggcgatctcgcggtggacggccgcgtgatggaaatgctgagcgaacatacgctcgaaggctggttcgaaggctacgtgctgaccggccgccacggcctgttcgccacgtacgaagcgttcgtccacgtgatcgattccatgttcaaccagcacgccaagtggctggagaaagccaaacgcgatctcggctggcggcagccggtgccgtcgatcaatctgctgattacctcgctcgtgtggcgccaggatcacaacggtttcacgcaccaggaccccggctttctcgacgtggtcacgaataaaagcccggacgtggtgcgcatttatctgccgcccgatgcgaactgcctgctgagtgttgccgatcattgtttgcgctcgcgcgactacgtcaacgtgatcgttgccgacaagcagccgcatctgcagtatctcgacatggacgcggcggtcatccattgcaccaagggcatcggcatctgggactgggcgtccacggatcagggcgtcgaaccggacgtggtgatcgccagcgcgggcgacatcgccacaatggaggcgctcgccgccgtgcagattctgaaggagcggttcgccgacctgaagatccgctttgtcaacgtggtcgacctgttccggctgatgcccgagcatgcgcatccgcacgggctgtccaaccgcgatttcgattcgttgtttaccgcgaccaagccggtgatcttcaatttccactcgtatgcgtcgctggttcacaagctcacctataaccgcaccaaccacgacaacctgcacgtgcacggctatcacgagaagggcaatatcaacacgccgctcgaactggccatcatcaatcaggtcgaccgcttctcgctggcgatcgacgtgattgatcgcgtgccgaaactgcgcggtgtcggcgaccatgcgaaggaatggctgcgcggccaggttatcgagcacctggcttatgcgcacgccgagggcatcgaccgggaagaaattcgcaactggacgtggaaaggctga

SEQ ID NO: 114 - DNA, 2394 bp, Burkholderia graminis C4D1M
atggctgaagcaatctcccgtcctgccccgccgcaaactctcgaccccgacacgctgcgcaagatggaccgctactggcgcgcatgcaattacctgtccgccggcatgatctatctgcgcgacaacccgctgctgcgcgaaccgctgaagccggagcacatcaagaatcgtctgttgggacattggggctcggaccctggacagagcttcctgctcgtgcatctgaaccggctcatcaacaagctcgacctgaacatgatctacatttccggtccagggcacggcgcacccgcgacgctcgcgaactgttatctcgagggacattactcggaaatctatccggaccgcagcgaagacgaagccggcctgcggcgctttttccgccagttttcgtttcccggcggcatcggctcgcactgcacgccggaaacgccgggctccattcacgaaggcggcgaactcggctacagcctgtcgcatggctatggcgcggcgttcgacaaccccgacctgatcgtcgcggtgatgatcggcgacggcgaagcggagaccgggccgctcgccacgtcatggcattcgaacaagtttttgaacccggtgcgcgacggcgcggtgctgccggtgctgcatctgaacggctacaagatcgcgaatccgacgctgctcgcacgcattccgcgcgaagaactcgaagcgttgctgaccggttacggccacaagccgtatttcgtcgaaggtgacgatccaaacgtcatgcatcagcagatggccgcgacgctcgaacaatgcatcggcgaaatcagggcgatccagcaacatgcgcgcgccagcaacgacacgacgcgtccgcgctggcccatgatcgtgctgcgttcgccgaaaggctggaccggtccgaaagaagtggacggtcacaaggtggaaggttcgtggcgctcgcaccaggtgcccattgccgatccggcgaccaacagcaagagcctgaaactgctcgaaggctggctgcgcagttacgagcccgagtcgctgttcgacgaaagcgggcggctcgtcgaggaattgcgcgaactcgcgccgaagggcacgcgccgcatcagcgcgaatccgcatgcgaacggcggcgtgctgtgcaagatgctcgacatgcccgcgtttcgcgactacgcggtcgaagtgaaaaagcccgcatccgcgtactcgtcgcccacacagacgctcggcaaatttttgcgcgacgtgatgcgcaggaacatgaccaacttccgcgtgttcggccccgacgagacagcgagcaacaagctcacggccatctatgaagcatcggacaagacctggctcgccgactcgcagccgaacgacgcggacggcggcgcgctatcggcggatggccgcgtgatggaaatgctgagcgaacacacgctcgaaggctggttcgaaggttatgtgctgacgggccggcatggtctcttcgcgacgtatgaagcgttcgtgcatgtgatcgattcgatgttcaaccagcacgcaaagtggctcgaaaaagccaagcgcgaactcggctggcgccagccagtgccgtcgatcaacctgctcatcacgtcgcttgtatggcgtcaggatcacaacggcttcacgcatcaggaccccggttttctggacgtcgtgacgaataaaagcccggacgtagtgcgtatttatctgccgcccgacgcaaactgtctgttgagcgtggcagatcactgcctgcgttcgcgcgattacgtgaacgtgatcgtgtcggacaagcagccgcatctggagtatctcgacatggatgcggccgtcacgcattgcacgaagggcatcggcatctgggattgggcgtcgaccgaccagggcgccgagccggacgtggtgatcgcgtgcgcgggcgacatcgcgacaatggaggcgctcgccgccgtgcagcttctgaaagagcgtttcgctgatctgaaaatccgcttcgtcaacgtcgtcgatctgttccggctgatgcccgagcatgcgcatccacacggcctgtcgagccgcgatttcgattcgctgtttacgacgagcaagccggtgattttcaacttccattcgtatgcgtcgctggttcacaagctgacgtataaccgcacgaatcacgacaacctgcacgtgcacggttatcacgagaagggcaacatcaacacgccgctcgaactcgcgatcatcaatcaggtggaccggttttcgctcgccatcgacgtgatcgatcgcgtgccgaagctgcgcggcgtcggcgatcacgcgaaggaatggctgcgcgggcagatcatcgagcatctcgcctatgcgcatgccgagggcatcgacaaggaagaaatccgcaactggacgtggaaagactga

SEQ ID NO: 115 - DNA, 2394 bp, Burkholderia sp. H160
atggccgaagcaacctcgcatcccaccccgccacaagttctggatcccgacacgctgcgcaacatcgaccgctattggcgcgcgtgcaattacctgtcggtgggcatgatttatctgcgcgacaacccgctgttgcgcgaaccgctgaagcccgagcacatcaagaaccggctgctcggccactggggctccgacgccggtcagagcttcgtgctcgtgcatctgaaccggctgatccgcaaacacgatctcgacgtgatctttctgtccggccccggtcatggcgcgcccgcgagcctcgcgcactgttatctggaaggccattactcggaaatttatccggaccgcagcgaggacgaaatcggcatgcggcgctttttccggcaattctcgttccccggcggcattggttcgcattgcacgcccgaaacgccgggctcgattcacgaaggcggcgaactcggctactgcctgtcgcacggctacggcgccgcgttcgacaaccccgatctgatcgtcaccgtgatgatcggcgacggcgaagcggaaaccggcccgctcgccacgtcctggcattcgaacaaattcctgaacccgatccgcgacggcgcggtgctgccggtgctgcatctgaacggctacaagatcgccaatccgacgttgctcgcgcgcattccccatgaagaactcgaagcgctgatggtcggttacggccacaagccgtatttcgtcgaaggcgacgatcccgccacgatgcatcagcagatggccgcgacgctcgaacaatgcatcggcgaaattcgcgcgatccagcagcatgcgcggcagaacaacgacaccgcgcgcccgcgctggccgatgatcgtgctgcgctcgccgaagggttggaccgggccgaaggaagtcgacggccacaaggtggaaggctcgtggcgctcgcatcaggtgccggtggccgatgccgtgagcaatcgcaagagtctgaagatcgtcgaggattggctgcgcagctacggccccgaaacgctgttcgatgtgaacggccggctcgtcgaggaactgcgcgcgctcgcgcccgaaggcgcgcgccgtatcagcgcgaacccgcacgcgaacggcgggctgctgtgcaagacgctcgacatgccgccgttccgcgactacgcggtggccgtgaagaaaccggcggcggcgtatacgtcgccgaccgcagtgctcggcacgttcctgcgcgacgtgatgcgcaagaacatgtcgaacttccggctgttcggtcccgacgaaacgtcgagcaacaagctgcacgcggtctatgaagcgtcgggcaagacctggctcgccgagctcgaaccgggcgacgccgacggcggccacctgtcgcccgatggccgcgtgatggaaatgctcagcgagcacacgctcgaaggctggctggaaggctatgcgctgaccggccgtcacgggctcttcgcgacctacgaagcgttcgtgcacgtgatcgactcgatgttcaaccagcacgcgaagtggctcgaaaaagccaagcgcgagctcgactggcggcagccggtgccgtcgctcaatctgctgatcacgtcgatcgtgtggcgccaggatcacaacggtttcacacaccaggaccccgggtttctcgacgtggtcacgaacaagagcccggatgtggtgcgcatctatctgccgcccgatgcgaactgtctgctgagcgtcggcgaccactgcctgcgctcgcgcgactacgtgaacgtgatcgtgtccgacaagcagccgcacctggactatctcgacatggacgcggccgtcattcattgcacgaaaggcatcggcatctgggactgggcgtcgaccgatcagggcgccgaaccggacgtcgtgatggcgtgcgcgggcgacatcgcgacgatggaagcgctcgccgccgtgcagatcctgaaggagcactgcccgacgctgaagatccgcttcgtcaacgtggtcgatctgttccgcctgatgcccgagcgtgcgcacccgcatggactgtccgaccgcgatttcgattcgctgttcacgaccgacaagccggtgatcttcaacttccacgcgtatgcggcgctcgtgcacaagctcacgtacaaccgcaagaaccacggcaacatgcacgtgcatggctacaacgagaagggcaacatcaatactccgctcgaactcgcgatcatcaacggcgtcgaccgcttcactctggcgatcgatgcgatcgatcgcgtacccacgctgcgcggtgtcggcgatcatacgaaggagtggctgcgcgggcagatcatcgagcatctcgcgtatgcgcacgaggaggggatcgacaaggaggaaatccgcaactggacgtggaaaggctga

SEQ ID NO: 116 - DNA, 2385 bp, Burkholderia phymatum STM815
atggacgacacccgcctgcaacccacgccgttgcaagccgatgaactgcgcaacatggacggctactggcgggcctgcaattacctggccgccggcatgatttacctgcgcgagaatccgctgctgcgcgagccgctgcaggccggacatatcaagcggcgcctgctgggacactggggctccgatccgggacaaagcttcgtgctcgtgcatctgaaccgggtcatcaagcagcgcgacctgaacgtgattttcctctcggggccgggccacggggcgcccgcctcgcttgcgcacagctatctggaaggacgctattcggagatctaccccgatcggggcgagtcggaagagggcatggcgcgtctgttcaagctcttttcgtttcctggcggcatcggctcgcattgcacacccgagacgcccggctcgattcatgaaggcggcgaactgggctacagtctgtcgcatggttatggcgcggcattcgacaaccccgatcttatcgtcaccgtgatgatcggcgatggcgaggccgagacggggccgctggccacagcgtggcactcgaacaaattcctgaatccggcgcgcgacggcgccgtgttgcccgtgctgcatttgaacggctacaagatcgcgaatccgacgatcctcgcccgcattccgcatgaagagctggaagcactgttcaatggttatggctacaagccttggttcgtcgaaggcgacgatcccgacacgatgcatcagcagatggcggccacgctcgatcaatgcctcgacgaaattcatgcgatccagcaacgcgcgcgtcaaggaggcgatctgcaacggccgcgctggccgatgatcgttctcagaacgccgaagggctggacagggccgcgcgaattcggcggacacaggattgaaggctcgtggcgcgcgcatcaggtgcctatcgccgatcccgcgagcaacgagcagagcctcaagcgggtcgaggaatggttgcgcagctatcgcccggaagaactattcgacgaatcagggcggctggtccgggagttgcgtgcgctcgcacccgaaggaccgcgccgcatcagcgccaatccgcacgcgaatggcggggcgctgtgcaaggcgctcgatctgccggcctttgccgactatgcggtcgacgtcgtcacgcccgccacacgctatctgtcgcctaccgatgtgctcgggcagtttctttgcgacgtgatgcgtcggaacatgacaagctttcgcgtgttcggtccggacgaaacgtccagcaacaagctcacggcgatttacgaagcttcgcagaagacgtggctcgcggaggtcgtcgaatcggacggcgacggcggttacctctctgccgatggccgcgtgatggaaatgctcagcgagcacacactggaaggctggctggaaggctatacgctgacgggccggcatggcctgttcgccacgtacgaagcgttcgtgcatgtgatcgattcgatgttcaaccagcacgccaaatggctcgaaaaggcgaagcgcgaattgcgctggcgccagcccgtgccttcgctgaatctgctgattacgtcgctggtgtggcggcaggatcataacggcttcacgcatcaggacccgggctttctcgacgtcgtgacgaacaagagccccgacgtggtgcgcatctatctgccgcccgacgcgaactgcctgttgagcgtcgccgatcattgcctgcgttcgcgcgattacgtgaacgtgatcgtcgccgacaagcagcctcatttgcagtatctggacatgccgtcggccatcacgcattgcacgaaaggcatcggcatctgggactgggcgtcgacggatcaggaccacgagcccgacgtcgtgatggcgagcgcaggcgacatcccgaccatggaagcgctggctgccgtcgaaatcctcaaggcgctgttccccgacctgaagatccgcttcgtgaacgtggtcgatctgttccggctaatgccggccgccgatcatccgcatggcctgtcgacgcgcgatttcgattcgctcttcacgacagacaagcccgtgatcttcaacttccattcgtacgcttcgcttgtccacaagctcacgtatcgccgcacgaatcacgagaacatacacgtgcacggctacgcggagaagggcaacatcaatacgccgctcgagcttgcgatcatcaacggcatcgaccgcttctcgctcgcaatcgacgtgatcgatcgcgtgccgtcgctacggggcgtcggcgatcacgcgaaggaacgcctgcgcgacaagcggatcgagcacctccactacgcgcacacggagggcattgactccgaagagattcgcgagtggacgtggaagggctag

SEQ ID NO: 117 - DNA, 2388 bp, Acidobacterium capsulatum ATCC 51196
atgagcaagacagcgacgaatgccgaacccacgctgaaaccacaagaattgcagcgcatggatgcgtactggcgcgcgtgcaactatctggcggcaggcatgatttatctgcgcgaaaatccgctgctcaaagagccactgcggccggagcacatcaagaatcgcctgctgggccactggggatcggaccccggtcagagctttgtgtgggtgcatctgaaccggctgattcgcgagcaggacctgaacatgatttatatctcggggccgggccatggcgcgcccgccacgctggcgaactgctatctggaaggcacgtattcagagatctatcccgacaagagccacgacgtggaaggcatgcggaagttcttccggcagttttcattcccgggcggcatcggcagccattgcacgcctgagacaccgggatcgattcatgaaggcggcgagctgggctacagcctttcgcatgcctttggcgcggcgtttgatcatcctgacctgattgtgaacgtggtggtgggtgacggcgaggccgagaccgggcccatggcaacgtcgtggcatgcgaacaagtttctgaatccggcgcgggatggcgcggtgctgcctattttgcacttgaacggttacaaaatcgcgaaccccacgattctggcacgcatctcgcatgaagagctggaggcgctgttcaccggatatggatggaagccctattttgtggagggcagcgagccggagcagatgcaccagaagatggccgcgacactcgattcctgcgtgcgcgagatcaaggagattcaagagcaggcgcgcgagagcgggaagtgggagcggccgcggtggccgatgattgtgctgcgttcgccgaagggatggaccggcccgaaggaagtggatgggcacaaggtggaggacttctggcgcgcgcaccaggtgccaattctgggcgtcaaggaaaaccccgaacacctgaagatgctggaagcgtggatgcgcagctatgagccggagaagctctttgacgagagcggacggctggtggccgagttgcaggaacttgcgccgaagggcgaccggcgcatgagcgcgaatccgcacacgaatggcggcaagctgcgcaagccgctcgacctgccggcattctgtgattttgcgctgaagtttcagcggcccggcgagatgtatgccagctcgacggagacgctgggcacctacctggcggaagtgtttcgccggaacccagagagctttcggctgtttgggcccgatgagacggcctcaaacaagttgagcggcgtgtatgaagccaccaagaaaacatgggaggccgggtacaagcccgaagatgccgatggtggcgagctggcggcggatggccgcgtgatggagatgctgagcgagcacacgctcgaaggctggctggaaggctatctgttaacagggcggcacgggttttttgcgacatacgaagcctttgtgcatgtgattgactcgatgtttaaccagcatgcgaaatggctggagaaatcgaagaaggagattcgctggcgcgcgcccatctcgtcactgaatttgctgattacatccgtggtgtggcggcaggatcataacggattcacacaccaggacccgggctttctggacattgtggcgaacaagagcgcggaggtcacgcgcatttatctgccgcccgatgcaaactgcctgttgagcgtggcggaccactgcctgaagagcaccgattacgtaaacgtgattgtggccgacaagcagccgcacctgcagtttttgagcgccgatgaagccatcaagcattgcaccaaaggcatcggcatctgggagtgggcgagcacagacaagggctgcgaaccggatgtggtgatcgccagcgcgggtgacattgccacgatggaagcactggccgccgcagcgctgctgcgcgagcatttccccaagctgaagatccgttttgtgaacgtggtggatctgttccggctggtgccggaggatgagcacccgcacgggctgccggagcgggactatgattcgctgtttcctccggatacgccggtgatcttcaacttccacggatatccgcagctcattcaccggctcacctaccagcgcaacaaccaccacaacctgcatgtgcatggatatcgcgagcgcggcaacatcaatacacctctggagttggccatcatgaacaaggtggaccgcttccatctggcgatgaatgcgattgaccgcgtgccggggttgcgtgcaattgggggccatgcaaagaactggctctttgaccaggtgaccgagcatgtgatgtatgcgcatgagcatggcattgatccggaggcgatcaacgaatggacatggcccgagtga

SEQ ID NO: 118 - DNA, 2367 bp, Leptospirillum sp. Group II '5-way CG'
atggcaccgcgtaccgaagaacaggaacttaaggagatggacgcctggtggcgcgccgcgaactatctctccctgggaatgctctacctgaaagacaaccctcttctgagattgccgctgacaccggatcatctgaagaaaagattgctcggacactgggggtccgaccccgggcagaacttcgtctgggtgcatgccaaccggctcatccgccgccacgatctcaacatgatctacatcagcggccccggacacggggcacccgcgaccctgtccaacgcctatctggaaggcacctacaccgaagtgtacccggaccggacagaggacacccggggactgaaaaactttttccggcagttttcctttcctggtggactcggaagccattgcaccccggaaacccccggatccatcaacgaagggggagaactcgggtacagcctgtcgcacgcctacggcgcagtgttcgatcatccggacctgattgcggtctgtgtcgtcggggacggagaagccgagaccggcccgatggccacctcctggcactccaataaattcctgaatcccgtcacggatggcgcggtccttccggttctgcacctgaacggatacaaaatcgccaatcccacgatcctcgcccggatttccccggaggaactcaaaagcctttttgtcggttatggctacaagcccgttgtggtcgaaggggacgatccggcggagatgcatctaaaaatggcgaaagccatggactcctgcctgtcggacatccgacggatccagaaaaattcccgttcgtcaggagtccctgcccgagccccctggcccatgatcatcctgcgcacgccaaaaggctggacggccccgaaagagatggacggccatcgcatcgaaggattcttccgggcccatcaggtcccgatcctggatgccgccacaaacccggcccatctgtccctgctggagcaatggttccggaagtaccgcccggaagagctgttcgacgaaaacggaacgcttgttccggccgtgaaagccctggcacccaaaggcaacaggagaatgagcgccaatccgctcgccaacggcgggcttctccggaagccgctcattatgccggatttccgggattacgcggtggatgtgtccaaaccgggaacggtggaggccgaaaacacctttgttctgggaacgtttctccgggatatcatgaagaaaaatccccggaacttccgggtgttcggacctgacgaaaccgcctcgaaccatcttcaggccctctacgaggtcacgaaaaaagcctggatgggggaaacccgtcccgaggatgcggacggctgccagctggcaccggacggtcatgtcatggagatgctgagcgaacacacgctcgaagggtggctcgaaggatatctgctcacaggccggcacggactcctgaacacctatgaggcgtttgcccacatcatcgactcgatggtcaaccagcacgcaaaatggctcgaaaaagcaaaaacggacgtttcctggcgcgcaccggtctcctccctcaacattctcctgagttcgactgtctggcgtcaggaccacaacggtttcacccaccaggaccccggctttctggacgtcgtgacgaacaaacgggccagcgtggtaaggatttatctccctcccgacgccaacacccttctgagcgtcgccgaccactgtctccggagcaccgactacgtcaacgtcatcgtggccgacaagcagccccatctgcagtatctcgaccgtgatgcagccgcccgccatgcggccaagggcatcggtctgtgggagtgggcctcgaacgaccagggagaagaaccggacgccgtcatggcctgctgcggagacgtcgtcacgcttgaagccctggccgctgtcgcgatcctgcgagaaaagattccggatctccgcatccggtttgtgaatgtcgtggatctttttcgtctgcagcccccgtccgaacacccgcacggactatccgaccgggacttcgacagcctgtttacgacagaccgcccgattatcttcaattttcacggctatccctggctgatccacaagctggcgtatcggaggaccaaccaccggaacctgcatgtgcgggggtacaaggaaaagggcagcatcaacaccccgctgcagcttgcgatcgagaaccagatcgaccgtttttccctggccatcgacgtcatcgaccgcgttccccgggtcggagtccggggagctcatgtcaaggaatggctgaaagaccagattctggagcatcttgcatatgcgagccgggagggagaggatccgccagaagtggcccgatggaaatggcccttttga

SEQ ID NO: 119 - DNA, 2379 bp, Leptospirillum ferrodiazotrophum
atggccatggcaaaagagccggacgaaaaagagatcgaatccatcaataactattggatggccgccaactatctctctctcggcatgctctacctgcgcgacaatcctctcctcgaagcccccctctctcccgaccatctcaagccccgccttctcggccactgggggtcggatcccggacagaacttcgtctgggcgcatgccaatcgcctcatcaaaaggcacgacctctccgccatctacatcagcggacccggacacggcgcccccgcctccctggccaacggctacctcgagggaacctattccgagctctaccccgaccggagccaggacagggaggggatgaagacgctcttccgccgcttctcccaccccggcggggtcggaagccactgcacccccgaaacccccggatccatcaacgagggcggcgagctcggctacagcctctcccacgccttcggggcggccttcgacaaccccgaccttctggtggtggccgtcgtcggggacggagaggcggagaccggtccgatggcgacctcctggcattcgaacaagtttctgaaccccagacaggacggagccgtccttcccgtcctgcacctcaacgggtacaagatcgcaaaccccaccatcctctcccgcatctcccgcgaggagatcaaaagcctcttcgagggctacgggtacgttccccacttcgtcgagggggacgatcctctccccatgcatcggctgatggccagaaccatggaaaaatgcctctcggaaatccgcaccatccagaagaaggcccgggaatccgaccgcccggagcgggggcggtggcccatgatcgtcctccggacccccaagggctggaccgcccccaaggagctcgacggacacaagatcgaaggctccttccgggcccatcaggttcccatcctcgacgccgccaccaatccggcccatctcaagatcctcgaggactggttccggagctatcgcccccaggaccacttcgacaaaaacggaaccctgcgcgccgagctccgggagctggcccccaagggcccccgccggatgagcgccaatcccgtggccaacggagggctcctgcgaatcccccttcgccttcccgacttccgggactatcaggtgcccgttccccggcccggaggggtcgtggaccagaacacccttcggatggggcagttccttcgggatgtcatgaagatgaatcccgggaaatttcgcgtcttcggccccgacgaaaccgcctccaaccatctccaggccctttacgaggccaccggcaaggcctggatggccgaaacccttcccgaggacgccgacggaacctttctctcccccaccggccatgtgatggagatgctgagcgagcacaccctcgaaggctggctcgagggctaccttctcaccggacgccatggcctcatcaacacctacgaagccttcgtccacatcatcgactccatggtcaaccagcacgccaagtggctggaaaaatcccggggggacgtctcctggagagccccggtctcctccctcaacattctcctctcctccaccgtctggaggcaggaccacaacggcttcacccaccaggatccgggctttctcgatgtcctgaccaacaagagccccaaggtcgtgcggatctaccttccccccgacgccaactgtctcctgagcgtcaccgaccactgccttcggagcaccgactatgtcaacgccatcgtggccgacaagcagccccacctgcagtttctcgacatggagtcggccatccggcactgcaccctggggatcggcctctgggagtgggcgtcgagcgacgggggcgaggatcccgacgtggtcatggcctcggcgggcgacatcgtcaccctggagtccctcgccgccaccgcgatcctccgggagctctttcccgacatccgcatccgcttcgtcaacgtggtggacctcttccgcctcgttccccagagcgagcatccccacggattctccgaccgggacttcgacagcctcttcaccgtcgaccgcccgatcatcttcaacttccacggctatccgtggctcatccacaagctgacctaccggagaacgaaccacaggaatctccatgtgcgcggctacaaggaacaggggagcatcaatacccccctgcagctcgccatcgaaaaccagatcgaccgcttctcgctggccatcgacgccatcgaccggatcccccggcttcagagcaagggggcccatgccaaggaatggctcaaggggcagatcatcgaccacctgcgctttgcccgggagcagggcatggaccgtccggagatcgaagccttccgctggcccttccccaaatag

SEQ ID NO: 120 - DNA, 2391 bp, Synechococcus elongatus PCC 6301
atgacaagtaccttgcaagcgacggatattgccacactaagtcccaacgaacaggctgcgatcgatgcgtggtggcgagccgccaactacctgtcggttgggcaaatttatttacgagataatccgctgctgcaagaaccgctgcggcccgaacatatcaaacagcggttgctggggcactggggaagcgatcccggcttgagctttgtctacgttcatctcaaccgcttgatccgccgcttggatctcaacctgatctacgtcacaggcccaggtcacggcgctccggcactactggcgaatgcttggctcgagggaacttacagtgaggtctatcccaactgtcagcagtcgaccgctggactccaacaatttttcaagcagttttcattccccggcggcattggcagccactgcacgcccgaaacacccggatcgatccacgaaggtggcgagttgggctacagcctctcccacgcttttggggcggcgttggataatcccgacctgattgtggcctgcgtgattggtgacggcgaagccgaaactggcccgctggcaacctcttggcattccaataaattcctgaatccggcgcaggatggagcggtgctgccgattctgcacctcaacggctacaaaattgccaaccccaccttgctgtcgcggatttcccatgaggagctgcgcagtttgtttattggctacggctacgaaccctttttcgtcgaaggcaatgatcccgccatcctgcatggcgtgatggctagcaccctagcgacttgtgttcagaagattcaggcgattcaagccgcggcacgatcgggagaaagtagcgatcgcccgatgtggccaatgattgtgctgcgcacacccaaaggctggaccggccccgccacgatcaaggggcacgttgttgaagggtcttggcgatcgcaccaagtaccaatggctgatgtgctgacgaatcctgagcatttgcaactgctggaagactggctccgcagctaccgaccggaagaattgtttgatgcaagtggcgcaccagtcgcagaactgcaagcgatcgcaccaatcggcgatcggcggatgagtgcaaacccagttacaaatggcggcttgctacggcgtgccttgaccctgccagatttccgcgatcaagcagtgtctgtaccggctcctggcaaaagccgtgcagattcaacgcgaccgctgggtcaattcctgcgcgaggtgatccgtcacaatcccgataacttccgcctgtttgggccggatgaaacggcctcgaaccggctagatgcggtttatgaagtcacttcgaaagtctggctgggcgatcgcattcctgaggatgaggatggcggccacctgagcgatcgcggccgggtcatggaaattctgagtgaacacaccctcgaaggttggctcgaagcctacttgctcacgggtcgccacggcttttttgccacctatgaagcctttgcccatgtgattgattcgatggtcaatcagcatgcgaaatggttggatgtcagcaagcgggaagtcgattggcgagcccctgtttcgtcgttaaatatcctgctctcctcgaccgtttggcgacaggatcacaatggctttagccatcaggatcccggctttattgatctggttacgaataagagtgcacgagtcacccgcatctatctaccgccggatgccaactgtctactctccgttgctgatcactgtctgcgcagcacagactatatcaacgtcatcgtggcggacaaacaaagtcaccttcagtatctcgatgctgaggcagctgctcgccactgcgctaaagggattggcatttgggattgggcaagcaatgaccaaggagcttcaccggatgtcgtgattgctagttgcggtgatgtcgtcaccttggaagcgttggcggcaacagcgttgctccgtgagcattttcccgatctcaaaattcgctttgttaatgtggtggatctgttccgtcttcagccggataccgaacatccccatgggttaagcgatcgtgatttcgatagcctatttacggttgacaagccgattatcttcaacttccatggctacccatggctgattcacaaactggcctatcgccgccacaatcacaacaacttgcacgtgcgcggctacaaggaagttggcaacatcaatacgccattagagctagcgattcgcaatcaagtcgatcgctttaaccttgcaattgatgtgatcgatcgcgttccgcatctacgtgatcgcggtgcccatgtcaaagagtggctcaaggatcaaatccacgaccacattcaatatgcctatcaagaagggatcgatcgccctgaaatcaatcagtggcaatggcctttctag

SEQ ID NO: 121 - DNA, 2439 bp, Thermosynechococcus elongatus BP-1
atggtaagctctcctccccgtcccaccgcactcaccgacgatattcatgcttttggtcctgctcgcgccacgattcaaggacagcccctgagcgatagcgaagttgaggccatggatgccttcttccgtgcctgtaattatttggcagtgggcatgatctatttacttgataaccccctgctcaaagaacccctgaagcccgaacacattaaaaagcgccttctgggtcactggggatcgagtcccggcttggccttttgctatttgcacctcaaccgcattatcaaaaaatatcaacaggaagttatttttttagcggggcccggccatggtgccccaggagtattagcaccggtttaccttgagggtagctacagcgagatttaccccaacatcagtgaagatgcagcaggcttaaaaaaattctttaagcagttttccttccccggtggcattggcagccactgtacccccgaaacccccggctcaattcacgaagggggagaactgggctatgtcctctcccatgcctgtggcgccgccttcgataacccggatttgattgtggcagcggttgtcggcgatggcgaagcagaaacagcacctctggctacctcgtggcacatcaacaagttcttgaacccagcgcgggatggggcagtcttgccgattctcaacttgaacggctacaagattaacaacccgacaattctggctcgcattccccatcaggatttggagaactacttccgagggttgggctatgacccctgctttgtggaagggtccgatcgcccctccatgcaccaagcaatggcggcaaccttggactactgtgtcaccagaatcaaagaaattcagcggacagcccgtgaagagggcctcaccaccttaccccgttggccgatgattgtgctgcgtacccccaaaggctggacgggcccagcggaagtgaatggccacaaagtggaaggctcctggcgagcacaccaagttcccttggcggatgttcacaccaaccccgaaaatctccagctgctggaaaattggctgcgcagctaccggcctgaggagctctttgatcacaatggcaccttccgccctgacctcaaggccctagcacccacaggcaactaccgcatgggcatgaatccccacgccaatggcggcctactgcgcaaagatttgaaaatgccgaatttccgggagtacggcattacatttgacaaaccgggacaaatcgaggtggaaaatacccgtcccttgggggtctttctgcgggatgtcatgcgcaacaaccccaggaattttcgcatctttggtcccgatgaaaccacctcaaacaagctcaatgcggtttatgaggccagcaagaagttttggattgccgagtcctttgatgaggatgccgatggcggtgagctgtccccggaggggcgcgtcattgaaatgctcagcgagcacacgctggaggggatgctggagggctatctgctcacaggtcgccatggctttttctccacctatgaggcgtttgtccatgtgattgattcgatgttcaaccagcatgccaagtggttgagcatttgcaatgaactgtcgtggcgggcagatgtttcctctttgaacctgctgattacctcaacggtgtggcggcaggatcacaatggcttcactcaccaggatcccggatttctggatattgtctgcaacaagagtgccaaggtgacgcgcatttatctacctcccgatgtgaattcgctgctgtcggtggcggatcactgcctgcggagcaaaaattatgtgaatgtgattgtttctgataagcagttgcacttacagtacctgacgatggatcaggccattatccactgcacaaagggcgtaggtatttgggattgggccagcaatgatcaaggctacgaaccggatctggtcatggccagtgctggggatattcccacccaagaggcgttggcggcgatcgccctcctgcggcaggaatttccagagctcaagattcgctacattaacgtggtggatctctttaagctgcaaccggaaaccgaacacccccatggcctcagcgatcgcgactttgatagcctatttaccctcgatcgcccgattatctttaacttccatggctacccgtggttaattcaccgccttgcctaccgccgccacaatcaccgtaatttgcacgtgcggggctacaaggaaaagggcaacatcaacacccccttagaattggccatcaataatgagattgatcgctttagtctggccattgatgccatcgatcgcctccctgaacttcaggtggcgggtgcccatgccaaggaaaaattccgcaacatgcaaattgcagcccgcaactatgcctacgagtacggtgtagacaagccggagtttagccactggacatggcccttctag

SEQ ID NO: 122 - DNA, 2436 bp, Methylococcus capsulatus str. Bath
atggcaacccaattccccctgtcctccgaattcgaacggctcaccgtctacgggccgacccgcgccactgtcagcggaacaccgctggatgccgaagaagtccgcaaaatccatgcgttctggcgagcctgcaattacctggcgctgggcatgatctacctgcgggggaatccgctgctgcgtgaaccgctcaaacccgagcacatcaagcaccgtctgctcggccattggggctccagccccaaccttgcgttcgtctacacccatctgaaccgggccatccggaaacacgacctcgacatgatcttcatggccggccccggccacggcgcccccggcgtgctgggcccgctctacctggaaggcagctactccgaaatctaccccgacaaggacctgagcgaagaaggcctgctgaacttcttcaagcagttctccttccccggcggaatcggcagccattgcacccccgagacaccgggctcgatccacgagggcggcgagctgggctacgtgctgtcgcacgcctgcggcgcagccttcgacaacccggacctgatcgtggccgccgtggtcggcgacggcgaggcggaaaccggccccctggccacttcctggcacatcaacaaatttctcaacccgatccgcgacggcgcggtgctgccgatcctcaacctcaacggctacaagatcaacaaccccaccctgctggcgcgcatcagccacgaagaattggaaaatctgctcaggggttacggctacacgccttatttcgtggagggctcggaaccggaaagcatgcaccaggcgatggccgcgacggtggaccgcagcatcgaagacatccgcgccgcccagaccgaggcccgcgccagcggcatcgcccgacggccgcgctggccgatgatcgtgctgcgctcgcccaagggctggaccgcgccacgccagatcgacggccacaacgtcgagggcttctggcgcgctcatcaggtgccggtagccgacgtcgcgaaaaatcccgaacacctgaagctgctggaaggctggatgcgcagctacaagccggaagaactgttcgacgccgaaggctgccccgtcgccgaaatccgggaaatggcgccggccggtctccgccgcatgggtctcaacccccacgccaacggcggccatctgaaaaaggccctgcgcatccctaatttccgcaactacggcatcgaagtcgccaaaccgggccagatcgaagcgccgaacacccagccgctgggcgtgttcctgcgcgacgtgatgaaggagaacgcgcacaacttccggctgttcggccctgacgagaatacctccaacaagctggacgccgtctacgccgctgccaagaaattctggatcgccgagtatttccccgaagaccaggatggcggcgaactggcccccgacggccgggtcatggaaatgctcagcgagcataccctggaaggcatgctggaaggctaccttctgaccgggcgccacggcttcctctcgacctacgaagccttcgtccacgtcatcgattcgatgttcaaccagcacgccaagtggctgtccatctgcaaccagctgtcctggcgccaggacgtggcctcgctcaacctgctcatcacttcgacggtctggcgacaggaccacaacggcttcacccaccaggaccccggtttcctggacgtcgtcgtgaacaagagcgccgacgtcacccgcatctacctgccgcccgacgtcaacagcctgctgtcggtcgccgaccactgcctgcgcagccagaactacatcaacgtgatcgtgtcggacaaacagttgcatctgcagttcatggacatggacgccgcgatcgcccattgcacggagggcttgggcatctgggaatgggccagcaacgacgagggccaggagcccgacgtggtcatggcctgcgccggcgacatcccgaccctggaagccctggccgccaccgccctgctgcgcgaggagttcccggaactgaagatccgcttcatcaacgtggtggatctgttcaagctgcagcccgagtccgagcatccgcacggtctcagcgacaaggatttcgacagcctgttcaccagggacaagccggtcatcttcaacttccacggctatccctggctgatccaccgcctcgcctaccggcgcaccaaccacgccaacatgcacgtgcgcggctacaaggagaaaggcaacatcaacaccccgctggaactggcgatcaacaaccagatcgaccgcttcagcctggccatcgacgtcatcgaccggattccggagatcgcggtctccggcgcccacgccaaggcccggttccgcaaacagcagatcgcctgccgccagtatgcctacgagcacggcgtcgacatgccggaggtcgcgggctggcgctggccgggctga

SEQ ID NO: 123 - DNA, 2442 bp, Cyanothece sp. PCC 7425
atggtagccacacccgaaaaacccacctttgatgaaatgcgctcgattagcgcctatggcgaggcccgctccaccattgccgggacacctctcagtagcgaagagttgcaaaacctccatgccttctggcgggctgctaactatctggccgtgggcatgatctacctgcgcgacaatccattactgaaggaaaccctccagccggagcacatcaagcggcgcctcctgggccactggggttccagtccggggatcagtttcctctatacccacctgaaccgggtgatcaaaaaatttggccaggaaatgctctttatggtcggtgcggggcatggggcccctgggtttctcggtccttgctatctggagggcagctattcccacttcttcccggaatgcagtgaagatgaagcgggaatgaaacagttcttcaaacagttttctttccctggtggggtgggcagtcactgtaccccggaaacgcctggctcgattcatgaagggggcgaactcggctacagtctctcccatgcgtttggggccgctttcgataatcccaatctgattgtggtagccatgcccggcgatggtgagtcggaaaccggtcccctggctacctcctggcactccaacaaatttatcaacccgatccgcgatggagccgtactccccgtcctgcacctgaatggctataagatcaataaccccactatcctctcgcggatcagccatcgggaactgaaagcgttatttgaaggttacggctatactccctactttgtggaaggctctgacccggaatcgatgcaccaggccctggctgccactctagatcactgtattgccgaaattcataccattcaacagcaagcgcgcagtagtggccaagccacccgtccaatctggcccatgattgttttgcgcacccccaaaggttggactggacccgtcgaggtggatggccacagggtggaaggcttctggcgggctcatcaggtgccgatggggggcatgcacagcaatcctgaccatgtgcgccagttagcagcctggatgaagagctacaaaccggaagaattgtttgatcccgatggcactctgatcagttcgatcaaggcccaggcacccaccggcgatcgacggctgggttcgactccctacgccaatggtggcttactgcggcgcgatctaaagatgcccgattttcgccagtatggggttgcagttgaaaaaccggggacactggaagtcgaaaataccaaacccctgggtgcctttctgcgggatgtgatgaaggccaattcgaccaacttccgtgtcttcggccccgatgaaaacacctcgaataaactgcatgcgatttatgaggtgagtaaaaagttctggattgccgattacctgccggaggatgcagatgggggggaactctcgccggatggacgggtgatggagatgctgagtgagcataccctggaaggctggttggagggctacctgctcaccgggcggcatggcttcttttccacctacgagtcctttgcccacgtgattgactccatgttcaatcagcatgccaagtggttagagatttgcaaccatattcactggcgtaaggagatctcctccctcaatctgctgattacctcaacggtgtggcggcaggatcacaatggttttacccatcaagatcccggctttctggatgtggtgctgaacaaaagccccgatgtggtgcgaatttaccttccccctgatgtcaatacattgctttctgtggcagaccattgcttaaggagtaaagactatatcaatgtaattgtctccgacaagcagttgcacctgcagtaccacagtatggatgacgccattcggaactgcaccaagggggttgcgatctgggattgggccagtaatgaccaggggggtgaaccggatgtggtgctggcggcggcaggggatattcctacccaggaagcgttggctgcctccgtgctgctgcgggagaacttccctgacctgaagatccgtttcatcaatgtgattgacctgttcatgctgcagcccagtagtgaacatccccacggtctgagtgacaatgattttgattctctgttcacgctggacaaaccgatcattttcaatttccacggctatccctggttaattcatcgcctcacctaccgccgacacaatcacaaaaacctgcatgtgcgcggctataaggaaaagggcaatattaacacccctctggatctggcaattcagaatcagatcgatcgcttcagtattgccattgatgtgattgatcgaattcacagattaaaagtggccggggcccacgtgaaggaaagcctcaaaaatgagcagatcgattgccgccattatgcctatgaacacgggatcgatcgccccgatattgtcaactggaagtggccctactaa

SEQ ID NO: 124 - DNA, 2466 bp, Synechocystis sp. PCC 6803
gtgggttctaccctggtagggaaatgtacaagtctgggagttttttccatggttacatcccccttttcccttagtccctttggtcaagctagatccaccgtcactggcaatccccttgacccgacagaacttaaccaaatgcacggtttttggcgggcagccaactacttggcagtgggcatgatttatctgcgggataatccccttttgcgggaaccgcttcaaccggaacagatcaagcatcgcctgttgggtcactggggttctagtcccggcattagttttctctacacccatctcaaccgcattatcaggaaatttgaccaggatatgctgtacatggtggggcctggccacggcgcaccaggctttttggggccctgctacctagaagggagctattctcgcttttttgccgagtgtagtgaagatgaggacggcatgaagcgctttttcaaacaattttcctttcccggtggcattggcagtcattgcactcccgaaacccctggttccatccacgaggggggagaattgggctactgcctatcccatgcctatggcgctgcctttgataatcccaatttaattgtggtcggtttagcgggggatggggagtcggaaacaggccccttggctacctcctggcattccaataagtttattaacccgattcgggatggggcagttttaccggttctgcatctcaatgggtacaagattaacaatccaagtgttttatctcgcattagccatgaagaattaaaggctttatttgaaggttacggttataccccctactttgttgaaggctctgacccggaatctatgcaccaagccatggcagccacgttggatcattgtgtgagcgaaattcatcaaatccaacaagaagctcgtagtacgggcattgccgtgcgcccccgttggcccatggttgtgatgcggactcccaagggatggacggggcctgactatgttgatggccataaggtagaaggtttttggcgatcgcaccaagttcccatggggggcatgcacgagaatccagcccatttgcaacagttggaagcttggatgcggagttataagccggaagaattgttcgacgagcaaggtactttaaaaccgggatttaaggcgatcgccccggagggagataagcgtttaggctctactccctacgccaatggtggtttgttacggcggggtttgaaaatgccggactttcgtcaatatggtattgatgtggaccaaccaggcaccatcgaagcccctaatactgcacccctgggagtatttctgcgggatgtgatggccaacaacatgaccaatttccgcctgtttggccccgatgaaaatagttccaataaactccatgccgtctacgaggttagcaaaaaattctggattgctgaatatctagaagaagaccaggatgggggggaattaagtcccgatggtcgggtgatggaaatgttaagcgagcacaccttagaaggttggttagaggcctatcttttaaccgggcgtcacggctttttcgccacctatgaatcctttgcccatgtgatcacttccatggttaaccaacacgctaaatggttggatatttgtcgacacctcaactggcgggcagatatttcctcgttaaatatcttgatgacgtccaccgtgtggcgacaggatcacaacgggtttacccaccaagatcccggttttctcgatgtcattctcaataaaagccccgatgtggtgcgaatttatttaccccccgatgttaattctctgctttccgtagcggaccattgtttacagagcaaaaactacatcaacatcatcgtttgcgataagcaagcccacctgcaataccaggacatgacttccgctatccgtaactgcactaaaggggtggacatttgggaatgggccagtaatgatgccggtacggaaccggatgtggtgatggcagcggcgggggatattcccaccaaagaggccttggcggccacagccatgctaaggcaattttttcctaatctgagaattcgctttgtcagcgtgattgatttgctcaaactgcaaccggaatcggagcatccccatggcctgagcgatcgggattttgactccctctttaccaccgataaaccgattatttttaacttccacgcctatccctggttaattcatcggttgacctatcgacggactaaccatggcaatctccatgtgcggggctacaaggaaaagggcaacatcaacacccccatggatttagcgattcaaaaccagattgaccgtttcagcctcgccattgatgtgatcgatcgcctgccccaattgcgggtggccggagcccacatcaaggaaatgctcaaggatatgcagattgactgcaccaactacgcctacgaacacggcattgatatgccagaaatcgttaattggcgctggcccctctag

SEQ ID NO: 125 - DNA, 2466 bp, Cyanothece sp. PCC 7425
atgattgcaacccctgaaagaccccccattgaggatatcaatgccatcagtgcctttggcctggctcgctccacggttaccgattccctcctcagcccgacagaactggagcacatccatgcctactggtcggcctgtaactatctagccgtggggatgatctatctgcaagccaaccccctgctgcgagaacctctgcaaccggaacagatcaaaaatcgcctcctgggccattggggaaccagccccggactatccttcatttacgtgcatttgaatcgcctgatcaaaaaatatgacctggatatgatctacctggctgggccgggacatggcgcaccgggcgtgctgggaccagtgtatctggagggtacctattccgaaatctacccagataaaagtgaagacatcgaaggactgcaaaaattctttcggcaattttcctttcccggtgggattggtagccatgccaccccggaaacccctggttccattcatgagggcggcgaactgggctatagcatttcccatgcctacggaagtgtgtttgacaatcccgacctgatcagtgccgtggtggtgggagatggggaagcagaaaccggccccctggccactgcctggcattcgaataaattcctcaaccccgttcgggatggagccgtgctgccgattctgcacctgaatggctacaagatcaataatccaaccctactctcccgcatcagccatgaagagttagaattcctcttccggggttatggctataccccctattttgtcgaaggttcagacccggcctccatgcatcaggcgatggcagccaccctggaacattgtttgaacgaaattcgcaccattcagcagcaggcccgacagggagatgggggtgaaaatgtgctgcgaccgcgttggccgatgattgtcttgcgatcgcccaaggggtggacagggccccaacaggtggatggccacaaagtggagggatactggcgggcccatcaggttcccctcaccgctgtccagagcaacccggaacacctgcacatgctggaggactggctacgcagttatcaaccggagcaactttttgatcaacagggccgcttaattccagagctgaaagccttagcccccaccggaacccggcgcatgagtgccaatccccacgccaatggtggactgttgaaaaaagcactgcggatgcctgactttcgcgactatggcataggaatcgagcaaccggggcaaaggatggccgaaaataccaaacccctgggagcctttttgcgcgacatcatgaagctcaaccccaggaatttccgcgtgtttggcccggatgaaaccacctccaacaaattgaatgccgtctacgaagccagcaaaaagttctggattgcccagtacctaccggaagatagcgatgacggccaactggcaccggacgggcgggtgatggaaatgttaagtgaacataccctggagggctggctggaaggctatctgctcaccggacggcatggtttcttctctacctatgaagcctttgtccatattattgactcgatgtttaatcagcacgccaaatggctgcagatctgtgaacatctgtcctggcgacaatcgatcgcctccctcaacttactgatcacctccaccgtctggcggcaggatcacaatggctttacccatcaagatccaggatttcttgatattgtggtgaacaaaagccctgcagtagtgcgaatttacttaccccccgatatcaactgcctgctgtccgtcgcggatcactgtttacgcagcgaaaactacattaatgtcatcgtttcggataagcagttacacctgcagtacctggatatggaggcggcgatccagcactgcacgaagggacttgggatctgggactgggccagtaatgaccagggagctgaacccgatgtggtgatggcctgtgctggggatattcccactcaagaagctttagcggccaccgccctgttgcgtcaggagttccccactttaaaaattcgctttatcaatgtggtggatttactgcggttgcaaccggaaagtgaacatcctcatggcatgagcgatcgcgactttgattccctcttcaccctggacaaaccgattatctttaacttccacggttatccctggctgatccatcgcctcgcctaccgtcgcaccaatcaccccaatctgcatgtgcggggctataaggaaaagggcaatattaacacgccgttagaactggcgattcggaatcagatcgatcggttcagtctggcgatcgatgtgatcgatcgagttccctggttaaaggttttaggtgcccatgccaaagaaaagttcaagaatatgcagatcgaatgccgtcattacgcctacgagtacggactggataaacctgaagtagcgaattggcaatggtcctctagcccagcccagccttaa

SEQ ID NO: 126 - DNA, 2370 bp, Allochromatium vinosum DSM 180
atgacgaccgccaccccgctcacacccgagcagctcgaccggatcgacgcctactggcgcgcctgcaactatctggccgtgggcatgatctatctgcgcgacaatccgctgttgcgcgaaccgctcaagccggagcacatcaaacagcggctcctgggccattggggcgcgagtcccgggctctcgttcatgtatgtgcatctcaaccggatcatccgcgagcgcgatcaggacgcgatctttctcgccggtcccggtcatggcgcaccgggcgtgctggcgccggtctatctggaaggcacctactccgagatctatcccaacaagagcgaggacgaggagggcctgaaggcgttcttcaagcagttctccttccccggcggcatcggctcgcactgcacgcccgagacgcccggatcgatccacgagggcggcgagctgggctactcgatctcgcatgccttcggcgcggccttcgacaatccggacctgctggtcgcggtggcggtcggcgacggcgaggccgagaccgggccgctggccacctcctggcattcgagcaagttcctgaatcccatccgcgacggcgcggtgctgccgatcctgcatctcaacggctacaagatcaacaatccgaccctgctctcgcgcatccccgacgaggagctggccagtctcatgcgcggctatggctggacgccgcatttcgtcgcgggcgacgatccgctgaccctgcatcagaccatggcggcgacgctggacgcctgtcacgaccagatccgcgccatccagcacgccgcgcgcgcaagcggtgaggccacacgcgcccactggccgatgatcgtcttgcgcacgcccaagggctggaccggcccgtccgaggtcgatgggcacaaggtcgaggggttctggcgcgcgcatcaggtgccgctctcggggatgcacgacaatccggaacacctcaagcagctcgaagactggctgcgcagttacagacccgaagagctgttcgacgcccagggacggctgatccccgaactcaaggcgctcgcgccccaaggaaccaaacgcatgagcgccagcccgcacgccaacggcggactgatccgccgcgcgctgcggatgccggatttccgcgactatgccatccgggtcgacaagcccggcaccgcgcgcgccatgaacaccaagccgaccggcgcgctactgcgcgatgtgatggcgcgcaacctggacaacttccgcgtcttcggcccggatgagaacagctccaacaagctcgatgcggtctatgaggtcagcaaaaaactctggctgtgcgactacaagcccgaggatgccgacggcggcgaactctcacccgacgggcgcgtgctcgaaatgctctccgagcacaccctggaaggctggtacgagggctatgtgctgaccgggcgtcacggtttcttcgccacctatgaagccttcgtccatgtcatcgacagcatgtacaaccagcacgccaagtggctgtcgatctgcgaggacatcccctggcgcgcgcgcatctcctcgctcaatctgctcatcacctcgaccgtctggcgtcaggatcacaacggattcacccaccaggatccggggttcctcgatgtcgtcgtcaacaagaaccccgaggtcacgcgcatctatctgccgccggatgtgaacaccctgctctcgaccgtcaaccactgcctccagagccgcgacgacatcaatgtcatcgtcgccgacaagcagagccacttgcagtatctcgacatggatgcggccatcaagcactgcaccaagggcatcggcatctgggagtgggcgagcaacgatcagggcgccgaacccgatgtggtgatggccggctgcggcgacatcccgaccaaggaggcgctggcggccacggctctgctgcgcgagcatttccccgacatcaagatccgcttcatcaacgtcgtggatctgttcaagctccagccggcgggcgagcatccgcatgggttgtcggacgcggatttcgacagtctcttcaccaaggaccgtccgatcatcttcaacttccacggctacccctggctgattcatcgactggcctatcggcgcaccaatcacaagaacctgcatgtgcgcggctacaaggaaaagggcaacatcaacacgccgctcgaactggcgatcagcaatgagatcgaccgcttcagtctggcgatcgacgtcatcaaccgcgtgccgcggctccaggtggccggggcgcatgtgaaggaaacgctgcgcgaccagcagatcgagtgccgcaactatgcctatgagcacggcatcgacaagccggatgtggatgagtgggtgtggccattctga

SEQ ID NO: 127 - DNA, 2367 bp, Mariprofundus ferrooxydans PV-1
atgaatcaacgttcgctcggtgctgaaaaactcaaagccatgcatggcttttggcgggcctgcaactatctggcggccggcatgatctatttgcgggataatccgctgctctccgggccgctcaagccggagcacatcaagcagcggctgctggggcactggggttccagtccggggctgagctttatctatacccaccttaaccggcttattgtcgagcaggatgtgaatgcgatctttcttgcaggtcccggtcacggcgcacccggcgtgctggcgccggtttatctggaagggcgctacagcgaggtatacccgaacaagagcgaagatgaagaaggtatgcgactgtttttcaaggatttctcttttccgggaggtatcggcagtcactgtacgccggagacgccgggttcgatccatgaaggcggtgagttgggttactcgatttcacacgcattcggcgcggcattcgacaatccggatttgctggttgcggttgttgtcggtgacggcgaggccgagacggcgccgctggccacatcatggcactccaataaattcctgaacccggtccgtgacggggcggtgctgccggtgctgcatctcaacggttacaaaatcaataacccctcggtgctgtcgcgtatccccgccgaagagctgaccagcctgatgcagggctatggctggaagccctgttttgtcgagggcgatgatccggagctgatgcaccagcagatggctgcagcgctggatgaatgtatggcggagatccgcagcatctggagtgcggctcgcgaggagggggtaactgagcgaccgctgtggccgatgattgtgctgcgctcgcccaaggggtggaccgggccggcagaggttgacggtcaccaggtggaaggttcctggcgggcccatcaggtaccgctaaagggtgtacgggagaatgaagagaaactgcatcagctggaagcgtggttgcgcagttatggtccggaagagctgtttgatgccgaaggctgcctccggccggaatttaaaacgctgacgccgaaaggggagcgtcggatgagtgcgaaccagcacgccaacggcgggcggttgcgccggatgttacgtttgccggatttccgcaggtatgcgctggaatttgagaaacccggcacggttgaagcggagaatacgcgaccgctgggtcgttttctgcgcgatatcatgagcaggaatatgcataacttccgggtgttcagtccggatgagaacagctccaacaagctggatgatatctatcaggccagcaaaaagtgctggatggccggacggttgccgatcgatagcgacggcggcgaactctcggccgacgggcgggtgatggagatgctctccgagcatacgctggaaggttggctggaaggttatctgctgaccggtcggcacggcttcttctccacctacgaatcctttgtgcatgtcattgattcgatgttcaaccagcacgccaaatggctggcgatgtcgcgcgatgtggactggcgggcgtcggtatcgtcgctgaatatgcttattacctccacggtatggcgtcaggatcacaacggcttcacgcatcaggatcccggctttctggacctggtggtgaacaagagcccgaaggtgacccgcatctatttgccgccggatgtgaataccctgctggtcacagccaatcactgcctgaacagccacgactacatcaatgtcattgtggccgacaaacagaatcacctgcaatacctcgatatggatgccgcaatcaagcactgtaccaaggggctggggatctggtcatgggccagcaatgatcaggggtatgagccggatgtggtgatggcatgcgccggcgatgtgcccacgcgcgaggcgctggcagccacgtatctgctgcggcagcacttcccggatttgaaggtgcgttttatcaatgtggttgatctctacaagctggtgccggactccgagcatccgcacgggctgaccgatcgcgactatgacagcctgtttaccgttgataagccgatcatattcaacttccacggttatccgtggctgattcatcgcctggcctaccggcgtacgaaccacaaaaacctgcatgttcgcggttacaaggagcacggcagcatcaatacgccgctggagctggcgattgcgaacgagatagaccgcttctcgctggcgattgatgtgattaatcgcattccccgtctggcagtggccggagcccatgtcaaagagcagttgcgcgatcagcagcttacctgccgacaatatgcctacgaacacggcgtcgacctgcccgaggccaccaactggacatggccattgtga

SEQ ID NO: 128 - DNA, 2370 bp, Gallionella ferruginea ES-2
atgaactcaaaaattcctcccttgtcagctagcgaaataaaccatatcaatgcctactggcgcgcctgcaactatctggctgccggcatgatttatctgcgcgacaatccgctgctcaaagagccactcaagctcgaacacatcaagaaccgcctgctgggacactggggatcaagccccggtctgtctttcggctatatccacatgaaccgtctgatcgtcaaatacgatctgaatgcgatctttatggcaggcccggggcatggcgcgcccggcgtgctgggtcctgtgtatctggaaggccgctacagtgaggtgtatccgaacaagggtgaaaacatcgacggcatgcgccagtttttcaaggaattttcttttcccggcggcatcggaagtcactgcacccctgagacaccgggctccatccacgaaggtggcgaattaggctacagcgtctcacacgcctttggcgccgcttttgacaatcctgatctgatcgtcaccgtgatggtcggcgacggcgaatccgaaacagcccccttggcgacctcatggcactcgaacaaatttctcaatccgatccgggacggcgccgtgctgcctatcctgcatctgaacggctacaagatcaacaacccgaccatcctgtctcgcatctcgcacgaagagctggaaaacctgttcaagggttacggctggaccccctacttcgtcgaaggctcagaccccgaaaccatgcatcagcgcatggcacaggtgatggaagaatgcgtactggaaatccgccgcattcagaccgaagcacgcgagagcggcatcccggcacgtccgcgctggccgatgatcgtactgcgctccccgaaaggctggacgggacctgccgaagtggatggcaaaaaaatggaggggttctggcgctcgcatcaggtgccgattggcgacgtcaaaacgccggagcatttcgccaagctggaagaatggctgagcagttataagatcgatgaactgttcgatgaaaacggcaaactgttgccggaactcaaagcgctggcccccaaaggcatccgccgcatgagtgccaatttgcacgcgaatggcggcctgctgcgccgtgcactgcacatgcccaactgccgcgactacgccgttgaggtcaaaaatccgggcaccacggtcgcggaaaatacccgtccgctgggaaaattcctgcgcgacatcatgcaggccaatatgcagaatttccgcgtattcggcccggatgaaaacagctcgaacaaactcgataacatctatgaagtgagcaaaaaaacctggcttgcggactacctgccggaagatgcgggtggcggtgaactctcgccggatggccgcgtgatggaaatgctctccgaacatacgctggagggctggctcgaaggctacctgctctcgggacgccacggtttcttctcgacctatgaggccttcgtccacgtcatcgactcgatgttcaaccagcatgccaaatggctggcgatgtcaaaggacgtgccctggcgcgcgccggtatcgtcattgaatctgctgatcacttccaccgtatggcgtcaggatcacaacggctttacccatcaggatcctggatttttggatctggtggtcaacaagagccctgaagtcacccgaatttatctgccgcccgatgtcaattgcctgttgtcggttgccgaccattgcctcaaaagcaccgattacatcaacgtcattgtctgcgacaaacaaaagcatttgcagtttctcaacatggaagcggcgatcctgcattgcaccaagggcatcggcatttgggattgggcctgtaacgatcagggaagcgaaccggatgtcgtgatggcctcagccggtgatattccaaccaaggaagcgctggccgccgtgatgctgctacgcgagcatttcccggatctgaagattcgttttatcaatgtggtcgatctgtacaaactgacgccttccaccgagcaccctcacggcctgagcgatcgcgatttcgacagcctgttcacaaaagaccgtcctgtgatgttcaacttccacggctacccatggctgatacaccgtctggcctatcgccgccacaaccaccagaacttccacgtgcgcggttacaaggaaaaaggcagcatcaatacgccgctggaactggcgattcagaatcagatcgaccgtttcagtctggtgatcgacatcatcgaccgtctccctgccctgcaagtttccggcgcacacatcaaggagaagatgctcaacaagcagatcgaatgccgcaactatgcttacgcgcacggcatcgatctgcctgaagtcgacaactggacctggacgctttga

SEQ ID NO: 129 - DNA, 2436 bp, Aspergillus clavatus NRRL 1
atgacgtcaaaagtagaaaccgaaagcatctccgcatatggggctgcacgttctacgatcacaggtagtcctctcaacaatgaggacctgcgcaagaccgacgcctacttccgggcgagcttgtacctctgtcttggaatgctctacctgcgggccaatcctctcctaaaggaacccctcacagtggagcatctcaaggcccgattgctcggccactgggggtcggatgccggccaagcttttacctatatccacatgaaccggctcatcaagaagtacggcttggatgtgttgttcatctctggtcctggacacggtgcacccggtgtcttatcccagtcatacctcgaaggtgtctacaccgaggtctatccggataagacagaagacgaagcaggaatgcaacggttcttcaagcagttctccttccccggtggcattgggagccacgcaactcccgaaactcccggtagtctccacgagggaggagaactcggctactccatctctcatggctttggcgtcgtctttgatcatccaaagctcattgccttgaccatagtgggcgacggtgaggctgaaaccggtcccttggccaccagctggcacagcaacaagttcttgaaccccgtcacggatggtgcagtgctcccagtcctgcatctcaacggatacaagatcaacaatccgaccgttctggcgcgcatcagccacgaggaactcgagatgctgctcaagggctacgggtggacccccaactttgtcgagggcagtgaccgcgacagcatgcaccaggccatggcggccaccttggagcactgtgtcttagagatccgtaaaatccagcagcaggcacgcgaatctgacaagcccttccgtccccggtggcccatgatcgtcctacgcagccccaagggatggtccgccccgcgtgaggtcgacggggagttactcgaggggtactggcgcgcgcatcagattcccatccctgatgtgcgaaataacctgtcccacctgaaggtgctggaaaattggatgcggtcatataagcctaacgaggtctttgacgagaacggcagattgatttccgagctcagggaattggccccaatcggcaattctcgtatgagcgccaacccggttgccaacggcggtctcctccgtcgtccgctcgatctacccaatttcagggactacgcgctcactgatattgagcccggtgtcagcatccgtcccagcatgatcaatatgtcccgctatctgcgagacgtggtggccaaaaatatgaccacgttccgcgtctttgggcccgacgaaacccagtcgaacaagctcggcgagatctacgaggctgggaagaaagtctggctggcggattacttcaaggaggatgaggatggtggcaacctagccatgcagggccgcgtgatggagatcctcagcgaacatacttgtgagggctggctggaaggctatattctgtccggtcgccacggcatgctcaatagctacgaaccattcatccatatcatcgactcgatggtcaaccaacactgcaaatggattgaaaaatgcctcgaggtcgaatggcgcgccaaggttgcgtccctcaacatcctcctgactgctaccgtgtggcgccaggaccacaatggtttcacacaccaggaccctggcttcctggacgtagtcgccaacaagagccctgaagtggtgcgaatctacctgcccccagatggcaacaccttgctgtcaaccatggaccactgttttcaaagcgtcaactacgtcaacgtcatcgtggccgacaagcaagagcacgtgcaatttctcaacatggaggaggcgattgaacactgcaccaagggactgggtatctggaactgggctagcaatgatcagggccatgagcccgacgtcgtgatggccgcatgcggcgatgtgcccacgcacgaagcgctggccgcaacggcactactgcgggaacatctgccccagctcaaggtgcgcttcgtcaacgtcgtcgacctcttccggctcatctcgcgcaagaaccacccgcacggcatgtccgaccgccaatggaaggccatcttcaccaccgataagcctgtcatctttaacttccactcctacccctggctcatccaccgtctcacctacaaccggccaggccagcacaacttgcacgtccggggctaccgggagaagggcaacatcgacacgcccttcgagctcgccgtgcgcaaccagacggaccgattcagcttggccatggacgccatcgatcgttgcacgtcgttgggcaatactgcttcgggggttcgtgagaaactgatcaaccagcagctggcggccaagaacaaggcgtatgacgatggcatagacccagattacattcgcagttggacatgggattatccaaggaagaagtaa

SEQ ID NO: 130 - DNA, 2439 bp, Neosartorya fischeri NRRL 181
atgacgtcaaaaggtgaaatcgagagcctctccgcgtatggagtcgctcggtccaccatccaggggaccccgttgagccaggacgagctccgcaagatggatgcttatttccgtgcgagcatgtatctttgtctcggcatgctttatctgcgcgacaatcctcttctaaaagagcctctcaaggtggaacacctcaaggctcgattactgggccactggggttccgacgctggtcaatccttcacatggatccacatgaaccgcttgatcaagaaatatgacttggatgtattgttcatctccggccccggacatggtgctcctggcatcctctcgcagtcatacctcgagggtgtatacaccgaggtctatccggagaagacgcaggatgaaaagggcttgcagcgattcttcaagcagttctccttccccggcggaatcggtagccatgcaactccagagacccccggaagtattcacgaaggaggcgagctgggatactcaatctcccatgccttcggaaccgtctttgatcacccgaatctcatcacgttgaccatggtgggtgatggcgaggccgagactggccctctggccaccagttggcacagcaacaagttcctcaacccgatcaccgacggcgcagttcttccggtgctccatctcaacggttacaagatcaacaaccccactatcctggcccgcattagtcacgaggagttggaaatgctcctcaagggatacggatggaccccgtactttgtcgaaggaagcgaccgtgagagcatgcaccaggccatggcggccaccctcgagcattgcgtgttggagatcaagaaaatccaaaaacaagcacgcgagtccaacaaggcctttcgccctctctggcctatgatcgtccttcggtcgcccaagggatggtcggcgcccagagaaattgacggcaaatacctcgagggcttttggcgtgcccaccagatccctatcaccgatgtgcagagcaagccggagcacttgaaggtgttggaaaactggatgaaggcgtacaaaccagaggaggtcttcgacaagaacggtacactgatccccgaattgaaggagttggctccgacaggcacctcacgcatgagcgccaatcccgtcggcaacggtggtctcctgcgacgaccgatggatctgcctgatttccgcgactacgccctgaccgatatcgagccaggcgtcaccatccgtcccagcatgtccaatatgtcgaagtatctgcgtgacgtggtggcccggaacatgaccaccttccgagtctttggacccgatgagaccgagtccaacaagctcgccgagatctacaaggcgggtaagaaggtgtggatggccgaatacttcaaagaagatgaggacggcggcaacctggacatgcagggccgtgtgatggagattctcagcgagcacacctgcgaaggatggctagagggctacatcttgtctggtcgacatgggatgctcaacagttacgagcccttcattcatgtgatcgactcgatggtcaaccaacattgcaagtggattgaaaagtgtctcgctgttgaatggcgtgccaaggtttcctcactcaacattctcctgaccgcgaccgtgtggcgtcaggatcacaatggattcacgcaccaggaccccggattcctcgatgtagtcgctaacaagagccccgaggttgtgaggatctacctccctcccgacggtaacaccctcctgtcgaccatgaaccactgcttccgcagcgtcaactatgtcaatgtcatcgtggccgacaagcaggagcacgtgcagttcctcaacatggaggaggcgattgaacactgtaccaagggagtcggcatctgggactgggctagcaacgatcagggctgtgagcccgatgtggtcatggcgtcttgcggcgatgtcgctacgcacgaagcgctggccgcgacggctctgctgcgcgagcacctaccccagctcaaggtccgttttgtcaacgttgtggacctgttccgtctcatctccgacatcaatcatccgcacggtatgccggaccgccaatggggggccatcttcaccactgacaaacccatcatcttcaactttcactcgtacccctggctcatccaccgtctcacctacaagcggccgggtcagcacaacctccacgtgcggggctacaaggaaaagggcaacatcgatacgccatttgagctggctgtacggaatcagaccgaccggtacagcttagcgatcgacgccatcgaccgtatcccgtcccttggcaataccgcctcgggagtgcgggagcgtctgatcaatctccagctggccgcgaagaacaaggcgtttgacgacggcatcgacccggattatattcgcaactggacctgggattacccgcggaagaaatgttga

SEQ ID NO: 131 - DNA, 2433 bp, Aspergillus oryzae RIB40
atggcgcccagcagcgaatctgatgacaatatcagcgcctatggagctactcgctccaccatcaaggggcagcccctggatgcagatgaggtccgcaaaatggacgcatacttccgagcaagtatgtatctatgcttgggtatgctctatatgcgagacaatgtcctgcttaaagagcccctaaaggtcgaacacctcaaagctcgcctactcggccactggggttcggatgccggtcagtcctttacctggcttcatatgaaccgtcttatcaaaaagtatgatttggatgtcctcttcgtttccggtcctggtcatggcgccccggctgttctctcgcagtcatatctagagggcgtctactccgaagtgtatccggacaagtccgaagatgagaagggcttgcagaggttctttaagcaattctcatttccaggaggcattggttcgcatgcgaccccggagacgccgggatctattcacgagggtggtgaattgggatattcgatttctcatgcatttggaagtgtctttgaccatcccaaccttattacattgacgatggtcggggatggagagtcggaaaccggaccacttgcgactagttggcatagcactaaattcctcaacccttgtaccgacggagccgttctccctgtcctccacctgaatggatacaagatcaataacccgaccgtccttgctcgcatcagccacgaagagctgaaagcgttgttcgttggttatgggtggacgccatatttcgtggaaggcaatgatcgagaaagcatgcatcaagcgatggcagctacattggaacactgtattgtggagatcaaaaagattcaaaagcaggcaagggagtcaaacaaaccattccgaccccgctggcccatgatcgttcttcggagtcctaaaggttggtctgctccaagagagattgacggaaagctgctcgagggcttttggcgttctcatcagatcccgatcactgatgtcctgacgaaccctgcccatctgaagctacttgagacgtggatgaagagttacaagccggaggagctcttcgacaaaaatggcaagctcgttgaagagttaaaagcgctcgcgccctcaggcaattctcgtatgagtgccaaccccgtcggcaatggcggtattcttcgcaggcctctccagctgccggacttccgggactatgctctcaaggatattgaccccggcgtctctgtacgcgggagcatgacaaatatgtcgaagttcttgagggatgtggtcaaagaaaacatgaccaccttccgtgtatttggtccggacgaaacagagtcaaacaagcttgcagagatctacaaagccggcaagaaggtttggctgggtgactacttcgaagaggataaagatggaggaaacctagcctttgaaggtcgggtaatggagatgcttagtgaacatacctgcgaaggctggctggaaggctacgtgctttccggtcgccatggtatactaaacagctacgagcctttcatccacgtcatcgattcgatggttaatcagcactgcaagtggattgaaaagtgcttagaagtggaatggcgtgcaaaggttgcctctctcaatattcttctgaccgcgaccgtctggagacaagaccacaatggcttcacccatcaggatcctggtttcttggatgttgttgcaaacaagagcccggaggtggttcgaatctatctgccacctgacgggaacacgctcctctcagtcatggaccactgtttccgtagcgtcaactacgtcaacgtggtcgttgctgacaagcaagaacacatccaatttctcagtatggatgaagccattgaacattgcaccaaaggtctcggaatatgggactgggctagtaatgatcaaggtcaagagcccgatgttgtgatggctgcatgtggtgatgtgcccacccacgaggctctcgccgcaacggcgttgttaaacgaacatcttccccaactcaaggtcagatttgtcaacgtcgtcgacttattccgactcatcaacgagaaagaccatccacatggcatgcccgaccgacaatggaaggctgtgtttaccgacgataagccgatcatcttcaacttccattcgtacccttggcttatccaccgtctgacctacaagcgccccggacaacataacttgcatgtgagggggtacagagaaaaggggaatatcgatactccgttcgagctagccgttaggaatcaaaccgaccgatacagtcttgctatcgatgccatcgaccgtgtaggatctctcggcaacacggcgtcccatgtccgagaaaagttgatcaatcagcaactagccgctaagcaagaggcatatgacaatggtttagatgcggaatatatccgaaactggaaataccctaagaaggcatga

SEQ ID NO: 132 - DNA, 2448 bp, Aspergillus niger CBS 513.88
atgccatcggattcgaatgatcagagcatctccgcttatggagctgctcgctccacggtcaagggccagaaccttgacccggaggaagtccggaaaatggacgcctactttcgcgccagcatgtacctatgcttaggcatgctctacctgcgcgaaaatgtgcttctgaaacagccattgaaggtggagcatctcaaagcacgcctactcggccactggggctcagacgcaggacaatccttcacctggattcacatgaaccggctgatcaagaagtatgatctggacgttctcttcatctcaggcccgggtcacggtgcccctggcattctttcacagtcctacctggagggtgtatactccgaagtctacccggacaagtcggaggacgagcgaggaatgcaaaggttcttcaagcagttttctttccccggcggtatcggcagccacgctaccccagaaacccccggtagtcttcacgagggcggggagctgggttattccatctcgcacgcctttggcaccgtcttcgatcatcccaatctgattacccttaccatggtgggcgatggtgaggccgagactgggccactagctaccagctggcacagcaccaagtaccttaatccctgcaccgacggtgccgttctgcccgtgctccatctcaacggctacaagatcaacaatccgacactcctcgcacgcatctcccatgatgagctttctgctctcatgaagggttacggctggaccccctactttgtagagggcagtgaccgcgaaaccatgcatcaagccatggcagccacgctcgagcactgtgttcttgaaatcaggaaattccagaagaaagcccgcgagtcgaaggagcccttccgcccacactggcccatgatcatactgcgcagcccaaagggttggtccgccccgcgtgaagtcgatggcaaactccttgagggcttttggcgtgcccaccaaatccctatcaccgacgtcctcaccaatccttcacatcttcaacttcttgaatcgtggatgaagagctataagcccgaggagctcttcactcacgacggccgtttgatctccgaactcaaagccctcgctccaactggcaattcccgtatgagtgccaatccggtgggcaatggtgggctgctacggcgaccgctggacctacccgacttccgcaagtacgcactcacatccatcgatccgggagccaccatccgcggcagcatggtcaacatgtcacactacctccgtgatgtggtcgccttcaatcagaccaacttccgtgtattcgggccggacgaaactgaatccaacaagctctccgagatctacaaagccggcaagaaagtctggctggccgaatacttccctgaagataacaacggtggaaacctttccatggccggtcgagtgatggagatgcttagtgaacacacatgtgaaggctggctagagggctacgtcctctcaggccgccatgggctccttaatagctacgagcccttcatccacatcatcgactctatggtgaaccagcactgcaagtggatcgagaaatgcctcgaagtcgaatggcgcgccaaagtggcatctttgaacatcctcctcaccgcgaccgtctggcgccaagaccacaacggattcactcaccaagacccaggcttcctcgatgtcgtggctaacaagtctcccgaagtcgtgcgcatctacctcccgcccgacggaaactctctcctctccgtaatggaccactgcttccgcagcgccaactacgttaacgtcattgtcgccgataaacaagaccacatccaattcatggacatggacgcagcaattgcccactgcaccaagggcgtcgggatctgggactgggccagtaacgaccagggcgcggaaccagacgttgtcatggccgcatgcggcgacgttccaacccacgaggcactagccgccacagcgctcctacgcgaacaccttccccagctgaaagtgcgcttcgtcaacgtggtcgatcttttcaaactcatgtccaagatccatcacccgcatggaatgtccgatcgggaatggaaggctatcttcacggctgataggccgattgtcttcaatttccactcgtacccgtggcttattcaccggttgacgtataagagacccggacaggagaatatccatgtgagggggtacaaggagaaggggaacatcgatacgccattcgagctggcggtgaggaatcagacggatcggtatagtttggccgttgatgcgattgatcatgcccgcggactgggcaatacggcgtccggagtgagagagaagttcctgaatatgcagttattggccaagcagaaggcatacgatgacggcattgatccggactatattcggaactggacctggcagtatccgcggaagaagggggagggcgtctga

SEQ ID NO: 133 - DNA, 2457 bp, Aspergillus terreus NIH2624
atgccatcaaccgtcggtaagagtaatgacccaacgatcgtcgcctatggcccggcgcgctcgacaatcaagggccagcccctggaggccgaagagcttcggaagaccgatgcgtacttccgagccagcatgtacctctgcttgggtatgctctacctgcgggataacgtcctcctgaaggaacctcttcggaccgaccatctcaaggctcgacttctgggacactggggatccgacgctggtcagtcattcacctggattcacatgaaccgcctcatcaagaagtacaatctggatgtgctcttcgtttccggtcccggtcacggcgccccgggtgtcctttcgcagtcctatcttgagggcgtatactcggaggtctaccccgacaagtcggaggacgccaagggaatgcagaagttcttcaagcagttctctttccccggcggcatcggcagccatgccacccccgaaactccaggtagtatccacgagggtggtgaactgggctactcgatctcgcatgctttcggcaccgtcttcgaccaccccaacctcatcaccttgaccatggtgggcgacggtgaatctgagaccggccccctggccaccagctggcacagcaccaagttcctgaacccctgcgtggacggtgccgtcctgcctgtcctccacctcaacggatacaagattaacaaccctaccgtccttgcgcgtatcagccatgaggaactcgaatccctgttccacggctacggatggaccccgtacttcgtcgaaggcagcgacagggaaagcatgcaccaggccatggcggcgacgctcgagcactgcgtcaacgagatcaggaagttccagaagcaggcccgcgagtccaacaagcccttccgtcctcactggccgatgatcgtcctgcgaacccccaagggatggtccgccccccgcgacgtcgacggcaagctcctcgagggcttctggcggtcccaccaaatccctattcccgatgtctggtcgaaccccaaacaccttcaggtgctcgagtcgtggatgcggagctacaagccggaggagctcttcgataaggacggaaagctgatcccggagttgaaggagcttccaccgactggcaaccgacgcatcagtgccaaccccgttgccaacggtgggatcctgcgcaagcccctcgatatgcctgacttccgggattatgctctcaaggaaatcgaacccggcgtgtcgatccgtggtagcatggtgaacatgtccaagtggctgcgcgacgttattgccaacaaccagaagtccttccggctgttcggccccgatgagaccgagtccaacaagctgagcgagatctacaaggccggaaagaaggtgtggatgggcgagtattttgaggaagatcaagatggcggcaacctggcccccgaaggccgcgtgatggaaatgctcagcgaacacacgtgcgagggctggctggaaggctacgttctttccggacgccatgggctcctcaacagctacgaacccttcatccatatcatcgactccatggtcaaccaacactgcaaatggatcgaaaagtgtctcgaggtcgagtggcgcgtcaaggtggcctcgctgaacatcctcctcacggcgacggtgtggcgtcaggaccacaacggcttcacccaccaggaccctggattcctggatgttgtgtcgaataagagccccgaggtggtgcgaatctacctcccgcctgatggaaactgtctcctgtccgtaatggatcactgcctgcgtagcgtcaactacgtcaacgtggtggtcgccgacaagcaggaccacatccagtacctcagcatggaggaggccatcgaacactgctccaagggtgtcggtatctgggactgggcgagcaacgaccaaggcgtggagcccgacgtggtcatggcgtcctgcggtgacgtgcctacccatgaggccctggcggcgacggcgctcctgcgcgagaacatcccggatctcaaagtgcggttcgtcaacgtcgtcgacctgttcgtgttgatttccaagatcaaccatccccacggcatgacggatcgccactggaaggccgtcttcacggacgataagcccatcgtcttcaacttccactcgtacccgtggctcatccaccgtctgacgtacaagcggccgggccagcacaacctgcacgtgcgaggatacaacgaaaagggaaatatcgatacgcccttcgaactggctattaggaacaagacggaccggtatagtctcgctatcgacgccatcgatcgcgtcccgtcactccataacaaggcggctgccgttcgggagaagttcatcaatgaacagcttgcggcgagggggtgggcgtatgatcatggcattgatccggaccatatccgcaactggacctgggcctatcccagaaagaagaagaacgttgattag

SEQ ID NO: 134 - DNA, 2433 bp, Penicillium chrysogenum Wisconsin 54-1255
atggcatcaaaggtaggtgaaaagagcatctctgcctatggagaggctcgttcgacagtggaagggaagcctctcgacgccgagacaatccgtaagatgaatgcctggtttcgtgccagcatgtacctatgtttgggtatgctttatctccgggacaacccactcctcaaagagcctcttaagctagagcatctcaaagctcgactcttgggtcattggggctccgacgccgggcaatctttcacctggatgcacatgaaccgtctcatcaagaagtacaacctcgatgttcttttcgtttcaggccccggtcacggcgccccaggaatcatctcacaatcttaccttgagggtgtctactcggaagtctacccagataaaggcgaggatacggagggcatgacgaagttcttcaaacaattctcttttcctggtgggattggaagccacgcgacgcccgagacacctggcagcatccacgagggaggtgagctgggatattcactgtcacatgcctttggcacggtctttgacaaccccaatctcattactttgaccatggttggggacggcgaatccgagaccggcccacttgcaaccagctggcacagcacgaagttcctgaacccgatcaatgatggagcagtcctgcctgttctccatctcaacggatacaagatcaacaaccccacggtacttgcacggatcagccacgacgaacttacctctttgctcgttggctatggatggaaaccatactttgtggagggaagtgacttggacagcatgcatcaagccatggctattacgctcgagcaatgtgtcacggagatcaaggagcaccagaagaaagctcgagagacaaagaccccgttccgacctcgctggccaatgatcgttctgcgcacacccaagggatggtcggctccacgggaggttgatggccatcttctcgagggattttggcgcgcgcatcaaattcctatcactgatgtccgcaccaaccccgctcatcttaaggtgttggagacatggatgagggcctacaaaccagaagagctcttcgacgagaatggtacattgattcaggaactaaaggaactcgcgcccacgggcaactcgaggataagtgccaaccctgttggcaatggaggcctcctgcgccggccgctccatattcccgatttcagagagtacgggttcaaggatattgatgctggactgacaatcaagggaggcatggccaacatggcgaaattccttcgtgatgtagtcgctcagaacatgaacaacttccgactctttggccccgatgagactgaatctaacaagctttccgaggtgtacaaagcaggcaagaaagtctggatgggggattactttgaagaagataaagatggaggaaatttgtctcccgatggccgcgtgatggagatcctcagtgaacatacttgtgaagggtggctggaaggctacattctttctgggcggcacgggctgctcaacagctatgagcctttcatccacgtcattgattccatggtcaaccagcattgcaagtggatcgagaagtgccttgaagtagagtggagagcccgggtctcgtctcttaatattttgatcaccgccacggtttggagacaagaccacaatggcttcacccaccaggaccccggattcctcgatgtggtggctaacaagagccccgaggtggttcgcatctatctcccgcccgatggcaacactctcctctccgtgatggaccactgtctccgcagtgtcaactacgtgaatgtgatcgtcgccgataaacaagagcacatccagttcctggacatggatgcagccgtcgcgcactgcaccaagggtctcggaatctgggactgggcgagtaacgaccaaggcgcagagccggatatcgtgatggcatcatgcggtgatgtttcaacccacgaagctttagccgcgaccgcactactacgtgaatatctcccacagctcaaagtccgttttgttaatgtggtggatctgttccgactgatttccgccattcaccatcctcacggtatgtccgataagagatggaagtccattttcaccgtcgacaagcccatcatattcaacttccactcctacccctggctcattcaccgactcacgtacaagcgacctggtcaacataacctgcacgtgagagggtacaaagagaagggcaacattgacacgccgtttgaactggctatgcgcaatgataccgatcgatacagtctcgctatggctgccattgatttgattcagactcttgggaactcggcagctggtgtgagagagaagctgtacaacgagcagcttgcggccaaatcggaggctttcgataatggggtcgatcccgaacatattcgcaactggaaatggcctttcccgaaagagtag

SEQ ID NO: 135 - DNA, 2454 bp, Penicillium marneffei ATCC 18224
atggcgccaggcgcaatcgatgtcaacatacaaagcatctccgcttatggacctgctcggtcgaccgtcaaggttgacaagccactcagctcagatgaggtccacaagataaacgaatatttcaaggccagcctgtacctctgtctcggtatgctttacctgcgcgacaaccctctgcttaaagagcctctcaagaaagagcatatcaagaaccgtgtgctcggtcactggggttcagatgctggccaatcttttacatggattcacatgaaccgcctcatcaagaagtacagcctggattcattgttcatttctggtcccggacacggtgctcctggtatcttgtctcagtcgtatctcgagggtgtctatagtgaagtgtacccagacaagaccgaggatgaggacggcatgcgccgcttcttcaagtcattttcgttccctggtggcattggcagtcacgccactcctgaaaccccgggcagtatccatgaaggtggagaactgggatactcgatttcgcatgcctttggagctgtttacgaccacccagatctcatcgctttgacaatggtcggtgacggagaggccgagactggaccactcgctaccagttggcatagcacaaaattcctcaacccgattactgatggtgcagtccttccagtcttacatctaaatggttacaagatcaacaatcccactctcctcgctcgtatcagccatgaggagctcgaagcattgtttatcggttacggctgggcaccatatttcgtggagggaagcgaccttcaaagtatgcaccagagcatggccgcaacacttgagcactgtgttttggatatcaaggagattcagaagaaagctcgagaatcgaagaaagcattccgaccacgctggcccatgatcgtgctacgcacccctaaaggatggactgcacctagagaagttgatggaaagagactcgaaggtttctggcgatcacaccaagttccaatgccagatgtacttactaacccggatcacctgaagttgcttgaatcatggatgaagagttatggccctgacgaactctttgcaaacaaaggcaagcttattcctgaacttaaagctcttgcaccgacaggaaattcccgtatgagcgccaacccagttggaaacggcggtcttcttcgcaaaccattagatctgcccgatttccgcacctatggtgtccagaaaatcgaacctggagtttcactcattggaaacatgaccaacctggcaaaattcctgcgagatgttattgccaaaaacaagaccaatttccgtctttttggcccagatgaaactgagtccaacaaactaggtgaggtctacaaagctggcaagaaggtatggctcggcgcatactttgacgaagatcaagacggaggcaacttggccatggaaggtcgggtcatggaaatgctcagtgaacacaccatcgagggttggttggaaggttatattctgtccggacgacatggcctgctcaacagctacgagccttttattcacatcattgactccatggtcaaccaacattgcaaatggctcgaaaagtgcttggaagtcgaatggcgtgcgaaagtggcttcgctgaacatcttgctcacagcaaccgtctggcgtcaagatcacaatggtttcacgcatcaggaccctggattcttggacgttgttgccaacaagagcccggaagttgttcgcatctacctacctcccgatggaaattcgctcctatctgtggccgaccactgtctccgcagcgtcaactacgtcaacgtcatcgtcgccgataagcaagaacaccttcagttcctctctatggaggaagctatcgaacattgtaccaagggtgtaggtatctgggactgggctagcaacgaccaaggcgaagaaccagacgtcgtcatggcttccgccggtgatgtagcaacacacgaagccctcgccgcgactgcattgcttcgccaatacctccccggcgtcaaggtccgattcgtcaacgtcgtcgatctcttccgcctaatccccgaaactcaacatccccatggcatgtctgacctgcaatggaaggcgctcttcacagaagacaaacccatcatctttaatttccactcataccccttcctcgtccaccgtctcacctaccgacgacccggacaaaagaatcttcacgtccgcggttatcgcgaaaagggaaacatcgatacgccttttgagcttgctgtgagaaacgaaacggatagattcagcctcgccattgccgctatcgataatatcccacggttgcacaacacggcttctgccatccgcgagaagtttgtgaattctcagattgctgccaggaatacggcgtttggggatggtgttgattctgaggagattcggacctggaaatggccttttccaaagaaagaattaatttag

SEQ ID NO: 136 - DNA, 2448 bp, Talaromyces stipitatus ATCC 10500
atggcgcccagcgcagtcgaggtcgacatacaggccatttccgcgtatggacctgctcgctccaccgtcaaggtcgaccaccccctcgatgcagaggaagttcgcaagatggaagaatacttcaaggccagtctctacctctgtctaggtatgctttatctacgcgacaacccgcttctcaaagagcctctcaagaaagagcatatcaagaagcgcgtgttgggtcattgggggtcagatgcaggccaggccttcacatggattcacatgaaccgtctgatcaagaaatacgacctggatgcattgttcatttctggtcctggacacggcgctcctggtatcttgtctcaggcgtatcttgagggcgtgtatagcgaggtgtatccagacaagactgaggacgaggatggcatgcgccgcttcttcaagtcattctcgttccctggtggcattggcagtcacgctactcccgaaactcctggcagtatccacgagggtggagagctgggatactcggtttcgcacgcctttggaacggtatacgaccacccaaatctcatctccttgacaatggtcggtgacggagaagccgaaaccggaccactcgccaccagctggcacagcacaaaattcctcaatcccattaccgacggtgcggtcctcccagtcctgcatctgaacggctacaaaatcaacaaccccactctcctcgctcgtatcagccatgaggaacttgaagcattgttcattggctacggctggaaaccctatttcgtcgagggtagtgacaccaagagcatgcaccagtctatggccgcaacgcttgagcactgtgtcttggagatcaaggagatccagaagaaagctcgagaatccaagaaggcattccgcccccgctggcccatgattgtgcttcgtactcccaaaggatggactgcgcctcgagacgtcgatggaaagagactggaaggtttctggcgatcccaccaagtccctatcccggacgtcctcaccaaccccgatcacttgaagctgcttgaagcatggatgcgcagctacggccccgagaagctgtttgctgacaatggcaagctcattccggaactcagagagctcgcaccgacaggcaattcccgtatcagcgccaaccctgttggaaacggtggtcttcttcgcaaaccactagacctgccggacttccggaaatacggcgccgagaaggtcgaacctggaatttcaatcgttggaaacatcactggcctggcaaagttcttacgagatgtcatcgccaagaacacaacaaacttccgtctcttcggtccagatgagactgaatctaacaaactcgccgaagtctacaaggcaggcaagaaagtctggctcggcgcatactttgacgaagatcaagacggaggtaacctcgccactgaaggtcgggttatggaaatgctcagtgaacacaccatcgaaggctggcttgaaggctatgttctttcaggacgtcatggcttgcttaacagctacgaaccctttattcacattattgactccatggtcaaccagcactgcaagtggctcgagaagtgtcttgaagtcgaatggcgtgccaaagtcgcttcgctaaatatcctacttacagccaccgtctggcgtcaagatcacaatggctttacgcatcaagaccctggattcttggatgttgttgccaacaagagcccagaagtcgtccgaatttacctaccacctgacggaaactcgctcctgtctgtagccgatcactgtcttcgcagcgtcaactacgtcaatgtcatcgtggccgacaaacaagaacatctccaattcctctccatggaagaagccatcgaacactgcactaaaggagcaggcatctgggactgggccagcaacgaccaaggcgaagagccagacgtcgtcatggcctctgccggtgacgtagcaacccacgaagcccttgccgcaactgctttgctccgcgaattcctcccagacgtcaaggtccgattcgtcaatgtcgttgacttattccgtctgatttctgaaactcagcacccacacggcatgtccgactcgcaatggaaagcactcttcacagaagacaagcccatcatcttcaatttccattcatatcctttcctcgtccatcgcttgacctaccgacggcctggccaacagaaccttcacgtccgcggctatcgcgagaaaggaaacatcgatactccctttgagcttgccgtgaggaacgaaacggatagatatagtctcgccattgctgctatcgaccacatccctcgcttgcacaataaggcttcttctgttcgtgaaaagtttgtgaacttgcagattgcggctaggaatacagcttttgaggatgggcttgattccgaggagattcggaattggaagtggcctttcccaaagaagatttga

SEQ ID NO: 137 - DNA, 2466 bp, Botryotinia fuckeliana B05.10
atggctccaccttctggcgaagtcaaagttgagagcatttctccatatggagttgctcgcaccaccatcgacgaaaaaccactttccgatgaagaagttaagaaattcgacgcttacttccgtgcttgtatgtatctgtgcctgggcatgctgtaccttcgagaaaatgctttactcaaggaaccactcaagaaagaacacctcaaagctcgacttttgggacactggggttccgatgctggccaagctttcacatatcttcatatgaaccgacttatcaagaagtatgacttgaatacattatttgtctctggtccaggccatggagctcctgctgtactctcaaacgcttatctggagggtacttactctgaagtctaccctgataaggcagaagatgaggagggtatgcgaaagttcttcaagcagttctctttccccggtggaattggtagtcatgctactccagaaacaccaggtagtattcatgagggaggagagcttggatactccatttcacatgccttcggtaccgtctttgataaccctgacttgatcaccttgactatggttggtgatggtgaggcagagactggtccattggccacagcatggcattcaaccaaatttctcaacccaattacagatggagctgttctaccagtcttgcaccttaatggttacaagatcaacaatcctacgattcttgcacgaattagtcataaggagttggaggctctattcgttggttatggatggacaccatactttgtcgaaggaagtgatctcgagagtatgcatcaagctatggcaggaaccctcgaacgttgtgtggtcgaaatccgcaagtaccaaaaggaagcacgtgaatctggcaaagcagtccgaccacgctggcccatgattgttcttcgcagtcctaaaggttggactggcccaagaaaggttgacgataagttacttgaaggcttttggcgtgcacatcaaatcccacttcccaatgttgcaagtaacccggaacacttgcaacttttggagtcttggatgcgcagttataaacccgaagagtttttcgataaagagggtaaattactttccgaattgaaggaattggctcctgttggcaatgctcgtatgagtgccaaccctgtcggtaatggtggtatccttagaagaccgcttgatatgcccgacttccgcaaatacgcattcgaaaatgtcgaagcaggcgtcagcaaacttcccagtatggccaacatggcaaagcttctacgtgatgtagttgccaacaatatgcataccttccgtctctttggacctgatgaaactgaatcgaataaacttggtgaggtttacaaggctggcaaaaaggtttggatgggcgaaaacttcgaagaagatgctgatggtggaaaccttgctactgaaggccgtgtcatggagatgcttagtgagcatactgttgagggttggctagagggatatattttgtctggtcgccatggtttactcaacagctacgaaccgttcattcatgttatcgactccatggtcaatcaacattgcaaatggattgagaagtgcaacgaagtcgaatggcgtgtaaagatgtcatctctcaatatcctcttgacggccactgtttggagacaggaccacaatggtttcacccatcaagatcccggattcctcgacgttgtcgccaacaagagccctgaagttgtacgaatttacctcccacctgatggaaattgtcttctctcctgtatggaccactgcctccgcagcaccaactacgtcaatgtcgtcgtcgccgacaaacaagaccatcttcaatacctcaacatggaagatgctctcactcattgcgagaagggtctcggaatatgggactgggcttctaatgaccaaggcttcgaacctgatgttgtcatggccacttgcggagatgtacccacccatgaatctctagctgctactgcacttcttcgagaactcattccagatttgaagatccgttttgttaatgtggtcgatcttttcaaattgatccatcatggtgatcatcctcacggtatcacggataaagaatgggtatcgattttcacagacaataagcccattatcttcaatttccattcctatccttggctcgttcacagacttacctacaagcgtcctggtcaaagcaatctccatgttcatggatacaacgaaaagggtaatattgatacgccattagaattggctattaggaataaaaccgatcgatatagtttggcgttgcatgcggtagacaggattgagagattgggaaacacaggatcgcatattagggaaaagcttctaaatatgcagattgaggctaggagagaggcgtttgagaatggaattgatccaattcatattcgggagtggaagtggccctttcagaacggtggtaaggatgagaagatgttgaagtaa

SEQ ID NO: 138 - DNA, 2499 bp, Sclerotinia sclerotiorum 1980 UF-70
atggctccagcttctggcgaggtcgaagtggagagcatttctgcgtatggagttgctcgcaccaccgtcgacgaaaagccgctttcagctgaggaagttaagaaatatgacgcttacttcagtgcttgtatgtatctatgcctcggcatgctttacctccgagagaatgccctactcaaagaaccgctcaagaaagaacatctgaaggctcgacttctaggacattggggctcagatgctggtcaagctttcacatatcttcatatgaatcgcctcatcaaaaagtacgacttgaatgcgttattcgtctctggtccaggtcatggggctcctgctgtactttcaaatgcgtatttggagggtacttactcagaagtttatcctgataaggcggaggatgaggaaggaatgcgaaaattctttaagcagttctcttttccgggtggaattggtagtcatgctactccagaaacaccgggtagtattcatgagggaggagagctgggatactccatctcacatgctttcggcactgtctttgataatcccaacttaatcacattgacgatggttggtgatggagaggcggaaacgggacctttggctacagcctggcattcaactaaattcctcaatccgattacagatggtgctgttttaccggttttgcatctcaacggttacaagatcaataatcctacgatccttgctcggatcagtcacaaggaactggaatctttattcatcggttatggatggaaaccatactttgtcgagggaagtgacctcgagagtatgcaccaagctatggcaggaactctggaacgctgtgtcgtcgagattcgtaaataccagaaggaagcacgtgaatctggtaaagcaattcgaccacgctggcccatgattgtccttcgtagtcctaaaggatggacaggtccaaggaaggttgatgacaagttacttgaaggtttttggcgtgcacatcaaatcccactgccaaatgttgcaagtaatccagaacacttgaaagttttggaggcttggatgcgcagctacaagcctgaagaggtttttgacaaggagggtaaactactgcctgagctaaaggaattggctcctgttggcaatgctcgtatgagtgccaaccctgttggtaatggtggaatcctcaggaaaccactcgacatgcccgatttccgcaaatatgcatttgagaatattgaagctggtgttagtcttcttcctagtatgtctaacatggccaagctcttacgcgatgtggttgccaaaaacatgcacactttccgattatttggacctgatgaaaccgagtcaaataaacttggcgaagtttacaaggctggtaaaaaggtttggatgggggagaatttcgaagaagatgctgatggtggtaatcttgctaccgaaggtcgtgtcatggaaatgcttagtgagcatactgttgagggttggttggagggatatattttatctggtcgtcatggtttactcaacagctatgaacctttcattcacgttattgattctatggttaatcaacattgtaaatggattgagaagtgtaatgaagtcgaatggcgagtaaagatggcatctcttaatattcttttgacagccactgtttggagacaggaccacaatggtttcacccatcaagatcctggattcctcgacgtcgtcgccaacaagagtcctgaagtcgtacgaatctacctcccacccgatggaaattgtcttctctcctgtatggatcattgtcttcgcagcacaaattacgtcaacgttatcgtcgctgataaacaagatcatctccaattcctaaatatggaagatgcactcactcattgtgaaaagggactgggaatctgggactgggcctctaacgaccaaggtttcgaaccagatgttatcatggctgcttgtggagacgtacccacgcacgagtctctagctgctacggctctccttcgagaactcattccagatctaaagatccgtttcgtaaacgtggtcgatctattcaaattaatccatcacggtgatcatccccacggtatcacagataaagattggatctccatcttcacatccaacaaacccatcatctttaatttccactcctacccatggctcgttcatcgactcacctacaaacgtcccggtcaagtcaacatccacgttcgcggatacaaggaaaagggtaatattgacacgcccttagagttggcaattaggaatcaaacggatcgatatagtttggcgatggatgctgtggatagggtggagagactgagtaataaaggagcgcatgttcgcgagaaattgctgaatatgcagattttggctaggagggatgcctttgagaatgggattgatccggtgcatattcgggagtggagatggccgtttcagaggggtgggaaggatgaggagatgttgaatatgttgagattgacttcttacaaagagaagggttga

SEQ ID NO: 139 - DNA, 2469 bp, Pyrenophora tritici-repentis Pt-1C-BFP
atggatgccatggcagcaaaagccccggcggacccagagaccgtttctgaggatgttgaacacctgagtctttctgcctatggtccagcaagggcgtcaatcaccgaacatccactcagcgatgatgaggtgcgaaagatgacagactacttccatgcgtcgctatacatgtgcctaggcatgatttacctccgtcggaatcctctattgcgcgaacctcttaccctagatcacatcaagcgacgactattgggacattggggctcagatgctggacagagctttacgtatattcacatgaaccgcctgatcaaaaagtatgatctcgacgccatcttcatctctggtcctggtcatggtgcgcctgcagtcctctccaacagctttttggagggcgtctactcagaggtgtatcctgaaaagagcgaggatgaagagggtatgaaacgcttcttcagatccttctcattccctggtggaattggatcccatgctacgcctgagacgcccggtagcttacacgagggtggtgaactcggttattccatctcccacgctttcggcgcagtattcgatcacccagatttgattgcactcacaatggttggcgacggcgaatcagagactggcccgctggctacaagctggcattccacaaagttcctcaatccgattactgacggtgctgttttacccattcttcacttgaacggctacaagatcaacaatccgactgttctcgctcgtgtaagccacaaggagctcgaagcactgttcattggatacggatggacgccctactttgttgaaggaagcgacattccctccatgcatcaagccatggctgccactatggagcgatgtgttaccaagatcagggagtaccagaaagaggcgcgggattcgggcaaagctttccggcctcgttggcctatgatcatcctccgtacacctaagggatggactggaccccgcaaggttgacggagatcatttcttggagggcttctggcgtgcacatcaggttcctctcaccaatgtcctcaaagacaagtcgcagctcaagctcctcgaggagtggatgcgtggatatgggcccgacaagcactttgacgagaacggcaagctcattcccgagcttcgagagttggcaccgaccggtaacaggaggatgagcgctaacccagttacaaacggtggcgcgatccgacgcaagctccatgttcctgacttccgtaattactctgtcgaggtcacgaagggaggtgttgcaaagatgggtagcatggcaaacttcgctgccttcctgcgtgatgtgatcagggacaacccgaaggatttccgcctctttggtcctgatgagactcagtccaacaagctagacaaggtctacgaagcgggaaagaaagtctggctggctgactactttgaagaagacaaggatggcggtaatctggttcacgatggacgtgtgatggaaatgctgtccgagcatacggtagagggatggctagaaggctacattctatctggacgacacggcttgctgaacagctacgagcctttcattcacatcatcgactccatggtcaaccagcactgcaagtggatcgaaaagtgtctcgaagtggagtggaggcagaagattgcttcgctcaacatcctactcacatcgaccgtatggcgtcaagaccacaacggtttcacccatcaggatcctggtttcctcgacgtcgtagccaacaagagccccgaggtcgtccgcatctaccttccacccgacgccaactgcctcctctcaaccatgaaccactgtctccgcagcgaaaactacgtcaatgtaatcgtagctgacaagcaagaacacctccagttcctcaccatggaacaggccattgcccactgcacaaaaggtgtcggcatttgggagtgggccagcaacgacagcggtgcagaaccagacatcgtcatggcatcttgtggtgacgtgtccacgcatgaatccctggctgccaccgcactcctccgcacacacctccccgacctaaagatccgcttcgtgaacgtagtcgacttgttcaagctcatcgacgatggccagcacccccacggcctcaaggcgcacgagtacaaggccatcttcacagacgacgtaccctgtatcttcaacttccattcgtacccctggttggttcaccgccttacctacggccgtaagggccagcagaacttgctcgtccgcggttacagggagaagggtaacatcgatacaccgcttgagctggctattcggaacggcactgatcgctttagtctggcgattgatgcgctggataagatcaggaatctgggcaataggggtgcggcgacgagggagaagctgctggatgagcagatcaaggcgaagaattatgcatatcatgagggtattgatccgtcatggacggaggagtgggtttggcctttctag

SEQ ID NO: 140 - DNA, 2466 bp, Phaeosphaeria nodorum SN15
atggacgcaatggccgcgaaagcgcctgtggacccggagaaggtagtcgaagacgtcgaacacctcagtctctctccattcggtcccgcaagagcctctatcaccgagcacccattgaccgacgatgaggtctcgaagatgaccgactacttccatgccagcatgtacatgtgcttgggcatgatttacttgcgaagaaatccgcttctacgtgacccgttgacgctggatcatgtcaagcgacgacttctgggtcattggggctccgactctggacagtctttcacatatatccacatgaatcgcttgatcaagaagtacgaccttgatgcgatctttatttcggggcctggacatggcgcacctgccgtcctgtcgaacagtttcttggaaggagtctactcagaagtctacccagataagagtgaagatgaaaatggtatgaggcgcttcttcaagtcgttctctttccccggtggaatcggatcgcacgcaacccctgagactcccggtagtcttcacgagggtggagagcttggttactcgatttctcatgctttcggcactgtcttcgatcatcccgatctgattgctctcacgatggttggagacggcgagtctgagacaggcccgttagccactagctggcattctaccaagttcctcaacccaattaccgatggcgctgttctaccagtgctccacttgaacggttacaagatcaacaaccctaccgtactctcgagaatcagccacaaggagctcgaagcactgttcattggttgcggatggactccttacttcgttgagggcagtgatctgccttcgatgcaccaagccatggctgcaacgatggagcgttgtgttacaaagattcgcgagtaccagaaggaggctcgtgattcaggcaaagcgttcaggcctcgttggcccatgattgtcctgcgcacaccaaagggctggaccggacctcgaaaggtcggagaccacttctcggagggcttctggcgagctcaccaagtgcctctcacaaacgtactcaaggacaagtccgagctcaagctcctcgaacagtggatgcgcagttacgaacccgagaagcactgggatgagaacggcaagctcaagcctgaacttcgagagctcgcgcccgagggcaatcgacgaatgtcggcgaacccagtcgccaacggtgggctcatccgaggcaagttacacatccctgacttccgcgaatatgccgtcgaggtcacaaagggaggcgtcgcgaagatgggaagcatggccaactttgctggcttcctgcgcgatgtgatccgagataacccaaagactttccgcgtcttcggccccgatgagactcaatcgaacaaactcgacacgatctatgaggctggcaagaaggtctggatgggtgaatacttcgaggaggacgaggatggtggcaacctggcatacgagggccgtgtcatggaaatgctctcggagcatactgttgagggatggctcgaaggctacattctgtccggtcgtcacggtctgctgaacagctacgagcccttcatccatatcatcgattccatggtcaaccaacattgcaagtggattgagaagtgcctcgaagtcgaatggagacagaagattgcttcgctcaacatccttctcacagccacagtctggcgacaggatcacaatggctttactcatcaagaccccggcttcttggatgtagtcgcgaacaagagccctgaagttgtacgcatctaccttccaccagacgccaactgcctgctttccacaatggaccactgcctccgcagctccaactacgtcaacgtcattgtcgccgacaaacaagagcacctccagttcctcaccatggagcaagcaatcgcccattgcacaaagggcgtcggagtctgggaatgggcctcaaacgacaaaggcgaagagcctgacgtcgtaatggccagctgtggcgacacttccacccacgaggcactcgcagccacagccctgctccgccaacacctccccgacctgaagatccgcttcgtcaatgtcgtcgatctcttcaagctcatcgactccagcgagcacccccacggcctcaaagcccacgagtggaaagccatcttcacctccgacaagccgtgcatctttaacttccactcctacccatggttgattcaccgcttgacatatggccgcaagggacagcagaacatgctggtgcgcggatacagagagaagggtaatatcgatacgccgctcgagctggcgattcgaaacggtacagacaggtacagccttgcgattgatgctattgatcacatcactacgttgggtaacaagggcggctctgcgagggaggcgctgcttaatgagcagatcaaggcgaagaattacgcgtaccatgaggggctggatcctaaggagacggaggactgggtgtggcctttctaa

SEQ ID NO: 141 - DNA, 2505 bp, Cryptococcus neoformans var. neoformans JEC21
atggctgaagaaacatcctccctcacctcttttggtcaggctcgctcgactgtcaaggaccagcccttgacagtggaggagctcaagaagatcgatgcctacatgcgggcctccctttacctctgtcttggtatgctctatctccgtcaaaatccacttctcaaggagcctctcaagaaggaacatctcaaggctcgtcttttgggtcactggggttccgacgctggtcagattttcacctacatccacatgaaccgtctcattaagaagtatgatttggatgctcttttcgtttctggtcctggtcacggtgcccccgctgtcctctctcagtcctatctcgaaggtgtctacactgaagtctaccctaacataaccgaagatgtcgaaggcatgcgacgcttcttcaagcaattctcattccccggcggggttggttctcacgctactcccgagactcctggatctcttcacgaaggtggtgaactcggttactccatttcccacgcctttggtacggtctttgacaatcccaacctcattactcttactatggtcggtgatggtgaaagtgagactggccctctggctgcttcttggcacagtactaagtttttgaatcctatcaccgatggcgctgttttgcctgtcttacatctcaacggttataagatcaacaaccccaccgtccttgctcgtatctcccacgaagagattgaagctctctttatcggctatggctggaagccctactttgtcgaaggctctgaccttacctctatgcaccaagctatggctgctactctcgaaaaggctgtccttgagatcaaggcctaccagaagcaagctcgagactctggcaaggctttccgtcctcgttggcctatgataattctccgatcccccaagggttggactgctcctcgaaacgtctctggccaccacctcgaaggctattggcgtgcccaccagatcccccttgccgacgttgcttccaattctgaacacctcaagctcctcgaggactggatgcgatcttacaagcccgaagagctcttcactgaggatggtaaacttatccctgagctcaaggctcttcctcctgcaggtcaagcccgtatgtctgccaatcctgtgtctaacggcggtttggtccgcaaggcattgaatcttcccgacttcaaggactacgccatcaaggacatcgctcctggtgtgactcttgcccccagcatgtcaaacatggcgctctttgttagggacgtgatcaagaagaaccagaccaacttccgtctattcggccctgatgagactgagtccaacaaactcgcagctgtgtatgaggcaggcaagaaggtttggatgggcgagtacttgcccgaggacactgatggtggtaacctcgctcacgcgggtcgggtgatggagatcttgtctgagcacacagttgaaggatggcttgagggttatgtcttatctggtcgacatggtcttctgaattcctacgagcccttcatccacatcatcgactctatggttaaccaacactgcaagtggatcgaaaagtgtctcgaagtcgaatggcgtgtcaaagtctcctcccttaacattcttcttaccgccacggtctggcgtcaggaccataacggttttactcaccaagaccccggtttcctcgacgtcgtcgccaataagtcccccgaggtcgtccgcatctatctccctcccgacggtaactgtcttctctctgtcatgaatcactgcttcgacagcaaaaactatgtcaacgttgtcgttgccgacaaacaggatcacttgcagtatctcgacatggaggctgctgttgcgcactgtaccaagggtcttggtatttgggaatgggcgtgtgtgggtgaccccaacgagaaccctgacctcgttatggcttgttgcggtgatgtccctactatggagtctcttgctgccactgctctcctgaaagagtacctcccagagctcaagattcgttttgttaacgtcgttgacctcttcaagcttatctctcacgtggaccatcctcacggtcttactgatcgtcagtgggtctcttacttcaccgaagacactccaatcatcttcaacttccactcttacccctggctcatccaccgactcacttataagcgccctggttctcagaacatccacgtccgaggttacaaggagaaaggtaacatcgacactcctctcgagctcgctattcgtaatgagaccgaccgatacagtctcgcgatggacgctattgatcgtctgccccacctcaaaaacaagggttctatggcgagggagaagctgtatgatgcccagattaaggcgagggactgggcctttgagcatggtattgacccggaggacgtcaggaagtggaagtggccttatggtcccaagactgagggtattgcgagcaagcttgggttcggaggagagaacaagcaacaggttgcatccgttggtactagcgaataa

SEQ ID NO: 142 - DNA, 2460 bp, Gibberella zeae PH-1
atgtcaccagaggtcaagtctatctcgccctttggcattgctcgttcaactgtccagggcgagcctctctccaaggaggagatccaacagtacaatgactttttcaaagccagttgttacctctccttgggtatgatctatctcaaagagaatcctcttcttagacaacccctcaaagccgagcatctcaagcttcgactacttggtcactttggctcagcccctggccagatcttcacatatatgcacttcaaccgtctgatcataaagcacgaccttcatgctctcttcatctctggtcctgggcatggtgctcctgctgtcctttcgcagtcttacctcgagggtgtctataccgaggtctaccccgacaagactctcgacgacgagggtatgcaaaagttcttcaagagtttctcattccctggaggaatcggctcgcacgccacccccgaaactcccggatccctccatgagggtggtgagctgggttattccatctcacacgctttcggtgccgtctttgataaccctgacctgattgctcttactatggttggtgatggtgaagccgaaactggccctcttgctactgcctggcacagcaacaagttcctcaacccaatcgttgatggcgccgtcctacctgttcttcacctcaatggttacaagatcaacaaccccactgttctcgctcgaatctctcatcgagaacttgagtgtctcttcatcggttacggctggcagccctattttgttgaaggtgatgacattgagtctatgcaccaggcaatggctgctacgcttgagcactgcgtggatgagattcgaaagatccaaaaggaggctcgtgactccggcgaggctgtgcgacctctgtggcctatgatcgttcttcgaagtcccaaggggtggactgctccccgcaaggttgacaacaactacctggagggttactggcgagctcaccaggtccctatcgcagaccccgccaccaaccctgcccatctcaaggttcttgaggactggatgcgaagctacgagcctgagcgccttttcgatgcgaatggcgcacccattgcatccctccgggctcttattcctcaaggtaaccgacgaatgagcgctaaccctgtcgccaatggtggtctgctcaggaagcccttgaagatgcccgacttcagggactatgccatcaaggtggagagccccggaaatgtcatgaatgctagcatgaccaacatggctgtattcctcagggatgtcatggccaccaaccaaaccaacttccgtctctttggtcccgatgagactgagtccaacaagcttggcggtgtctacgatgctggaaagaaggtctggatgggtgagtactttgaagaggatgacaatggtggcaacctcgccaaggctggacgtgttgtcgagatgctttctgagcacaactgtgagggctggcttgagggttacctcctgagtggtcgacatggactactcaacagctacgagcctttcatccatgtcattgactctatggtcaaccagcactgtaaatggatcgagaagtgtctcgaggttgagtggcgtgccaagattgcttctctcaacatcctgttgactgctgtcgtgtggcgccaggaccacaacggcttcacacaccaagatcccggtttccttgacgtcgtcgccaacaagagccccgaggttgtccgaatctatcttcctcctgatggcaactgtctgctttctgttatggaccactgtcttcgctccgtcaactatgtcaacgttgtcgtttcagataagcaggaacatctccagtacctgcctatggatgctgccattgagcactgcaccaagggcatcggtatctggccccagttctccactgatgctggacagaaccccgacctggtcatggcctcttgcggtgacatcagcactcacgagtctctggctgctattgatctcctacttgagcatttccccgacctcaagattcgctgcgtcaacgttgttgatctctttaagttgattcaccccagcgatcatccccacggccttacagactctgagtggaccagcctcttcactgatgacactcccgtcatcttcaacttccacagctacccatggatggtgcaccgcttgacatacaagcgccccggaagccgcaacctgcacgttcgtggttacaaggagaagggcaacatcgacacccctctcgagttggccatccgcaaccagactgatcgtttcagtcttgccatcgatgctatcgattggatgcctcagcttcgcaaccgtggcgcttcagctcgccaggctcttctgaactcccagatccaggctcgcaatgaggccttcgagacaggaatggaccctgccttcctcaagaactggacttggaagcgcaatggcctgtggaagaaggtcagcgaaggcctagcttcacgatag

SEQ ID NO: 143 - DNA, 2457 bp, Nectria haematococca mpVI 77-13-4
atggctgaggtcgaatccatccagccctttggcatcgcccgctctactgtcaagggcaccccgctctccgaggaggagatctcccagtacaatgacttcttcaaggccagttgctacctgtccctgggtatgatctacctgaaggagaaccctctcctgcgagaacccctcaagcctgagcacctcaagcttcgacttctcggtcactttggttctgctcctggccagatcttcacatggatgcacttcaaccgtcttatcaagaagtacgaccttgacagcatcttcatctctggccctggccacggtgcccccgctgtgctctctcagtcctatctcgagggcgtctacaccgaggtgtaccccgacaagaccctcgacactgagggtctccagaagttcttcaagagcttctccttccccggaggcattggctctcatgctacccccgaaaccccaggatccctccacgagggtggtgagctgggttactcagtctcccatgctttcggtgctgtctacgacaaccccgacctgattgctcttaccatggtcggtgatggtgaggctgagactggtccccttgccactgcctggcacagcaacaagttcctcaaccccattgtcgatggtgctgtcctccctgtcctccaccttaacggttacaagatcaacaaccctactgttcttgcccgtatttctcacaaggagcttgagaacctcttcctcggctacggctggcagccatactttgtcgagggtgacgatatcgagtctatgcaccaggccatgtccgctactctcgagcactgtgtcaatgagatcaagaagttccagaagcaggcccgtgacagcggcgaggccttccgccccatgtggcccatgatcgtcctccgaagccccaagggctggaccgccccccgcaaggttgacgacaactacctcgagggttactggcgtgctcaccaggtccccatcaccgaccccgccaccaaccctgcccacctcaagcttcttgaggactggatgcgaagctacgagcccgagcgtctctttgacgaggctggtgctcctattgctgctctccgcgctctcacccctgagggcaaccgacgaatgagcgccaaccccgttgctaacggtggtctcatcaagaagcccctgaagatgcccgacttccgggactatgccatcaaggttgacagccccggcaacgtcaacaacgccagcatgaccaacatggccgtgttcctcagggacgttatcgcccagaaccagaacaacttccgtctgtttggtcctgatgagactgagtccaacaagctcggtggcgtctacgctgctggcaagaaggtctggatgggtgagtactttgaggaggatgaaaacggcggcaacttggccaagtccggccgtgtcatggagatgctttctgagcacaactgtgagggttggctcgagggttacatcctgagtggtcgtcacggtctgctcaacagctacgagcctttcatccatgtcattgactccatggtcaaccagcactgcaagtggatcgagaagtgtctcgaggttgagtggcgcgccaaggtcgcttccctcaacattctcctgactgccgtcgtctggcgtcaggaccacaacggtttcactcaccaggatcctggcttcctcgatgttgttgccaacaagagccccgaggttgtccgtatctacctgcctcctgatggaaactgtctgctttccgtcatggaccactgcctgcgctccgtcaactatgtcaacgttgtcgtctctgataagcaggagcatctccagtatctgcccatggaccaggccatcgagcactgcaccaagggtattggcatctggcctcagttctctaccgatgccggccaggagcccgacctcgtcatggcttcttgcggtgatatcagcacacacgagtctctcgctgccatcgatctcttgctcgagcacttccctgagctcaagattcgatgcgtcaacgtcgtggatctgttcaagctgatccaccacaccgaccacccccacggtcttccggactctgagtggaccgcccttttcaccgatgacaagcccgtcatcttcaacttccacagctacccctggatggtgcaccgcctgacctacaagcgtcccggcagcctcaacctgcacgtccgcggttacaaggagaagggtaacatcgacacccctctcgagctggccatccgcaaccagaccgaccgcttcagcttggccatcgatgccatcgaccgcatgcctcagctgaagaaccgcggcgctgctgcccgccagaccctcctcaacgcccagatccaggcccgcaacgaggccttcgagacgggcatggacccccccttcctcaagaactggacttggaagcgcaacggtctgtggaagaagattggcgacggtctcgcctcacgatag

SEQ ID NO: 144 - DNA, 2463 bp, Metarhizium anisopliae
atggctgacgaacaatccatccgggcctttggcccagctcgttcaactatcaagggcaatccgctgagctcctccgatattgctctgtataacgactacttcaaggccagctgctacttgtctttgggtatgatttacctccgagataacccgctgcttcgcgagcctcttaacaaggcacacttgaagcagcgtcttcttggccactttggatctgctcccggtcagatcttcacctatatgcacttcaatcgtctaatcaaaaagtacgacctgaatgcctatttcgtatctggccctggccatggcgcgcctgctgtgctctcacagtcctacttggagggcgtctactcagaagtctacccggagaaatccttggatgctgcaggcctccagaagttcttcaagtacttttcattccctggtggcattggctctcacgccacccccgaaactcctggctccattcacgaaggtggtgaattgggttattccatttcccatgcgtttggctcagtttttgaccacccagacctgattgccttgaccatggttggcgacggtgaagccgagactggtcctctggcaacttcatggcactcgaccaagtttctaaatcccataacagatggagctgttttgccagtcttgcatcttaacgggtacaaaatcaacaatcccaccgtccttgcccgtatttcccacgacgagctcaagaatctgttcattggctacggctgggagcccttctttgttgagggcgacgaattggacagcatgcaccaggccatggcctcaactctcgaacactgcgtccgcctgatcaaagactaccagaaagaagcccgagagagcgggaaagctttccgtcccagatggccaatgattgtcttgcgaacgcccaagggatggaccgcgccccgaaaggtcgataacaactatcttggaggattctggcgagcgcaccaggtccccattaccgatgtcaacacaaactctgagcatctcaaggttctcgaaaattggatgcgtagctacgagccggacagactcttcgacaaggaaggtgcaccagtcgctgccttgcgagctctgtgccccgagggacatcgccgtatgagtgccaacttggtgactaatggaggtcttattaagaagcctctcaagatgcctgacttcagagattatgccatcaaggtcgatcaacccggcgccacaatgaacggtagcatgacaaatatggccggcttcctgagagacatcatggcactgaacatgcacaactttagactgtttggtccagacgaaacggaatcgaataagttggctcgagtttacgaggcgggtaagaaggtttggatgggtgattacttcgaggaagacgccaatggtggcaaccttgccatggctgggcgtgtcatggagatgctctccgaacatacttgcgaagggtggctcgaagggtatattttgagtggtcgccatggccttttgaacagctacgagccgtttattcatgtcattgactccatggtcaatcagcactgcaagtggattgaaaagtgtctggaggtggaatggcgagccaaggttgcttcgctcaatatccttctgaccgctcttgtttggagacaggatcacaatggcttcacccatcaggaccccggtttcctcgacgttgttgccaataaaagccccgaggttgttcgcatctacctgcctcctgatggcaactgtctcttgtctgtcatggatcactgcttccgatcgaataactatgtcaacgttattgttgccgacaagcaagatcacctgcaatacctagacatggagagtgccattcagcactgcactaaaggaattggcatctggacaaagtttagtactgactcaggttgtgagcccgatctgataatggcttcctgtggcgacattagcactcaagagtccattgccgctgtcgatctcctgctcaactacttccccgatctcaaaatccgcgtcgtcaactgtgtcgacttattcaagcttattcacccgactgatcacccgcatggtctcacagacaaagaatggatcagcatctttactgaaaacacccccatcatcttgaacttccacagctacccctggatggtgcaccgtctcacctacaagcgacccggcagcaagaatctgcacgtccgaggataccgtgagaaaggcaacatcgacacgccactagaattggctattcgcaatcagactgatcgtttcagcctcgctatcgatgctattgaccgtatgaagtttctgggtaaccgtggtgcttcggctcgacaagcactgctggaccagcggattgctgcccgtaacgaggcctttgagcagggtatggatccgccggcattgtcagagtggacatggcagcggaatggactttggcagaaagctgctgaaaaattgaccattcatacgaaataa

SEQ ID NO: 145 - DNA, 2484 bp, Neurospora crassa OR74A
atgagtgattcgaatgagctcgaggtcgagagcatcagccccttcggaccagctcgctcgacaatcaagggagaacccctgaccaaggaagagattgacaagttcaatgacttcttcaaagccagcttatacctcagcttgggcatgatctatcttcgcgacaacccgcttctcaaggagcctctcgacacaaagcatctcaaagcccgcctgctcggccacttcggctccgcacccggccaaatcttcacatggatgcatttcaaccgtttgatcaagaagtatgatctcgattccatcttcatatccggccccggccacggtgcccccgccgttctgtcgcaggcatacctggaaggtacatactccgaggtatatccagaaatatcggaggacgaggagggcatgcagaagtttttcaagcacttctccttccccggcggaatcggctcgcacgccacccctgaaacaccaggcagtatccacgagggtggtgagctaggttactccatctcccatgcttttggcgcagtcttcgaccaccccaatctgatcgccctgacaatggtgggtgatggcgaggccgagaccggtcccttggcgacttcatggcacagcacaaagttcctcaatcccattaccgacggtgccgtcctccccgtcttgcacctcaacggttacaagatcaacaatcctacgattctcgcccgtattagccacaaggagctagagaatctgtttcgcggctatggctacgaaccatactttgttgagggcgacgatgttgacaccatgcaccaggctatggccgcaacactggagcattgtgtcctggagattaggaagttccagcaaaaagcaagggagtctggcaaggccttcaggcctaggtggcccgtcatcatccttcgcagtcccaagggctggaccggtccccgcaagatcgacgacaagtttctcgaagggttttggcgtgcccatcaggtgcccatcacggatgtgcacgagaagcccgagcatctcaagatccttgagcagtggatgaagagctacgagccagatcgtatctttagagatggaaggatcagcgaagatctcaaggatctctgcccgactggaacacgccggatgagtgccaaccccgtcgcgaacggtggcatcattaggaagaccctgaggatgcccgacttccgcaattatgccctcaaggtcgacaagccggcgtcgattatggccgccagtatgaccaatatgtccatgttcctccgagatgtcattgccgggaaccctaccaccttccgactttttggtcccgacgagactgaatccaacaagctcgggaaggtttacgaagctggaaagaaggtctggctgggcgagtactttgaagaggataaggacggcggtaatctggcccccgagggtcgcgtgatggagatgctctcagaacacacatgtgagggttggctggaaggctacatcctcaccggtcgtcacggtctcctgaacagttacgagccgttcatccatgtcattgactctatggtcaatcagcactgcaaatggctcgaaaaatgcttggaagtggagtggcgccacaaggtcgcctctctcaacatcctcctcaccgccgtcgtctggcgtcaagatcacaacggctttacccatcaagaccccggctttctcgacgttgtggccaataagagccccgagatagtccgtatctacctcccgcccgacggtaactgcctcctctctgtcacggaccactgcctgcgctcatccaactacgtcaacgtcattgtggccgacaagcaagaacacctgcagtacctatccatggacgacgctaccattcactgtaccaagggcatcggcatctggccacaattcagcagcgaccgcggcgaagagccggatctggtcatggcctcgtgcggcgacatctccacgcacgagtccctggccgccattgatctgctcctccaacactttcctgagctcaaaatccgctgcgtcaactgcgtcgacctcttcaagctgatctcgcacgacgagcacccgcatggcctgacggacgccgagtggatttccttgttcaccgacaacaggcccatcatcttcaacttccactcctacccctggcttgtccaccgtctgacatacaagcgacctggttcgcacaacgtgcacgtgcgcggataccgcgagaagggtaacattgatactcccctggagctggccatacgtaacggcacagatcgattcagtctcgcaatggcggctatcgatcacatgacgggtattctgggcaatcgtggagcggcagccagggagcagctaaggaatgagcagctcaaagcaaaggcgatggcatttgaggtgggcatggatccgccgtttttgaagaattggacatggccgcataccgggttgtggagtaagggggaagcgagggtggccagtgagcagcatcttcactga

SEQ ID NO: 146 - DNA, 2517 bp, Podospora anserina DSM 980
atgggcgaacaacaaagaacaagctcagaacaaccaccaccaccgccacaacccaagtccatcagcccctatggccccgccaggtcaaccgtccagggcgctcccctcacaaaagaggaggttgagcaatgcaatgacttcttcaaggcgtcactgtacctttccctggggatgatctacctccgctccaacccgctcctcaccacccccctcgacaagtcacacttcaaggcccgcttgctgggccactttggctccgccccaggccagatcttcacctacatgcacttcaaccgtctcatcaagaagtacgaccttgacgcgatcttcatttccggcccaggccacggtgcgcctgctgttttgtcacaggcgtacctcgaggggacgtacagcgaggtttatcctgaatgttcagaagacgaggagggcctccgcaagttcttcaagcagttctcttttcccggcgggattggatcgcatgccacgccagagacaccgggtagtctgcacgagggtggtgaactggggtacagcatcagccatgcgttcggcgccgtgtttgacaaccctgatttgattgctgtgacgatggtgggggatggcgaggcggagaccgggccgttggcgacgagttggcactcgaccaagttcctcaacccgattaccgacggtgctgtgctgccgattctgcacctgaacgggtacaagatcaacaaccccaccattctcgctcggatcagccacgatgagctggagagcttgttcagggggtatggctaccagccttactttgtcgagggcgacgatgtggaaagcatgcaccaagccatggccgccacgctcgagcactgcgtgctcgagatcagaaagtttcagcaacaggcgaggacgacagggaaggcgttcaggccgatgtggccggtggtgattctgagaagtccaaagggttggactgggccgaggaagatcaatggcgggctggactaccttgagggatactggcgctcgcaccaggtccctttgacggatgtgcacaagaacccggagcagttcgccctgctggagagctggatgaggagctacgagcctgaacggctgtttatcgccaacgggggcaggatttcttcctcgcttcgacaggcgctctgtcccactggcaacaggcgcatgtcggccaatccggtcgcgaacggggggatgcttcagaaaccgttgaggatgcctgattttagggattatgctttgggggtcgaccacccggccgagacgctttccgcctccatgtcgaacatggcgcggttcttgagggatatcatctcgctcaacccgaacaactttcggctctttggccctgacgagacggaatccaacaagctcggcaccgtctatgaagtggcccaaaaagtctggatgggggagtatttccccgaagacctcaacgggggcaatctcgcgacagaagggagggtgatggagatgttgtccgagcacacgtgtgagggttggctagagggttacctcttgtccgggagacacggcctgctgaattcctacgagccgttcatccacgtcattgacagcatggtcaaccagcactgcaaatggctcgagaagtcgctcgaagtgtcgtggagacaccccatcccgtccctcaacattctcctcaccgctgttgtctggcggcaggaccacaacgggttcacgcatcaggacccggggttcttggacgtggtggcgaacaagagcccggaggtggtgaggatttacttgccgcctgatgggaactgtttgctgtcggtgacggatcactgtctccggtcgaggaactacgttaatgttattgtagccgacaagcagccgcatctgcagtttttgtccatggctgatgcgattgttcattgcaccaaggggatcgggatctggcctggtttctcgtcctgcccggctggctcggcaccggatgtcgtcatggcttcctgcggcgacatctcgactcaggaatccctcgccgccatctcgctcctccttgaccatttccccgccctcaagatccgctgcgtcaacgtcgtcgacctcttcaaactgatcagccatgaggaacacccccacggtttgaccaacgccgagtacgaggcgattttcacgggggacaaaccggtggtgttcaactttcatagctatccttggttggtctaccggctgattcacggacggaagaatgcagggggggtggtggtgaggggttacaaggagaaggggaacatcgacacgccgttggagttggcgatcaggaatgggaccgataggttttctttggcgatggaggctattgatcggttgagcgaggctgggggggtgttggaggggaagggaggcgaggcgagggagttgttgaggaacgagcaggtgaggtgtcagatgagggcttttgaggagggggttgatcccgtggaggtgacggggtgggtgtggcctagcgagaggcgagggctctggagtgagcggaagcattga

SEQ ID NO: 147 - DNA, 2448 bp, Acidithiobacillus ferrooxidans ATCC 53993
atgacgacggaacacgatgcagcttgtgagggtgagagcatcagcgcctacgggaccgcccgagcgacggtcgaagatcaacctctgaacaccgatgatctgcgtaagatcgacgcctactggcgggccagtctttacctgtgtctcgggatgttatatctccgggataatccgctgctgcgggatccgctcaagccggagcacataaagccgcgcctgttaggtcactggggatcggacgcgggccagtgtttcacttatattcatttcaatcgcctgattaacaaatacgacctgaacgcgatctatatctccgggccggggcacggggcaccggccatactctctcaagcctaccttgagggaacgtactcggagacatatccggacaaaagtcaggatatcgcaggcatgcggcgatttttcaagcagttttccttccctgggggcatcggcagtcacgcgacaccggaaaccccgggcagcattcatgagggcggagaactcggctacagtgtttcgcacgcatttggaaccgtctacgacaaccccgacctgatcgccctggtcatggtgggcgacggggaggcggaaacgggtccccttgccacgagctggcacagcaataaattcctcaatccgattaccgatggcgcggtattgccggtgctccatctcaacggctataaaatcaacaaccccaccattctggcccgcatcacccatgaggaactggaggcattatttatcgggtatggttataccccttattttgtggaaggaagcgaccctgcgagcatgcaccaggcgatggctgccaccatggaacggtgcgtattgaaaatccgggaatttcaggacaaagcgcggcacaccggcacggccttccgtccgcgctggccgatgatcatcctccgctcccccaagggctggaccgcgccccgcaaggtggacggacactatctggagggcttctggcgggcacatcagatccccattccggacgtcgtttccaatccggcacatctgcaactgttggaatcctggatgcgcagctataggccggaggaactcttcgacgctcagggtcggctcatccccgagctgcacgaactggccccgaagggtaagcgccggatgagcgccaatcctgtggccaacggcggtctgctgcgccgccctctggatatgcccgactttcgcgtattttccatcgcggtgcaggatgcgggcggaacccgggcggacaatgtgcccaccctggggcactttctcagggagattacgcggcgaaacatgcagaacttccgcatcttcggtccggacgagacccaatccaataaacttgacgccatatatgatgtcacgcaaaaagtctggctgggggcgtattttcccgaagatgccgatggcggggcattggcgctgagcgggcgggtcatggaaatgctcagcgaacataccctggaaggatggctggaggggtatctgctcagcgggcggcacggcctcatcaacagctatgaggccttcattcacatcatcgattccatgttcaatcaacacgccaagtggctggaaaagtgcaacgaattaccctggcgcgccaaggtggcatcactcaacctgctgattacgggtctggtctggcgccaggaccacaacggcttcacccaccaggacccaggttttctggacgtcgtcgccaacaagagccccaatgtcgtgcgcatctatcttccacccgatgccaactgcctgctctcggtgacggatcattgcctgcgaagcgtgaattatatcaatgtgattgtcgcggataagcaaacgcatctgcagtatctggacatggacgctgccatggcgcactgcgcaaagggtgccggaatatgggaatgggccagtaacgacatgggagaagaacccgacgtggtcatggccagttgcggtgacgtacccaccatggaatctctggcggcgaccgccctcttacgccagcatctacccgatataaaaatacgctttgtgaatgtcgtcgatctcttcaaactggtgccccataccgaacacccccacggcatgacggaccgtgaattcgaggcactcttcacctcctcaaaaccggttattttcaattttcactcctatccctggctgatacaccggctcacctaccgccgccccgcccagcaccacattcatgtacggggctataaggaaaaggggaacatcgacacaccgctggaactcgccatccgcaaccagacggaccggttcagcctggctattgatgccattgaccggatcccccgtttttgcgacacgggttccggtgtgcgtgagatactgctcaacctgcaattcgcctgtaaaaatcatgcatacgagtacggcgtggacccgcaggaaatcaccgactggcaatggcctttccgggatactccctga

SEQ ID NO: 148 - DNA, 2463 bp, Acidiphilium cryptum JF-5
atgcgcttgaaaaatccgatgttgacggacggcgacatcgaggccatctcgccatacggtccggcgcgtgcgacaatccacggtacgccactgaacccggacgaactcgaaagacttgatgcctactgggatatcagtctctatctctgcctcggcatgctgtatctgcgggacaatccgctgttacggacaacgctccagcccgaacacgtgaaggcgcgactgctcggccattggggctcggacgccgggcagtgtttcacttacatccatttcaatcggctgatctgcaaatatgacctggacgcaatgtatatttcgggaccagggcacggagcgccggcggtgctgtcgcaagcctatctcgaaggaacctattcggagatttatcctgagatcagcgaagatctcgccggcctgaggcgtttcttcaaccagttttcgtttcccggtggaattggcagccacgcgacccccgagacacctggaagcattcatgaaggcggtgaactgggttacagcctatcgcacgcctttggcactgtgttcgacaatccggatctgatcacgctggtaatggtcggtgatggtgaagcggaaaccggccccctggcgacaagttggcacggcaacaagttcctcaacccgataacagacggagcggtactgccggtgctacatctcaatggatacaagatcaacaatccgacgatcctcgctcggatcagccacgaggaactggaggcgctatttgtcggctacggctacaccccctatttcgtcgagggtagcgatcgagccagcatgcatcaggcgatggcggcaacaatggagcattgtgtgcacgagattcgcgcggcgcagggcgaggcgcggcggactggcaaagcattccggccacggtggccggtcatcgtgctacgtagcccaaagggctggaccgggccgcggctagtggacaaccattacctcgaaggatcctggcgcgcccatcagatcccgatagccgatgtcccctgtaatccggaccatctgaagctcctggaagactggatgcgcagttatcgaccggaaatccacttcgacggggatggtcggatcattccagagttgagggcactggccccaaagggtttgcggcgaatgagcgccaatccagcagccaatggcgggaccattcggcgtccgctcaatctgcctgactttcgctcctttcaagttgatgttgatcatccaggagtgaggagagcaggcaacgtgccgacactcggtccgtttctgcgtgaaatcatccgtgaaaatcatgataattttcgcatatttggccccgacgagacgcagtcgaacaagcttgattcgatctatacggccggcaagaaatcttggcttggcgcccattttccagaagacgaggacggaggcaatcttgcagtggctgggcgggtcatggaaatgctcagcgagcacaccgtcgaaggttggcttgaaggctatctgctgagtgggcgccacggcctgatcaacagttacgaacccttcgtgcatgtgatcgactcgatgttcaaccagcatgccaaatggctcgagaaatgtaacgagctagcgtggcgagtgccgatatcatcgctcaacattctaatcacagcactggtgtggcggcaagatcataacgggtttacccatcaggatcctgggtttcttgatgtcgtggccaacaaaaatccagatgttgttcgcatctatctgccaccggatgcaaactgcctgttatctgtggctgatcactgtctgcgtagtcagaattatgtcaatgtcatcgtctccgacaagcagatacacctccagtatctcaacatggacgccgcaatcgcccattgcgccaagggtgcgggcatctgggattgggcaagcaacgaccacgggcaagagccagatgtcgtgatggcaagttgcggtgacgtgccgactgtggaggcactggcagcgaccgccctcctgcgtacacatctacctgacatcaaaatcaggtttgtaaattgcgtcgatttgttcagattggtcccgaactgggagcatccacacggtctgaccgacagtgaattcgaggagctgttcaccgcgacaaagccggtaatcttcaactttcattcttatccgtggctcatccaccggctgacttatcgccggcccgcccaacacaacatccacgtttgcggttacggtgaaaaaggcaacatcgatacacccctcgagctcgccatccgcaatcggactgaccgcttcagtctggcgatcgacgctatcagccggatcccacgcttccgtgactcctcctccgatgtacttgaggtcttgctggaacggcgacaagcctgtgttcagcacgctcacgaattcggaaccgatccaaaacacatctccgactggatttggccgaaagcagactccgaaggacgatcttaa

SEQ ID NO: 149 - DNA, 2364 bp, Thermotoga lettingae TMO
atggttgaaaaacttgttgatttctggaaagcctgctgctatatttcagccggaatgatctatctcaaagacaaccccctactgagaactcccttgaagtctgaacatataaaaaacagattgcttggccactggggtgcttcacccgccttgagtttcgtatatgttcatgctaacagagtgataaacaagtacaatctgaatgccatcttcattgctgggcccggccatggcgcgcctggtgtaatagcgcctgtatatcttgaagggacattgagtgaatactatccggaattcacacaagacgaagaagggatgaaaaaactcttcaagtatttttcttttccaggtggttttggcagccactgcacacctgagctacccggttcgatacaggaaggtggtgagcttggttattcactttctcatgcctatggtgcaattttcgacaatccaaaactcttagctgtaacggttattggagatggcgaagcagaaactggccctcttgcggcatcgtggcattccaataaatttctcaatccagcaagagatggtgcggttttaccagtactgtctttgaatggctataaaataaacaacccaacagtactcgctcgaatagaagaagccgaactactcaatttgttcaaaggctatggctatgatccaatcattgttgatggaacagatgattatgttgagtcgcaccaaaaaatggctgaagcgatggataagagtgttgaaagaataatcaatatctggtctgatgccaaggaaaaaattcaaaggccaattttacccatgataattttgagatctccaaaaggctggactgcccccaagatcgtcaaagaccattacatcgaaggatactggagatcacatcaggtaccactttctgatgtcaaagaaaacacagaaaacctcgtgattttgcaacaatggttgatgagctatgaacccaataaactattcgatcaatctggaaaattgagaaaagatttacttgaactcattccaccagataatctgaagatgagtaaaaatcccatctcaaacggtgggcttatcagaattccattgaaattgccccagttaaaagagttctccatcgatccgcagcaacagaaataccacgaaaacacccgcccgcttggagactatctcagaaagatcatagatcttaatccaaataatttcagagtttttggaccggatgaaacaaaatccaacagacttgatgcaatatttgctcatggcaaagcctggaatgcaagaatttttccagttgacagcgacgaaggctatctttcagcctttggaagggttatggaaattctctctgaacacacgatcgaaggttggcttgaaggctatttgctcacaggcaggcatggttttctaaatacttacgaaggttttgcacctattatttcttcgatggtcaatcaatttggaaagtggatcgatatatcttcggatatttcctggagaatgccggtttcttctttaaatctgctgctgacttctgtggtatggcggcaggatcacaacggtttcacgcatcaagacccgggttttataacctcaattgttgacaaatggccaaacgtagtcagagtttattttccaccagatgcaaatacacttctggcaacgacatggcactgtctgcagacaacaaacaggataaacatcatcgtggccgataaacaaaaacatccacaatatctgaatattgatgaagcaatcaaaaacgtgataaaaggaattggaatctggaattttgcatcaaatcatccacaagaagaaccagatgttgtcgtggcaagctgtggagatattccaacaaaggaagccatcgcggcagtgaagattgttaaagactttttcccggagctcagaataagatttgtaaacgtgataaatcttttcgctctaacaccgagcggtgagcatcctgatggattgactgatagagaatttgattcttatttcaccactgacaaacctgttatattcaacttccacggttacccatggctcatacacaggctcacatacagaaggaaaaatcacgacaatattcatgtgcgaggttatcgcgagaacagaaaatatggaatagattccaccgcactttcaccgttcttgaaaggaagaggtggtataaccacaccgatgcagctatcgattttgaatcaaactgacagattcagtatagcaatagacataatagacagggtagaacgcataagccaaaaagccggttatgcaagagatctgataagaaacgctcaaattgaggctcttcaatatgcttatgaacatggagtagataaaccagacctttgtgattaa

SEQ ID NO: 150 - DNA, 2379 bp, Dictyoglomus turgidum DSM 6724
atgctggaaaaattaaatgattattggaaagcttgttgttatttagctgcaggtatgatttatttatgggataatcctcttttgaaggagcctttaaaaccggaacatattaaggagagacttcttggacattggggagcaagtcctggactttcctttgtttatgtacatggaaatagggtgataaataaatatgatttaaattgtatatttatagcaggccccggacatggagcacctggagtaattgcaccagcctatttagaaggaacgataagtgaactctattctcaatttagtcaagatgaagagggaatgaaaaatctttttaaagccttctcttttccaggtggccttggtagccattgtactccagaacttccaggatctattcaggagggtggagagcttgggtatagtttatctcatgcctttggtgcagtatttgatcacaaagatcttattgccataaccgtagtaggcgatggggaagcagaaactggtcctcttgccacttcttggcattctaataagtttttaaaccctgtaagagatggggcggtacttcctgtgcttcttctcaatggctacaaaataaataatcctactcttctttcaaggatagagaatgatgaacttataaatctttttaaaggatatggatatgagccttatatagtagagggagaagaatcctttgaagttcacgaaaagatggcaaaagctatggattctgccgttgagaaaataattaatatatgggaagatgcaagatctaataataaaccttttagacctttatggcccatgattatattgaggactccaaagggatggaccgcaccaagaaaagtaggggatcactacattgagggttattggagagctcaccaagtacccttctctgatgccaaggaaaatcaaaaatctcttgaagttcttgaggcttggcttagaagttatgagcctcaaaaactctttacacctgaggggaaattgagagaggatttaagagaacttgctccaaagggcgaaaaaagaatgagcgctactcattatgctaatggaggatttttgaggaaagaattaaagcttcctgatttaaaaaattatgcagttaaagtagaaagccctattaatgatgaagcggaaaatactcgtcctcttggtatatttttgaaagagattattaggttaaatcctgataatttcagagtttttggacctgatgagaccaagtctaataggcttgatgcggtatttgaatatggaaaggcatggatggctaaaatattacccgaagatgaagatgaaggatttttatctccttttggaagaaccatggagatgctttcagaacatacccttgaaggttggcttgaaggctatcttcttacaggaagacatggatttttaaatacctatgaaggatttgctcctattatttcttccatggtaaaccaatttggaaagtggcttgacatatcttcagatattccatggagagctcccatatcttctttaaaccttcttcttacatcagtagtttggagacaggatcataacggttttactcatcaggatcctggatttattacctctattgtagacaaatggcctaatgtggtaagggtatacttcccacctgacgccaatacccttctttgtactgtctggcattgcttccaaaccacaaatagaataaatattattgttattgataaacaaaaacatcctcaatacttatctatagaggatgcctttaaacatgccatgaagggaataggaatttgggattttgcaagcaatcatcctgagcatgagcccgatgtggttatagcaagctgtggagacatacctacaaaagaagctatttatgcggtaaagatacttaaaaaattgttccctaatcttaagataagatttgtaaacgtactcaatttatttaccctaactcctaatacagaacatcccgatggactttccgatagggaatttgactcctactttacaaaggacaaaccagtaatatttaacttccatggatatccatggctaattcatagactaacttacagaagaaataaccataaaaatatccacgtaagagggtatagagaaaacagaaaaattggaatagatgcaggatatttagcccccttcttaaaaggaagaggaggaataaccactccacttcaacttgctattcttaaccagatagatagatttagtattgctatggatgtgatagaaagggtagaagcattgcaagacgaaggtggatactacaaagatcttttaaagaataaacagattgaagccttagaatatgcatataatcatggagttgataaagaatttgatgaaaaagatttataa

SEQ ID NO: 151 - DNA, 2382 bp, Nitrobacter hamburgensis X14
atgaagacaacggcagactcaaagacgcttagcccggaattgctgcacaacatggatgcctattggcgggcggccaactttctctcggtcgggcaaatttatctttacgacaatccgttgctgaagcggccgctgacgctcgcggatgtgaagcacatgttgttgggccactggggcacgacccccgggcagaatttcatctacgtccacctgaatcgcgtcatcaagaaatatgacctggacatgatttacgtctctggacctgggcacggcgggccggccgtggttggcaacacttacctcgagggcacttacagcgagatctatcccgacatcagccaggatgaggccgggcttcggaaactcttcactcagttttcgtttcccggaggcattcccagccacgcatcgccggagtgcccaggctcgatccacgagggcggcgaactgggttattcgctcagccactctttcggtgcggtgttcgacaatcccgatctcgttgtggcctgcgtcgtcggcgacggcgaagctgaaaccggaccgctggccacggcgtggcattccaacaagttcctcaacccggcgaccgacggcgcggtactgccgatcctgcatctcaacggctacaagatttccaacccgacgatcctcgcccgcatcacgcgcgaggaattggagcagttgcttcggggttatgggtgggcgccctactttgtcgagggccacgagcccgcgctgatgcacgaggccatggccgcaacgctcgatatggcagtggagcagatcaaacaaatccagcaggacgcccgcatccacggcaatgtcacgcgtccacgctggccgatgatcgtccttgattcacccaaaggttggaccgggcccaaggtcgttgatggcctgcaggttgaaggtactttccgtgcgcaccaggtgccgctttctgacccggccacccatcctgaacacctcaagctgctggaagactggctgaggagctatcggccggaggaactcttcaatgagcacggacacctaaagccggagctggctgaacttgcgcccaaggacgaacgacgcatgggtgcgaatcctcacgctaacggcggcattttgctccgcgacctgcggatgccgaatttccgcgactacgcagcggacgtgccctcgccgggagttcgcggcatcggcgacacccgggtgctcgggcctttcctgcgcgatgtgaccaagctgaacagcgaacaacggaatttccgggtctttggacctgacgagacgctctccaacggtctggaagcgctctttgaggtgaccaatcgccaatgggacgcgacgaccgcggcgaacgacgattttctcgcgcccaccgggcgcgtgatggaaatgctgagcgagcaccagtgtgagggttggctcgagggctacctgctcaccgggcggcacggactatttaattgctacgaagcgttcatccacatcgtcgattcaatgttcaaccagcatgccaagtggctggaggtcacgtcacacctgccgtggcgtcggaagatcgcctccttgaactacctgctggcctcacatgtctggcgacaggatcacaacggctacacacaccaggaccccggttttattggccacgtcatgaacaaaaaggccgagatcgtgcgggtttaccttccgcccgacgccaactgccttctgtcggtgacggaccactgcctgcgtagccgccattacgtcaacgtcgtgattgcaggcaaacacccggcaccccaatggttgaccatggacgccgccgccgcgcattgctcagaaggcatcggcatctggcaatgggctggcagtgaccaagactctgagccagacgttgtaatggcctgctgcggcgacgtgcctacgctggagacgctcgccgctgtctcgattctgcgccaacgtcttccggacttgaaaatccgggtggtcaacgtcgtcgatctcctgaagctacagccgaagaacgagcacccgcacggtttgagcgatacagatttcgattcactcttcaccaaggataaaccggtcatttttgcgttccatggttacccatggttggtccaccggctgacctaccgccgtaccaaccacgagaacttgcacgtccgcggctacaaagaggaaggcacgatcaccaccgccttcgacatgaccgtgcttaacgatctggatcgtttccatctggtgatcgatgtaatcgaccgcctaccgcagttgagtgccaagggggcttatctgaagcagcagcttcaggacaagctcaccgagcataagcactacatccgcaggtatggcgaagacatgccggaaatccgcaactggcggtggggtgcaaagacgtga

SEQ ID NO: 152 - DNA, 2370 bp, Blastopirellula marina DSM 3645
atgaacgctacgtcccttacgtcggagttgcttgacaaaatggacgcctattggcgggccgctaattatctgtccgttggtcagatctatcttttcgacaatccgttgctaaaacgtccattgcagctttcggatatcaagcccatgttgctcggccactggggaacgacgccgggacaaaactttatctacgtccatttgaatcggatcatcaagaaatatgatctcaacatgatttacgtctccggtcccggacacggcggaccggccgtcgtaggcaatacctatctcgaaggaacctacagcgaaatctaccccaacatcagtcaggatgaagagggactgcgaaagctgtttattcagttttcattccccggcgggattccgagtcatgcgtctccagaatgcccaggctcgatccatgaaggaggcgagcttggttattcacttagccattcgtttggcgccgtgtttgataatcctgatttgatcgtcgcctgcgttgtgggggatggcgaggccgaaaccggtccattggcgacagcctggcattctaacaagtttctcgatcccgctaccgacggcgccgtcctccccattttgcatcttaacggctacaagatcgcgaatccgacgattttagctcggattgagccggaagagctggataagttgctccacggctatggttggacgccgtactatgtcgagggggatgattcgcgacgaatgcatgaagtcatggcaattgcgctcgacgaagcggtcgagcaaataaaaacgattcagcaggacgccagagccaacggcaatttcactcgtccgcgctggcccatgatcgtcttccgttcacccaaaggctggacgggaccaaagatcgttggtggcctgcaaatcgaaggaacttttcgcgctcaccaggttcctctctctgatccgaaatctcatccagagcatctgcaactattggaggattggctgagaagttatcgaccggaagaattgtttgacgaccaagggcgtttgaaaccggagctcgccgaactcgcgccgcaaggcgagcggcgcatgggcgccaatcctcatgccaacggcggcaagttgttgcgcgatctgagactgcctgattttcgtgactatgcgtgcgacgttcccgagccgggagctcacggcatcggtgatacgcatgtcttgggccctttcttacgcgacgtgacgaagctcaaccagccgcagcggaatttccgggtctttggccccgatgaaacgctctccaacggcctggaggcgctcttccaggtaaccaagcggcaatgggaagcgcgaacggaggacaacgacgagtttctggcgcctcaaggtcgcgtgatggaaatgctcagcgagcatcaatgcgaaggctggttagaaggctatttgctcaccggacggcacggcgtatttaactgctacgaggcgttcatccacattgtcgattcgatgtttaatcaacacgccaaatggctgaaggtcaccgccggcctggcctggcggcataagattgcgtcgctcaactacttgctcgcgtcgcatgtctggcgacaagatcataacggtttcacgcatcaagatccgggctttctcgaccatgtcgtcaacaagaaagccgcaatcgtccgcgtctatcttccgcctgacgcgaattgcctgttgtcggtcatggatcattgtttgcgcagtcgacattacgtcaacgtcgtagtcgctggcaagcacccggcgccgcaatggctaacgatggatgcggctgtgaagcattgcaccgaggggatcggaatctggcagtgggccagtaacgatcaaaatgaaacgcccgatgtggtgatggcctgttgcggcgatgttcctacgctggaaactctggccgcggtatcgatcttgcaggagcatcttcctgatctcaaagtccgcgtcgtcaacgtcgtggatctgatgagactgcaaccccacagcgagcatccgcatggcttaagcgatgttgatttcgatgagctgttcaccaaagacaagccggtgatattcgcctttcacgcttacccgacgttgatccatcaactgacgtaccgtcgcacgaatcatgccaacattcatgtgcgcggctacaaggaagagggaacgattacgactccgttcgacatgactgtgttgaatgatctggaccgatatcatttagtcatggatgttattgatcgcgtgccgaaaactggcgaaaagggagtctatttgaaacagcagttggaagacaaactgatcgaacatcgacaatatatttgccgtcacggacaagacatgccggaaatccggaattggaaatggaacgctgcgaaataa

SEQ ID NO: 153 - DNA, 2394 bp, Marinomonas sp. MWYL1
gtgccaaaaactacgatgcaaaccgcagcactagcgccggatcaactgagcctaatagacagatactggcgagccagtaattacttgtcggttgggcaaatttaccttcacgataacccgctattgtcgcggcctttggtcttggctgatataaaacgtatcttgcttggtcactggggcacgacccccggacagaattttatctacgtacatttgaatcgcattattaaacaatacgatttaagcatgatttatatctctggccccggtcatggtggtcctgccgtggtgtcaaatacgtatttggaaggcagttacagcgagatttatcctgatataagtcaagacacagtcggcctacaaaagctgttcaaacagttttcttttcccggtggcattcccagccatgcgtcacccgaatgtcccggttccatccatgaaggtggagaattgggttattcattaagtcacgcctttggtgcggtatttgataatccagaattaatcgctgcctgtgtggtgggtgatggcgaagctgaaacagggcctttggcgaccgcttggcattctaataagtttctaaatccaattaccgatggcgtggttttgcccattttgcatttgaatggctacaagatcgcgaatcctacggttttggcgcgcatcagtcaccaagagctagagcagctatttcgtggttatggttggcatccaatttttgtcgaaggcagtgatcctgactatatgcataaagctatggcgacagcgctcgactttgcggtacgggaaatcaaggcgatcaaattgaacgcccaagaaaatagagtatttgaacgtccccgttggccgatgattattctaaaatctccaaaaggctggacgggccctaagatagtcgatggcgtgcagatcgaaggcacttttcatgctcatcaagtgccaatatctaatccagaatcgaaaccagaacacctgccattaatcgaagaatggttgcgcagttaccgccctcaagaattattcgatagcaacggccgcttgttaccagagctagtcgaactggcgccaaaaggcgagcgacgcatgggggcgaaccctcatgccaacggtggtttgctactgaaacccttacaaatgccagattttcgtgactacgcttgtacggtgccgaaacacggcgtgcgcggcgttggcgatacccatgtgctcgggccatttgtacgagatgtggttaagcttaaccaagagaactttcgagtatttggcccagatgaaaccatttctaatgggcttgaggcggtgttcgaaaccactaatcgacaatgggaagcgaccacaaaaattaatgacgaatacctagcgcccaatggtcgcgtgatggaaatgcttagcgaacaccagtgtcagggctggctagaaggctatttgctcacaggccgacacggcttatttaattgttacgaagcctttattcatatcgttgattccatgtttaaccagcacgcgaaatggctaaaagtcaccgctggtttgtcttggcggcctaagatcgcctcgttgaattatctattggcgtctcatgtttggcgtcaggatcacaatggctttactcaccaagatccgggttttattgatcatgtggtgaataaaaaagccgacatagtccgagtctatttgccaccagatgccaactgtttgctttcggtgatggatcattgtttgcgtagcaagcattacgtcaatgtggttgttgccggcaagcatccagcgccgcaatggttggatatggacgccgcagcgaaacattgtgcggcagggattggcatttggcagtgggcgagcaacgacacaggtttaaatcaacatgaccaaacggacgtggtgatggcgtgttgtggcgatgtgccaacgttggaaaccttagccgcggtgtctattttgcgcgagcatttacccaccttgaatattcgtgtggtgaacgtggtggatttaatgaaactgcagccgcaaaccgagcatccacatggtttgaatgatgccgagttcgactttttgtttaccgagaataagccagttatttttgcctttcatacctatccatcactgattcacaaattaacctatcgccgtaccaatcatcgcaatattcatgttcgcggttacaaagaagaaggcacgatcaccacagcatttgatatgacagtgcttaatgacatggatcgctttcacctcgtaatggatgtgattgatcgactaccacaaaccggcgtgaaaggcgtcgagttaaaacgcatgttgagcgaaaagctgatcgagcatcgccagtacatcaatgaatacggtgtcgatatgccggaaattcgcgattggaaatggagcaataaggatgaatga

SEQ ID NO: 154 - DNA, 2382 bp, Rhodopirellula baltica SH 1
atgattgaaacacttgagtcaacccaggtttctcacgagacattgcgaacgatcgacgcctactggcgtgcagcgaattacttgtcggtggggcagatctacctttccgacaatccgttgctcaaacgcccgcttcggattgaggacgtcaaaaagatgcttctgggtcactggggaacgacgccgggtcagaattttatctacgcccatttgaaccggacaatcaaacaaaatgatctcaacatgatctatgtctcgggtccgggacatggtgggcccgcggtcgtcgccaatacgtatttggaaggctcctacagcgagatctacccgcatatcagccaagatgaggcgggaatgagaaagctgttcgttcagttctcgttcccaggagggatccccagtcacgcgtcgccggagtgtcccggttcaattcacgaaggcggtgaacttggatattcgctgagtcattccttcggtgctgtattcgacaatcccgatttgatcgtagcttgcgtggtaggcgatggcgaagcggagacaggtccgctggcaacggcatggcactcgaacaagtttttgaatccagcgactgacggtgcagtgctaccgatcttgcatttaaacggattcaagatcgcgaaccctaccatcctcgctcgcatcaaccacgaggagctcgagcaactgatgcgaggttacgggtggacgcccatttttgtggagggcaaagatccaatgaaaatgcatgctgcgatggcggaagccttggacgtcgccatcggacaaatccgatcgatccaacagaatgctcgcgaaactggcgacacatctcgtcctcgctggcccatgatcgtgttgagatcgccgaagggatggacgggtcccaagtttgtcgatggtgtccgcaatgaagggacctttcattcgcatcaagtgcctttgtctgatccggccaaatgccccgagcatctgaaacaaatcgagcaatggctccgcagctatcgcccagaagaactgcttgacgaaaacggtcgacttcgccaggaaatcgcggatttggcacccacgggtgatcgtcgaatgggagcgaacccgcatgccaacggcggacgtttgttgcggcgactgaagatgcccgacttcagggactatgccgtcgaaattagccaacgcggttgccgaggaattggtgacacgcacgtcacgggcaaattcattcgcgacatcgttcgattgaacgaagagcacaaaaactttcgcatctttggccccgacgaaacgatctcgaatggcttggaagctgtattcgatgtcactcagcgtcaatggaacgccgcgatcgtcgaagatgatgaatcactcgcaccgaccggtcgtgtcctggaaatgttgagcgagcatcaatgcgaaggctggctggaaggttacctgctgacaggtcggcacgggcttttcaattgctacgaagcgtttgtgcacatcgtcgattcgatgttcaaccaacacgcaaagtggttgaaggtgacgtcggaattgccatggcgccacaagattgcgtcgctgaactatttgctcgcgtcgcacgtctggcgacaagatcacaacgggtttacccaccaagacccaggtttcctcgacgtggtcgtcaacaagaaggccgaaattgttcgcgtctacttaccaccggacgccaattgtctgctctcggttatggatcactgcttgcgaagccagcactatgtcaatgtcgttgtcgcgggcaaacacccatcgccgcagtggctgacaatgggcgaggcagccgaacactgcgccaaaggaattggaatttgggattgggcaggcaacgagtcctcgagtgaccctgatgtcgtgatggcttgttgtggtgacgtccccacattggaaacgttggctgcggtttccattttgcgtgagcatttgcccgatctaacaatccgggtcgtcaacgtggtcgacctgatgcgactgcaacccaaatcagaacacccacatggtctcagtgactcagactttgatgctctgttcaccaaaaacaaacatgtgatctttgcctttcacgcgtacccttggttggttcatcgactgacttatcgtcgtaccaaccacgccaacattcatgttcgcggttacaaggaagaaggcacgattacgacaccgtttgacatgaccgtgctaaatgacctcgaccgatttcatttagtaatggatgccattgatcgtttgcccgaaaccggcgggcgaggccaacgcctaaaagctttgatgcaagagaagttagtggagcatcggcgatacatcaatgagaacggacaagacatgcccgagattcgtgactgggaatggagcgccaggtcatga

SEQ ID NO: 155 - DNA, 2382 bp, Legionella drancourtii LLAP12
atgaaaacacttactcaagaaatgcttaataaaatagacaggtattggcgtgctgctaattatttatcagtggggcaaatttacttacgcgataatccgttgctcaaacgaccgttggttttttcagatattaaaccgaggctgttagggcattggggaacaactcctggccagaattttatctacacccacctaaaccacattatcaagaaatatgatttgaatatgatgtacatttctggtccggggcacggtggcccagcagtcgttgcgaatgcttatcttgagggaacttatagtgaggtataccctgaagttagtcaggatgaagacggtttgcgtaaattattttcccaattttcttttcctggtggaattccaagtcatgcatccccagagtgccctggttctattcatgaaggcggtgaattagggtactctttaagccatgcttttggcgcggtattcgataacccagatttaatcgttgcttgtgttattggggatggagaggcggagaccggtccacttgcaactgcatggcatgcaaataaatttttatgtccagtaaccgatggtgcagtattgcctattctccatttaaacggctataaaatagctaatcccacggttttagctcgcattacgaaagaggagctggggagcttgctttatggttatggttggacaccttattgggtagaaggcgatgagcctctgctgatgcatgagacgatggctgctgcgctacaaagcatcatcgagcagattaaactcattcagcacgatgcacgttcccaaaagaataaccaacgcccacattggcctatgattattttaaaaacgcctaagggatggactgctcctaaggtggttgatggaatacagattgaggggacgtttcgttctcatcaagtacccatttctgattgttctagcaatattgagcatctaaaaattttggagcattggcttcgaaattacaaacccgaaacattgttcgatgaacagggtcggttactcaatgatttaaaggatatggcacctgagaatgaaaagcgtatgagtgcgaatcctcatgctaatggcgggggattactacaagcacttaaattacctgatcccgataattactctattaagttattggtgcgtggtatgccgggccaaggagatacccgcgtattaggtccttatatacgagatgtaatccaattaaacgcaagtaactttcgtgtatttggaccagatgaaaccatttccaatggattagaagcggtatttgaagccacaaatcgtcaatgggatacgcaaattttgccctcggacagttttttatcttctcaaggaagggtctttgaggtactgagtgaacatcaatgtgaaggttggttagaaggatacttattgacgggacgtcatggtctttttaattgttatgaagcattcattcatatcattagttcgatgttcaatcagcatgctaaatggctcaaagtcacatcaaccattccctggcgtaaaaaaattgcttcgctaaattacctgctcacatctcatgtttggcgtcaagaccacaatggcttttcacaccaagaccctggatttatcgatcatgttgtaaacaagaaggcagaaataattcgtgtttatcttcctcctgatgcaaattgtttgttatccatcatgcatcattgcttacagagtcaacattatgtcaatgtggttattgccggcaaacatccagcaccgcaatggctttcaatcgaagaagcaaaacagcattgtgccaatggaatagggatttgggaatgggcgagtcatagtaaaggagaggttcctgatgtcattatggcttgtgcaggagatgtgcctactcttgaaaccttggcggcagtttctattttacgtgctcaattaccgcacataaacattcgcgttatcaacgttgttgatttaatgaaactgcaacctgattatgaacatccccatggattaagtgatgaggattttgacctcttgtttcttcctgataaacccgtgatttttgcataccatggatatccatggcttattcaccggttgacaagcagtcggtcaaatcatagaaatatgcatgttagaggatacagagaagaagggacaatcacgactccttttgatatgactgtattaaatgagctggatcgctttcacttagttcttgatgttcttaatcatttaccgcatttaggtagtaaagaacaaaaacttatcgagaatatcaacataaaattgttagaacatcaacactacattaggcagcatgggaacgatttacccgaaattagagattggaagtgggaatatcacacgcttgaagatgagagctatactatttga

SEQ ID NO: 156 - DNA, 2370 bp, Streptomyces sp. Mg1
atgagcactcagagccttcccaaggaactgctgcaccgtatggacgcctactggcgggcggccaactatgtgtcggtcggccagctctatctctacgacaacccgctgctgagacggccgctggagttggatgatgtgaagccgctggtggttgggcactggggaaccacaccgggtcagaacttcgtctacgtgcacttgaaccgggtcatcaagaagtacggcctggacatgttctacgtctccgggccgggccacggaggccctgccctggtgggcaacacctacctggagggcacgtacagcgagatctatccggatgtcacgcaggacgaggccggcctgcggaagctgttcacccagttctccttccccggcggcatctccagccacgtcgcgccgaccacgcccgggtcgatccacgagggcggggagctcgggtactcgctcagccacgcgttcggcgccgtgttcgacaaccccggtctgatcgtcgcctgtgtcgtgggcgacggagaggccgaaacgggtccgctggcgaccgcctggcagtccacgaggttcctcgacccggccggtgacggggccgtcctgccgatcctgcacctgaacggatacaagatcagcaacccgacggtactggcccgcatcggagacgatgagctggcgcagtatcttcgcggctgcggctgggagccccacttcgtgtcgggcgacgatcccgagacgatgcacgaactgatggccaccacgctggaccgggccatcgagggcatccggcagatccaggaggcctcccgggcaggcgccggagggaaacgtcctcgctggccgatgatcgtcctgcggtcacccaaaggctggacgggcccgaagagcgtcgacggccaccagatcgagggaaccttccgttcccaccaggttcccctgctggtcgacgccgcccaccccgaccacgtgggccagttggagagctggatgaggagctacaagcccgaggagctcttcgacgagagcggccgtctcctgcccgacctggccgaactggctcccgtgggggaccggcggatgagcgccaacccccacaccaacggcggtgtcctgctgcacggcctgcgcatgcccgacttccgtccgtacgccgtggacgttccggcgcccggggcggtcagcgcacaggacaccctggtcctgggcggattcctgcgcgatgtcatcgtctccaacgctgaacggcgcaacttccggatcttcggtccggacgagacgctctccaacttcctgggagcggtcttcgagacgaccaaccgccagtggaacgccggcacggtgcaggatgatgagttcctcgcgccgtcggggcgcgtcgtggactccatgctcagcgagcaccagtgcgagggctggctcgagggatacctattgaccggccgccacggtctgttcaactgctacgaggcgttcatccacatcatcgactcgatgttcaaccagcacgccaagtggctcaaggtcaccaagcagttgccctggcgccgcgacatcgcctcgctgaactacctcctcacctcgcatgtatggcagcaggaccacaacggattcacccaccaggaccccggtttcctcgaccacgtcgtgaacaagaaggccgacatcgtgcgggtctaccttccgccggacgccaactgccttctgtccgtcatggaccactgcctgcgcagccggcactacgtgaacgtcgtggtggcgagcaagcgcgcgatgccccagtggctcgccatggacgaagccgtcgtgcactgcaccgagggcatcggcatctggccctgggcgggcaacgacgaaggcgtagacccggacatcgtgctggcctgctgcggggacacccccacgctggaaattctggccgccgtatcgatcctgcgcgaacacctccccgaggtatcggtccgggtggtcaacgtggtcgacctgatgaggctggaatccgacaggaagcatccgcacgggctcagcgaccgggactacgacgcgctcttcacccgggacaagcacatcatcttcgccttccacggctacccctggctcatccaccgcctcacctacagccgcaccaaccgaaacctgcacgtccgcggctacaacgaggagggcaccatcaccacggccttcgacatgcgggtccagaaccacctggaccgcttccacctcgtccaggacgtcatcgaccgcctgccccagctcggttcccggggcgactacctgcgacagcagatgagcgaccggctcgtcgagcacacccgccacatcgccgtccacggcacggatctgccagaaatccgggactggacctggaacgggcctctgtga

SEQ ID NO: 157 - DNA, 2064 bp, Lactobacillus reuteri SD2112
atggcagtagattacgattccaagaagtatttggaaagtgttgatgcttactggcgtgcagctaactacctttcagttggtactttgttcttaatgggtgatccattattacgccaaccattaaaggctgaagacgttaagcctaagccaattggtcactggggtactattgttcctcaaaacttcatttacgcacacttaaaccgtgtaattaagaagtatgaccttgatatgttctacattgaaggttcaggtcacggtggtcaagttatggttaacaactcatacttggatggttcatacactgaaatttatcctgaatacacacaagacactaagggaatggctaagttattcaagcacttctcattcccaggcggtactgcatctcacgccgcacctgaaactccaggttcaatccacgaaggtggggaacttggttactcactttcacacggtgtaggtgctatcttagataaccctgatgttatcgccgctgttgaaattggtgatggtgaagctgaaactggtccattaatggcatcatggttctcagacaagttcatcaacccaatcaaggatggtgcggtattaccaatcatccaagttaacggattcaagatttctaaccctactattctttcacggatgagtgacgaagaacttactaagtactttgaaggtatgggctggaagccatacttcgtatcagcttacaaagaagctgaccgtgatggtgaattcgatggttacaagccacacatggaagttcacgaacaaatggctaagactatggataaggctgttgaagaaatcaaggctatccaaaagaacgctcgtgaaaacaacgatgattcattaccacaatggccattaatcatcttccgtgcacctaagggttggactggtcctactaaggatcttgatggtaacccaatcgaaaactcattccgtgctcaccaaattcctattccggtatcacaagatgacatggaacacaaggacatgcttattaactggatgaagtcatacaagccagaagaattgtttgacgaaaacggtcacccagttgctcttgttgaagagaacacaccagaaggtaaccgtcgtatggctatgaatcctatcactaatggtggtatcgatcctaagccacttgtattaccaaactaccgtgactttgctgttgacgttcaaactccaggttctgttgtaaagcaagatatgcttgaatggggtaagtacctcagcaagatggctgaattgaacccaactaacttccgtggatttggtcctgacgaatctaagtcaaaccgtctttacgcattccttgacaaccaaaagcgtcaatggatggaaggcattcacgaaccaaacgatgaaaacgttgctccacaaggtcggatgattgattctcaattatcagaacaccaagctgaaggattccttgaaggttacacattaactggtcgtcacggattcttcgcaacttatgaagcattcggtcgtgttgttgattcaatgcttactcaacacatgaagtggttacgtaaggctaaggatctttactggcgtcgtcaatacccagcattgaactttgttgatacttcaactgtattccaacaagatcacaacggttacactcaccaagatccaggtctattgactcacttatttgaaaaggaacgtccagaccttgttaaggaatacttacctgctgatactaactcacttatggctgtatcaaacaaggcattccgtaaccaagaatgtatcaacctctttgtaacttcaaaacacccacgtgcacaatggttctccattgatgaagctactgaattagttgacaatggtcttggctacatcaactgggcatctactgaccaaggtagcgaaccagatgttgtatttgcttcagctggtactgaacctactgaagaagctcttgcagctattgacattcttcatgacaacttccctgaattgaagattcgttacatcaacatcattgaaatcatgaagttaatgaagcaagacaagaacccagaaggtttgtctgacgca

SEQ ID NO: 158 - DNA, 2475 bp, Lactobacillus vaginalis ATCC 49540
atgatttacgtattgtttaacggcaagaacgtatctatttattcagaaggagtgtttattagaatggcagtagattacgattccaagaagtacttggaaagtgttgatgcttactggcgtgcagccaactacctttcagttggtacattattcttaatgggtgacccattattacgtcaaccattaaaggcagaagacgttaagcctaagccaattggtcactggggtactattgttcctcaaaacttcatttacgcacacttgaaccgtgtaattaagaagtacgaccttgacatgttctacatcgaaggttcaggtcacggtggccaagttatggttaacaactcatacttggatggttcatacactgaaatttatccagaatttactcaagacactaagggaatggctaagttatttaagcacttctcattcccaggcggtactgcatcacacgccgcacctgaaactccaggttcaatccacgaaggtggggaacttggttactcactttcacacggtgttggtgcaatcttagataacccagacgttatcgccgctgttgaaattggtgatggtgaagctgaaactggtccattgatggcatcatggttctcagacaagttcatcaacccaatcaaggatggtgcggtattaccaatcatccaagttaacggtttcaagatttctaacccaactatcctttcacggatgagtgacgaagaacttactaagtacttcgaaggtatgggctggaagccttacttcgtttcagcttacaaggaagctgatcgtgaaggtgaatttaacggttacaaggaccacatggaagttcacgaacaaatggctaagaccatggatactgttgttgaagaaatcaaggctatccaaaagaatgctcgtgaaaacaacgatgactcattaccacaatggccaatgattatcttccgtgctcctaagggttggactggtcctactaaggatctcgatggtaacccaatcgaaaactcattccgtgctcaccaaattcctattccggtatcacaagatgacatggaacacaaggacatgcttgttgactggatgaagtcatacaagccagaagaattgtttgacgaaaacggtcacccagttgctcttgttgaagagaacacaccagaaggtaaccgtcggatggctatgaaccctatcactaacggtggtatcgatcctaagccacttgtattgccaaactaccgggacttcgctgttgatgttcaaacaccaggttctgttgtaaagcaagacatgcttgaatggggtaagtacctcagcaagatggctgaattgaaccctaacactttccgtggattcggtcctgatgaatctaagtcaaaccgtctttacgcattccttgacaatgacaagcgtcaatggatggaaggtattcacgaaccaaacgatgaaaaccttgcacattcaggtcggatgattgattcacaactttctgaacaccaagctgaaggattccttgaaggttacaccttaactggtcgtcacggattcttcgcaacttacgaagcattcggtcgtgttgttgactcaatgcttactcaacacatgaagtggttacgtaaggctaaggatctctactggcgtcaccaatacccagcattgaactttgttgatacttcaactgtattccaacaagatcacaacggttacactcaccaagatccaggtctgttaactcacatgttcgaaaaggaacgtccagatcttgttaaggaatacttaccagcagatactaactctctgatggctgtttctaacaaagccttcaacgaccaagaatgcatcaacatcttcgtaacttccaagcacccacgtgcacaatggttctccattgacgaagctactgaattagttgataacggtcttggctacatcaactgggcatctactgaccaaggtagcgaaccagatgttgtctttgcatcagcaggtactgaaccaactgaagaagctcttgctgctattgacattcttcatgacaacttccctgaattgaagattcgttacatcaacatcattgaaatcatgaagttgatgaagcaagacaagaacccagaaggtttgtctgacgcagaattcaaccgttacttcactactgacaagccagttatctttgcatggcacggattccgtgacatgatccaagcattgttcttcgatcgtgcaaaccggaacgttcacattcactcatacgaagaaaatggtgacattaccactccattcgacatgcgtgtattgaacgaacttgaccgtttcaacttagctaaggatgctatccaaagtgttcctggttacgaacaaaagagtgctgcatttgttgccaagatggacaacatgattaacaagcacaaccactacatccgttcagaaggtaaggacttaccagaagttactaactggacttggaagggtcttaagtaa

SEQ ID NO: 159 - DNA, 2412 bp, Lactobacillus reuteri 100-23
atggcagtagattacgattccaagaaatacttggaaagtgttgatgcttactggcgtgcagctaactacctttcagttggtacattgtacttaatgggtgatccattacttcgccaaccattaaaggcagaagatgttaagcctaagccaattggtcactggggtactattgttcctcaaaacttcatttacgcacacttgaaccgtgtaattaagaagtatgaccttgatatgttctacatcgaaggttcaggtcacggtggccaagttatggttaacaactcatacttggatggttcatacactgaaatttatcctgaatatactcaagacactaagggaatggctaagttattcaagcacttctcattcccaggcggtactgcatcacacgctgcacctgaaacaccaggttcaatccacgaaggtggggaacttggttactcactttcacacggtgttggtgctatcttagataacccagaagttattgccgctgttgaaatcggtgatggtgaagctgaaactggtccattaatggcatcatggttctcagacaagttcatcaacccaatcaaggatggtgcggtattaccaatcatccaagttaacggattcaagatttctaaccctactatcctttcacggatgagcgacgaagaacttactaagtacttcgaaggtatgggttggaagccatactttgtttcagcttacaaagaagctgaccgtgatggtgaattcaagggttacaagcctcacatggaagttcacgaagaaatggctaagactttggacaaggttgttgaagaaatcaaggctattcaaaagaacgctcgtgaaaacaatgatgattcattaccacaatggccaatgattatcttccgtgcacctaagggttggactggtcctaagactgaccttgatggtaacccaattgaaaactcattccgtgcacaccaaattccagttccagtatcccaagatgacatggaacacaaggacatccttgttgactggttgaagtcatacaagccagaagaattattcgacgaagatggtcacccagttgctcttgttgaagagaacacaccagaaggtaaccgtcgtatggctatgaaccctatcactaatggtggtatcgatcctaagccacttgtattaccaaactaccgtgattttgctattgacgttcaaaatcctggttctgttgtaaagcaagacatgcttgaatggggtaagtacctcaacaagatggctgaattgaacccaactaacttccgtggatttggtcctgacgaatctaagtcaaaccgtctttacgcattccttgatggtcaaaagcgtcaatggatggaaagtgtccacgaaccaaacgacgaagatgtggctccacaaggtcgtatgatcgattcacaactttcagaacaccaagctgaaggattccttgaaggttacacattaactggtcgtcacggattcttcgcaacttacgaagcattcggtcgtgttgttgattcaatgcttactcaacacatgaagtggttacgtaaggctaaggatctttactggcgtcaccaatacccagcattgaactttgttgatacttcaactgtattccaacaagatcacaacggttacactcaccaagatccaggtctattgactcacttatttgaaaaggaacgtccagacctcgttaaggaatacttgccagcagatactaactcattaatggctgtatctaacaaggcattccgtaaccaagaatgcatcaacctctttgtaacttctaagcacccacgtgcacaatggttctctattgatgaagctactcaattggctgacaatggtcttggctacattgactgggcatctactgaccaaggtactgaaccagatgttgtatttgcatcttctggtactgaacctactgaagaagctcttgcagctattgacattcttcatgacaacttccctgaattgaagattcgttacatcaacatcatcgaaattatgcgtttgatgaacactgacaagaaccctgaaggtttaactgatgctgaattcaatagttacttcactactgacaagccagttatctttgcatggcacggattccgtgacatgatccaagcattgttcttcgatcgtgctaaccgtaacgttcacattcactcatacgaagaaaatggtgatatcaccactccattcgacatgcgtgtattaaacgaacttgaccggttccacttagctaaggacgctatccaaagtgttcctggttacgaacaaaagagtgctgcatttgttgccaagatggacaacatgatcaacaagcacaaccactacatccgttcagaaggtaaggacttaccagaagttactaactggacttggaagggtcttaagtaa

SEQ ID NO: 160 - DNA, 2400 bp, Lactobacillus coleohominis 101-4-CHN
atgacagtagattacgattccaagcaatacttggaaaatgttgatgcttactggcgtgctgctaactacctttcagttggtacactgttcttaatgcacaacccactgttacgtcgtgaattagaggctaaggatgttaagcctaagccaattggtcactggggtacgattgttcctcaaaacttcatttatgcacacttaaaccgtgttatcaagaagtacgacctggacatgttctacattgaaggttccggtcacggtggccaagttatggttaacaactcatacttggatggttcatacactgaaatttaccctgactacactcaagatgttaagggtatggctaagctgttcaagcacttctcattcccaggtggtactgcttcacacgctgcccctgaaactccaggttccatccacgaaggtggggaattaggttactcactttcacacggtgttggtgcaatcttagataacccagacgttatcgctgctgttgaaattggtgacggtgaagctgaaactggcccattggctgcttcatggttctcagacaagttcatcaacccaatcaaggatggtgcggtattaccaatccttcaaatcaacggtttcaagatttctaacccaaccattgtttctcggatgaccaacgaagaacttactaagtacttcgaagggatgggctggaagccatacttcgtatcagcttacactgatggcgaatttgatggtttgaagccacacatggaagtccacgaagaaatggctaaggttatggacaaggccattgaagaaatcaaggctatccaaaagaacgctcgtgaaaacaacgatgactcactgccacaatggccaatgatcatcttccgtgttcctaagggttggactggtcctaagaaggatcttgatggtaacccaatcgaaaactcattccgtgctcaccaaattcctattccggtatcacaagatgacatggaacacaaggacatgcttgttgactggatgaagtcctacaagcctgaagaattatttgatgaaaatggtcaccctgtagaagcagttacgatgactactcctgaaggtgacaagcggatggcaatgaacccaatcactaacggtggaattgatcctaagccattagttctcccagattaccgtgactttgccgttgacgttaagactccaggttctgttgtaaagcaagacatgattgaatggggtaagtacctgaacaaggttgctgaattgaaccctaacaacttccgtggatttggtcctgatgaatctaagtccaaccgtctttacgcaatccttgacgatcaaaagcgtcaatggatggaagatatccacgaaccaaacgatgaaaacatgaaccactcaggtcggatgatcgactcacaactttcagaacaccaagctgaaggatggcttgaaggttacactctgactggtcgtcatggtttcttcgcaacttacgaatcatttggtcgggttgttgactcaatgctgactcaacacatgaagtggttacggaaggctaaggaaatgtactggcgtcatgactacccagcactgaactttgttgacacttctactgtcttccaacaagaccacaacggttacactcaccaagatccaggtctgttaactcacatgtacgaaaaggaacgtcctgacttagttaaggaataccttcctgctgatactaacgaattgatggccatttctgatgttgcattccgcaaccgtgaatgcatcaacatcttcgtaacttccaagcacccacgtgcacaatggttctccattgatgaagctactgaaatcgctaagaacggtcttggctacgttgactgggcttctactgatcaagatgctgatcctgatgttgtctttgcttctgctggtactgaaccaactgaagaatcattggctgcaatcagcattcttcacgaaaacttcccagaattgaagattcgttacatcaacgttgttgacattatgaagttaatgccaatcgaaaagaaccctgaaggtttgactgatgaagaatttgatcgttacttcactactgatgctcctgtaatctttgcatggcacggtttcgaagacatgattcaatcactcttcttcccacgtcacaaccacaaccttcacgttcactgctaccgtgaaaatggtgacattacgacaccatttgacatgcgtgtcttgaacgaacttgatcgtttccatttagctaaggatgctatcctgaatgttaagggctacgaacaaaaggctgcttccttcgctcaaaagatggatgacatggttgcaaagcataaccaatacatccgtgacgaaggtaaggatcttccagaagttgaaaactgggtatggaagactttgaagtaa

SEQ ID NO: 161 - DNA, 2400 bp, Lactobacillus fermentum 28-3-CHN
atggcagtagattacaattccaaggaatacttggaaactgttgatgcttactggcgcgccgccaactaccttagtgttggtacgctgttcttgatgcacaacccactgttacgccaagaactcaaggcttctgacgttaagccgaagccaattggtcactgggggacgattgttccgcaaaacttcatttacgcccacttaaaccgggttatcaagaagtacgacctgaagatgttctacatcgaaggttctggtcacggtggccaagtgatggttaacaactcttacttggacggttcttacaccgaaatttacccagaaatcacccaagacgaagccgggatggctaagttgttcaagcacttctccttcccaggtggaactgcttctcacgccgcaccggaaacgccaggttcccttcacgaaggtggggaattaggttactccctttcccacggtgttggggcaatccttgacaacccagaccaaattgctgcggttgaaattggtgacggggaagccgaaactggcccattggctgcttcatggttctctgacaagttcatcaacccaatcactgacggtgcggttctgccaatccttcaaatcaacgggttcaagatctctaacccaactatcctttcccggatgtccgacgaagaactgactaagtacttcgaagggatgggctggaagccttacttcgtatctgcatacgcaggtggcgaatttgatggcctcaaggaacacatggaagttcacgaagaaatggctaaggtgatggatgccgctgttgaagacatcctggctatccaaaagcacgctcgtgaaaacaacgacgactccatgccacaatggccaatgatcgtcttccgtgtaccgaagggttggactggtccggttaaggacttgaacggcgacccgatcgaaaactccttccgtgcacaccaaattccgattccggttacccaagacgacatggaacacaaggacatgctcgttgactggatgaagtcttacaagccagaagaactgttcgacgaaaacggtgctccggttgaaaaggttgttgctaacattccagaaggcgaccgccggatggctgttaacccaatcactaacggtggggttaacccgaaggaactcgtgatgcctaactaccgtgacttcgccgttgacgtgaagaaccacggtactgaaatgcaccaagacatgctcgaatggggtaagtacatcgctaagatgatcgaacttaacccaaccactttccgtggcttcgggccggacgaatccaagtctaaccgcctttacgctgcccttgacggcgggaagcggacttggatggaagacatccacgaaccaaacgacgaaaatctgagccgcactggtcggatcatcgactcccaactttccgaacaccaagctgaaggatggctcgaaggttacaccctgactggtcgtcacgggttcttcgcaacttacgaatcattcggtcgtgttgttgactccatgctgactcaacacatgaagtggttacgtaaggccaaggaacaatactggcgtcacgactacccagcattgactttcgtggacacttccacggtcttccaacaagaccacaacggttacactcaccaagatccaggtctgttgacgcacctttacgaaaaggaacgtccagacatgatcaaggaatacctgccagccgacacgaactccctgctcgctgtctctgacgtggctttccgtgaccgtgaatgcatcaacgtgctggttacttccaagcacccacgtctccaatggttctccatcgatgaagcaactgaactcgttgctaacggcctcggctacatcgactgggcatccactgaccaaggcgcagaaccagatgttgtctttgcttccgctggtactgaaccaactgaagaagctctggccgctatcgacctgcttcacgacaacttcccagaactgaagatccgttacatcaacgtgatcaacatcatgaagttgatgacgattgctaagaacccagaaggccttagcgacgaagaattcgaccgttacttcactgctgacaagccagtgatctttgcatggcacggcttccgtgacatgatccaaagtctcttcttcccacgtcacaaccgcaaccttcacgtacactgctacgaagaaaatggtgacattaccaccccattcgacatgcgtgtcctgaacaaacttgaccggttccacttggccaaggacgctatcttgagcgtacctggttacgaacaaaaggccgttgccttcgcacaaaagatggacgacatggttgctcgtcacaaccacttcatccggactgaaggtaaggacttaccagaagttgaagcttggacttggaagggcctcaagtaa

SEQ ID NO: 162 - DNA, 2418 bp, Lactobacillus acidophilus ATCC 4796
gtgctcaaaggagaaaaaatgacagttaattacgattccaaagattacttaaagagcgttgacgcatattggcgtgcagctaattatttgtcagttggacaattatttttaatgaaaaatccgttgttaaagaaacctttaacagctgaagatgtaaaacctaagccaatcggtcactggggtactattgctccacaaaactttatttatgctcacttaaatcgtgcgcttaaaaaatatgacttggatatgttctatattgaaggttcaggtcacggtggccaagtgatggtttcaaattcatatcttgatggttcatatactgaacgttatccagaaattacccaagatgaaaagggtatggctaaattgtttaagcgctttagtttcccaggtggtgtagcttctcacgctgctcctgaaactccaggttctattcatgaaggtggggaattaggatacgcactttcacatggggtaggtgctattttagacaatccagatgtaattgctgccgttgaaattggtgatggtgaagcagaaactggtccacttgcagctagctggttcagtgacaagtttattaatccaattaaggatggtgcagttttaccaattcttcaaattaatggtttcaagatttctaacccaactatcgtttcaagaatgagcgatgaagaattaactgaatacttccgtggcatgggttgggatccgcactttgtttcagtatttaagggtggccgctttgacggtgaaaaggatccaatgcaagtccacgaagaaatggctaaaaccatggacgaagtaattgaagaaattaaggctattcaaaagcatgctcgtgaaaataatgatgctactttgccacattggccattgattatcttccaatgtccaaagggctggaccggtccaaagaaggatcttgacggcaatccaattgaaaactcatttagagcacaccaaattccaattcctgtctcacaatacgatatgaaacatgttgatatgttgactgattggcttgaaagttataagccaaacgaattattcaacgaagatggttcaccaaaggaaattgttactgaaaacactgctaagggtgatcaacgtatggcaatgaatccgatcactaatggtggtaaggatcctaaacgattgaacctaccagattatcgcaactttgcacttaagtttgacaagccaggttcagttgaagcacaagacatggttgaatgggctaaatatttaaacgaagttgctaaacttaacccaactactttccgtggctttggtcctgatgaatctaaatcaaaccgtttatttaaacttttagatgatcaaaagcgtcaatgggaacctgaagttcatgaaccaaatgatgaaaacttggcaccaagtggccgcgttatcgattcacaattatcagaacaccaagacgaaggcttccttgaaggctacgttttaactggtcgtcacggcttctttgcaacctacgaagcatttggtcgtgtagtagattcgatgcttactcaacatatgaagtggcttagaaaagctaaagaacaatattggcgtcatgattatccatcacttaactttgttgctacttcaacagtattccaacaagatcacaatggttacactcaccaagatccaggcattttaactcacttatatgaaaagaatcgtccagatttagttcatgaatacttgccatcagatactaatactttacttgctgtaggtaacaaggcatttactgatcgtgaatgtattaatgttttagtaacttcaaagcaacctcgtccacaatggttctcaattgaggaagcacaaaagttagttgataaaggtttaagttacattgattgggcttcaactgataaaggtgtaaaaccagatattgtctttgcttcaacagaaactgaaccaacaattgaaactttggcagcaattgatattttgcatgacaagttcccagatcttaagattcgctacattaacgtaattgatgtgatgaaattaatgtcaccaaaggacaataagaatggtatttctgatgaagaatttgatcgcttattcccaaaggacgttcctgtaatctttgcatggcacggctacaagagtatgatggaatcaatttggtttgcacgtaaccgtcataatgtacatattcactgctacgaagaaaacggtgatattactaccccatttgatatgcgtgttttgaaccaccttgacagatttgatcttgccaaagatgctgttgaaagtgttgataaattgaagggcaagaacgctgactttatcagtcatatggatgacttgcttgaaaagcaccaccaatacattcgtgataatggtaaagatatgccagaagttactgaatggaagtggaagggcttgaagtaa

SEQ ID NO: 163 - DNA, 2439 bp, Lactobacillus crispatus JV-V01
atgaaaaagagcactcttagatgctcaaaggagaataagatggcagttgattatgactcaaaagactatttaaagagcgttgatgcttattggcgcgcagccaactacttgtcagttggtcagttgttcttgatgaagaaccctcttcttaagaccccattggttgcagaagacgttaagcctaagccaattggtcactggggcactattgcaccacagaactttatttatgctcacttgaatcgtgtgcttaagaagtatgacttgaacatgttctatattgagggttcaggtcacggtggtcaggtaatggtttctaactcatatcttgatggttcatatactgaacgttacccagagattacccaggaccaaaaggggatggctaagctattcaaacgcttcagtttcccaggcggtgttgcttctcacgctgctcctgaaactccaggttcaattcatgaaggtggggaattaggctactcactttcacacggtactggtgctgttttggataatccagatgttattgccgctgttgaaattggtgatggtgaagctgaaactggtcccttagctgcttcatggtttagtgacaagttcattaacccaattaaagatggtgcagttctgccaatcttgcaaatcaacggctttaagatttctaacccaaccattgtttctcgcatgagcgatcaagaattaaccgaatacttccgtggcatgggctgggatcctcactttgtttcagtctttaagggtggccgttttgacggtgaaaaggacccaatgcaggttcacgaagaaatggctaagaccatggatgaagtcattgaagaaatcaaggctattcaaaagcacgcccgtgaaaacaatgacgctactttgccacactggccaatgattatcttccaatgccctaagggctggactggtccaaagaaggacttggatggcaacccaattgagaacagcttccgtgctcaccaaattccaattccagttgctcaaggcgatatggaacacgctgatatgcttactgattggctggaaagctacaagccggaagaattgtttaatgaagacggttcacctaaggaaatcgtaactgaaaacactgctaagggtgaacatagaatggccatgaacccaatcactaacggtggtcttgatcctaagcggcttaacttgccagactaccgcaaatttgctttgaagtttgacaagccaggttctatggaggcacaagacatggttgaatgggctaagtacttggatgaagttgctaagctcaacccaactactttccgcggctttggcccagatgaatccaagtcaaaccgtctgttccaattgcttgacgatcaaaagcggcaatgggaaccagagattcatgaaccaaatgatgaaaacctggctcctagcggtcgagtaattgattcacaattgtcagagcaccaagatgaaggctttctcgaaggctacgttttgactggccgtcatggcttcttcgctacttatgaagcctttggccgggtagttgactctatgcttactcaacatatgaagtggctcagaaaggctaaggaacaatactggcgtcatgattatccatcacttaactttgtcgcaacttcaactgtattccaacaagaccacaatggttacactcaccaagatccaggcatcttgactcacttgtatgaaaagaaccgtccagatcttgttcatgaatacttgccatcagacactaatacgcttttggcagttggcgataaggccttgaaagatagagaatgcatcaatgttttggtaacttctaagcagcctcgtccacaatggttctcaattgaagaagcacaaaagttggttgacaagggcttaagctacattgactgggcttcaactgataagggtgctaagccggatgttgtctttgcttcaactgaaactgagccaactattgaaactttggccgcaattgatattttgcataagaagttcccagatctcaagattcgctacattaacgtagttgatgttatgaagttaatggatccaaaggacaacaagaatggcttgtcaactgaagaatttgacagattattccctaaggatgtaccagtaatctttgcatggcatggctacaagagcatgatggaatccatttggtttgctcgcaagcgttacaatgttcatattcactgctatgaagaaaatggtgatattactaccccatttgacatgcgggtattgaatcatcttgatcgctttgacctagctaaggatgccgtagaaagcatcccagctttgaagggcaagaatgcggacttcatcagtcacatggattacttgcttgaaaagcaccaccaatacatccgcgacaatggtaaagacatgccagaagtaaccgaatggcaatggtcgggcttgaagtaa

SEQ ID NO: 164 - DNA, 2400 bp, Lactobacillus ultunensis DSM 16047
atgacagttgattacgattctaaagactacttaaagagcgttgacgcttattggcgtgcagctaactacttatcagttggtcaattattcttaatgaagaaccctttgcttaagacgcctttagtagcagaagatgttaaacctaaaccaatcggtcactggggcactattgcaccacagaactttatttatgcacacttgaaccgtgtacttaagaaatatgatttgtacatgttctatattgaaggctcaggtcacggtggtcaggtaatggtttccaattcttatcttgatggttcatatactaaacgttatcctgagatcactcaagatgaaaaaggaatggctaaattattcaagcgcttcagttttccaggcggtgttgcttcacatgctgctcctgaaacaccaggttctatccatgaaggtggagaattaggctactcactttcacacggtgtaggggcaattttagataaccctgatgtaattgctgctgtagaaattggtgacggtgaagctgaaactggtcctcttacagctagttggtttagtgacaagtttattaatccaattacagatggtgctgttttgccaattattcaaattaatggtttcaagatttctaacccaactatcgtttctagaatgagcgatcaagagttaactgaatacttccgtggtatgggttgggatccccactttgtttctgtcttcaagggcggccgttttgatggtgaaaaggatccaatgcaagtacatgaagaaatggctaagacaatggatgaagttatccaagaaatcaaggctattcaaaagcacgctcgcgagaataatgatcctactttgccacattggccaatgattgttttccaatgccctaagggttggactggtccaaagaaggatttggatggcaacccaattgaaaactcatttagagctcaccaaattccaattccagtttctcaaggtaatatgaagcatgcagatatgcttactgactggcttgaaagctacaagcctgaggaattgttcaacgaggatggctcaccaaaggatattgttaccgaaaatactgctaagggtgaccacagaatggcaatgaacccaattaccaatggtggtcttaatcctaagagacttaatctgccagattatcgtgacttcgccttgaagtttgataagccaggttctgtagaagcacaagacatggtggaatgggctaaatatctggatgaagtagctaagcttaacccaactactttccgtggtttcggtccagatgaatctaaatccaaccgtttgttcaaattgcttgatgatcaaaaacgtcaatgggaaccagaaatccatgaacccaacgatgagaacttggccccaagtggtcgggtaatcgactctcaattatcagagcaccaagatgaaggtttccttgaaggttatgttttaactggtcgtcatggtttctttgctacttatgaagcatttggtcgtgtagttgattccatgcttactcaacacatgaagtggttacggaaagcaaaagagcaatattggcgtcatgattacccatcactgaactttgttgctacttcaactgttttccaacaagaccacaacggttatacccaccaagatccaggtgtcttgacgcacttatttgaaaagaatcgtccagatttaattcatgagtacttgccatccgatactaatactttgttggcagtgggcaacaaagcattgcaagatcgtgaatgcattaatgttttggtaacttcaaagcaaccacgtccacaatggttctcaattgaagaagcacaaaagttagttgatcatggtttaggttatgttgattgggcttcaacagataagggtgctaagccagatgttgtttttgcatctactgaaactgaaccaactattgaaactttggcagcgattgacattttgcataagaagtttccagacttgaagattcgttacattaatgtggttgatgtaatgaagttaatgtcacctaaggacaataagaatgctatttctgatgaagaattcgatcgtttattcccaagtgatgtaccagtaatttttgcatggcatggttacaagacgatgatggaatcaatttggtttgcacgcaatcgtcataatgttcatattcactgttatgaagaaaatggtgatattactactccatttgatatgcgtgtcttgaaccaccttgatcgctttgacttggctaaagatgctgtggaaagcgttgaaaaattaaagggcaagcatgcggactttattagtcagatggatgacttgcttgaaaagcaccaccaatacattcgtgattatggcaaagacatgccagaagttactgaatggcaatgggaaggcttgaagtaa

SEQ ID NO: 165 - DNA, 2397 bp, Lactobacillus crispatus 125-2-CHN
atggctgtagattacgattcaaaagaatatttaaagagcgtcgatgcttattggcgtgcagcaaattacttatcagttggtcaacttttcttaatgaaggccccacttcttaaaacacctttagttgctgaagatgttaagccaaagccaattggtcactggggaactattgctccgcaaaactttatttatgctcacttaaacagagtgttaaagaagtatgatctggatatgttctatattgaaggttcaggtcatggtggtcaagtaatggtttctaactcatatctggatggttcatacactgaacgctatccagagatcacccaagatgaaaagggtatggctaaattgtttaagcgcttcagtttcccaggtggtgtggcatcacatgctgctcctgaaactcctggatcaattcatgaaggtggggaattaggttactcactttcacacggtactggtgctatcttagataatcctgacgtcattgctgctgttgaaattggtgatggtgaatcagaaactggtccacttacagctagttggtttagtaacaagtttattaatccaattaacgatggtgcggtattaccaattttgcaaatcaatgggtttaagatttctaatccaactattgtttctcgtatgagtgacaaagaattaactgaatacttccgcggcatgggctgggatcctcattttgtttcagtctttaaaggcggtcgttttgacggtgaaaaggatccaatgcaggttcacgaagaaatggctaagactatggatgaagtcattgaagaaattaaggctattcaaaagcatgcccgtgaaaacaatgacgctactttgccacattggccaatgattatcttccaatgccctaagggctggactggtccaaagaaggatttggatggcaacccaattgaaaactcattccgggctcaccaaattccaattccagttgcacaagatgatatggaacataaggaaatgcttgaaaaatggcttaagagctacaagccagaagaattattcaatgaagatggttcacctaagaagatcgttactgaaaatacggctaagggtgaccacagaatggccatgaatccagttactaatggtggtaagaaccctaagcgtttgaacttgccagattaccgcaagtacgcattgaagtttaagccaggtcaaatggaagcacaagatatggttgaatgggctaaataccttagcgaagttgctgatcttaacccagacacattccgtggctttggtccggatgaatctaagtcaaaccgtttgtttgcacttcttgatgatcaaaagcgtcaatgggaaccagaaattcatgaacctaatgatgaaaacctagctccaagtggtcgtgtaattgattcacaattgtcagaacaccaagatgaaggattccttgaaggctatgttttgactggccgtcatggcttcttcgctacttacgaagcctttggccgtgtagttgattcaatgcttacccaacacatgaagtggttaagaaaagctaaggaacaatactggcgtcatgactatccatcacttaactttgtcgcaacctcaactgtcttccaacaagaccacaatggttacactcaccaagacccaggcatcttgactcacttatatgaaaagaatcgtccagaccttgttcatgagtacttgccatcagacactaatacgcttttggcagttggcgacaaggctttgaaagacagagaatgcatcaatgttttggtaacttctaagcagcctcgtccacaatggttctcaattgaagaagctactaaattagctgataaaggattgagttacattgactgggcttcaactgatcaaggctataagccagatattgtatttgcttcaactgaaactgaaccaactttggaaagtttagctgcaattgatatcttgcacaagcgtttcccagaccttaagattcgttacataaatgtagtagatgtgatgaaattaatgagtcctaaggataataagaatgctgtctctgataaagagtttgatcgcttattcccaagtgacattccagtaatctttgcatggcatggatacaagactatgatggaatcaatctggtttgcaagaaaccatcataatatacatattcactgttacgaagaaaatggtgatattactaccccatttgacatgcgtgtcctgaaccaccttgatcgtttcgacttggctaaggatgctgttgaaagtattccatcattggcaggtaagaatccagacttcatcaatgaaatggatgacttgcttgctaaacaccaccaatacattcgtgataatggtaaagacattcctgaagtcactgagtggaagtggacaggtcttaagtaa

SEQ ID NO: 166 - DNA, 2457 bp, Lactobacillus gasseri JV-V03
atgattaatactgtaataagcaatgaaaactatttcaaggagatacttgctatggtagtaaattatgattctgaagaatatttaaagagcgtcgatgcatattggcgtgcagccaactacttatcagttggtcaactatttttaatgaataatccactattaaaaggcgaattaaaagctgaagatgtaaagcccaagccaattggtcactgggggacaatcgttccacaaaactttatttatgctcatttaaatcgtgcaattaaaaagtatgatttaaacatgttctatattgaaggatccggtcatggtggccaagtaatggtatctaattcatacttagatggttcatatactgagcgctatccagaaattactcaagatgaaaagggaatggctaagttatttaagcaatttagtttcccaggtggagttgcttctcatgctgcaccagaaacaccaggatcgatccatgagggtggcgaattgggctattcactttctcatggtgtaggtgcaattttagataatccggatgtaattgcagcggttgaaattggtgacggtgaatcagaaactggtccacttgctacttcttggttctcaagtaaatttattaatccaattaaagacggtgctgtcattccaattttacaaatcaatggctttaagatctctaatccaactatcgtttccagaatgagcgatgaagacctaactaagtactttgaaggaatgggttggaagccatattttgtttctgcatataaagatggcgaatttaatggttacaaggaccacatggaagttcaccacgagatggctaagacaatggatgaagttgttgaagaaattaaggctattcaaaagcatgcccgtgaaaataacgatgattcattagttaaatggccaatgattgtctttagagtgcctaagggatggactggtcctaaatttgacttagatggtaatccaattgaaaatagcttccgtgctcaccaaattccaattccagtttctcaaggtgatatgagtcataaggaaatgcttaccgactggatggaaagctataaaccagaagagctatttaatgaagatgggtcacctaaggaaattgttaaagaaaacaccttatctggcgaccaaagaatggcgatgaatccagtaactaatgggggaattaatcctaaagttttaaatatgccagattaccgtgattttgcagtgaaatttgataaacctggttctgttgaaaagcaagacatggctgaatgggcaaaatacttagacaagatggctgccttaaatccaactaatttccgtggttttggtccagatgaaactaaatctaaccgtttattccaacttttagataatcaaaaacgtcaatggatggaaaatattcatactccaaatgatgaaaacttggctcgcgaaggtcgcgtgattgattcgcaattatctgaacaccaagatgaaggatggcttgaaggttacgttttgacaggcagacatggtttctttgctacatatgaagcatttggccgcgtagttgattcaatgcttacccaacacatgaagtggttaagaaaggctaaagaacaaacttggcgtcatgattatccagctttgaacttagttgatacttcaactgttttccaacaagatcataacggttatactcaccaagatcctggtatgttaacccacctttatgaaaagaaccgtccagatttaattcatgaatacttaccagcagatactaactcacttcttgctgtatctgataaggcatttagagatcgtgaatgcattaacgttttagtaacttccaagcaacctcgtccgcaatggttctcgattgaagaagctaaaaagttagttgataaaggtcttggctacattgactgggcatcaactgataagggtgctaagccagatgttgtctttgcttccactggtactgaaccaacgattgagtcgttagctgcgattgatttattgcataaaaagttcccagacttaaagattcgttacattaatgttattgatgtcatgaaattaatgtctccagaaaagaatccgaatgcaatcagcaatgaagaattcgatcgtcttttccctaaagacacaccagtcatctttgcatggcacggctttaaaccaatgatggaatcaatttggtttgatcggggacgcggaaagaatgatgttcatattcatggctatgaagaaaatggtgatattactacgccatttgatatgcgagtattgaaccatatggatcgctatgatttagcaaaagatgttgtcgaaagtgttcctgaactaagtgaaaagaatgctgactttattgatgaaatggatagcttgcttgctaaacaccatcaatatattcgcgacaatggtaaagatatgcctgaagttacagaatggcaatggaatggcttaaaatag

SEQ ID NO: 167 - DNA, 2397 bp, Lactobacillus iners DSM 13335
atgaattacgatagtgaagaatatttaaaatctgttgatgcatattggcgtgcagccaattatttgtccgttggacaactttttttgatgaataatcctttgttgaagcaagatttagttgctaccgatgttaagcctaaaccgataggtcattggggaacgattgctccgcaaaattttatttatgcacatctaaatcgagttatcaaaaaatataatttgaatatgttctatattgaaggatctggtcatggtggtcaagtgatggtgtctaattcttatttagatggttcatatactgaaacatatcctgagattacgcaagatgaaaaaggaatggctaagttatttaagcaattcagttttccaggtgggatagcatcacatgctgcaccagaaacaccaggttctattcatgaaggtggagaattagggtattgcttatcacatggtgtaggtgctattttagataatccagatgttattgcggcagttgaaataggtgatggtgaatcagaaactggtcctttagctactagttggttttctgataaattcattaatccaattcatgatggggcagtgattcctattttgcaaattaatggttttaagatatcaaatccaacgattgtgtcgcggatgtcggatgcggaattaacacaatattttgaagggatgggttggaaaccatattttatttctgcatataatgatggacaatttaatggttataaaccgcatatgcaagttcatcatgaaatggctcatgtacttgaccaagtaatagaagaaattaaagcaattcaaacgcatgcacgagaaactggcgacagttccttaccaacatggccgatgattatctttagagtacctaaaggttggacaggtcctaagtttgatttagatggcaatccaattgaaaatagtttcagagcacatcaaataccaattccagttagtcaaaagcaaatggaacacaaagatttattgaccgattggttaaagagttatcatcctgaagaattgtttgaagatactggttatccaaaaccgatagtattgcaaaatacgcttacaggtgtacatagaatggctaaaaatcccattactaatggcgggttaagtccaaaatctttaaatttacctgattttagaaaatttgctgtgaaatttgatcaaccaggttctgttgaaaaacaagatatggttgagtgggctaaatatttggatgcaatagctaaattgaatcccgataattttagaggttttggccctgatgagtgcaaatctaatcgtttattcgatttgctagataatcaaaaaagacaatggatggaaaaaatccatcaacctaatgacgaaaatttgaacaattctggtagaattattgattcacaattatcagaacatcaagcagaaggatggcttgagggatatgtattaacaggtcgtcatggcttttttgcaacatatgaggcatttggacgtgtagttgattcgatgttaacgcaacatttcaaatggttacgtaaagctaaagaacaagcttggcgtagatattatccagctttgaactttgttgatacttcaacagtatttcagcaagatcataatggatatacccaccaagatcccggtttattgacgcatttatttgaaaagggacatgcagatttggttcatgaatatttacctgcagatgctaattcgcttttagcagtatcagataaggcatttaaagatcgtgaatgtattaatattttggttacatccaagcaaccacgtccgcaatggtttagtattgatgaagctaaacgcttagttgatcacggcttgggatatattgattgggcatctacagaccataatgcaaaacctgatgttgtgtttgcttctactggaacagagcctaccattgaaacgttggctgcaattgatattttgcataaagaatttcctgaattgaagattcgctatattaatgtgattgatgtcatgaaattaatgcctacatctaaaaataatgcggcaatttccgatcaagaatttgaacgactatttccgataggcgtgcctgttatttttgcttggcatggatttaaaccaatgatgtcatcgatttggtttgaacgtggtcgtggtaaagatgatattcatattcattgttatgaagaaaatggtgatattacgacaccttttgatatgcgtgttttaaatgaacttgatcgtttccatttagttaaagatgcagtgatgatgactaatttagcagatactaatgctgaattcatagaacaaatagacagacttttagataaacaccatgtatatattagagattatggtgaagatatgcctgaagtagtttcatggaaatggcaaggcttaaaatag

SEQ ID NO: 168 - DNA, 2403 bp, Lactobacillus delbrueckii subsp. bulgaricus ATCC 11842
atgacagcagattacgattcaaaagaatacttaaagagcgtcgacgcttggtggcgggccgccaactacttgtcagtcggccagttgttcctgctcaagaaccccttgcttaaggaagaactgacggcagacgacgtcaagatcaagccggttggccactggggcacgatcgcgccgcagaactttatctacgcccacttaaaccgggttatcaagaagtatgacttgaacatgttctacatcgaaggttccggtcacggcggccaggtgatggtttccaactcatacctggacgggtcttactctgaaatctacccggaaatcagccaagacgaagccgggatgaccaagctcttcaagcgcttcagcttcccgggcggggtagcttcccacgcggctccggaaaccccgggttcaatccatgaaggcggggaactgggctacactttgtcgcacgcgactggcgcgattctggacaacccggacgtgattgccgccgctgaaattggtgacggggaagctgaaaccggcccgctggctgctggctggttctccaaccgcttcatcgacccggtcaaggacggggctgtcttgccaatcctgcaggttaacggctttaagatttccaacccaaccattactgcccgcatgagcgatgaagaactgactaagtactttgaaggcatgggctggaagccttactttgtttcaactttcaagggcggccgctttgacgggatgaaggatattgaccagatccatgaggaaatggccaagaccctggatgccatcattgaagacatcaaggctattcaaaagaatgcccgtgaaaacggcgataaatcatttgcccactggccgctcttgatcttccaatgcccgaagggttggactggtcctaagaccgatttggacggcaacccaattgaaaactccttccgggcccaccagattccgcttccggttgaccagaagcacatggaccacaaggaactgttgctggactggctgaagagctacaagccggaagaactgtttgacgaaaccggctacccgactgacttagtcctgcaaaacgcggttcatggtgaccaaagaatggctatgaacccagtaactaacggggggatcaatcctaagcgcttgaatctgccagactggcgcgactttgcctttgaagttggcaagccgggctccaaggacgcccaggatatggtggaatgggccaagtacctgaccaaggtggcagaactgaacccgactactttccggggctttggcccggacgaatccaagtccaaccgcttgtttgacttcctggacagcgaaaagcggcaatgggaaagtgaaatccacgaaccaaacgatgaaaacctggccgcgcaaggccgtttgattgactcacaattgtcagagcaccaagatgaagggatgctggaaggctacgttttgactggccgccacggcttcttcgctacttacgaagcctttggccgggtggttgactccatgctgacccagcacatgaagtggctgcggaaggctaaggaacaatactggcgccgcgattacccatcattgaactttgtagctacgtcaactgtcttccagcaggaccacaacggctacacccaccaggatccaggtcttttgacccatttgtttgaaaagaaccggccggacatgattcatgaatacctgccagctgacaccaacactttgttggctgtagctgataaggccttccgtgaccgggaagggatcaacctgctggtaacttccaagcaggaacggccgcaatggttcactcctgaagaagctgccaagctggttgacaagggcctgggctacatcgactgggcttcaactgacaaggatgccaagccggacgtggtcttcgcttcaactgaaactgaaccgaccatggaaaccctggcagcgatcgacatcctgcaccagaacttcccagacttgaagatccgctacatcaatgtggttgacgtgatgaagctgatggcgccaaaggataacccagctgctatttcccaagaggaattcgaccgcctcttcccaactgacgtgccaaccatttttgcatggcatggctacaagaccatgatggaatccatctggtttgcccgcaagcgttacaacgtttcaattcactgctatgaagaaaatggtgacattaccacggcatttgacatgcgggtcttgaaccaccttgaccgtttcgacctggccaaggacgcggttgaacaaatcccagccttgaaggacaagagtgctgccttcatcgacaagatggacagcctgctgtctaagcaccacgcttacatccgggaccacggtgaagacattccagaagtaacttcttggaagtggactggcctggacaagtaa

SEQ ID NO: 169 - DNA, 2370 bp, Lactobacillus jensenii JV-V16
atggcagttaattatgattcacaagactacttaagaagtgttgatgcatattggcgtgcagctaattatttatcagttggtcaattatttttaatgaagaatcctttattaaaaacagaattgaaggctgaagatgttaaacctaagccaatcggtcactggggaactattgtcccacaaaactttatttatgctcatttaaaccgtgcaattaagaaatatgatcttaatatgttttacattgaaggttctggacatggtggccaagttatggtttcaaattcatatcttgatggttcatacactgaaagatatccagaaattacacaagatgaagcagggatgacacgcttgttcaagcgcttttcattcccaggtggtgttgcttcacatgctgcaccagaaactcctggctcaattcatgaagggggagaacttggttattcactttcacatggtgttggtgcaattttagataaccctgatgtaattgcagctgttgaaattggcgatggtgaaagtgaaactggtccacttgcagcaagttggtttagtgataagtttattaacccaattcacgatggtgcagttttaccaattttacaaattaacggttttaagatttcaaatcctactattgtttcaagaatgagcgatagtgaattaactcaatactttgaaggtatgggttggaagccatactttgtaaatgttcatggtttaagccacatggaagctcacgaattgatggctaaggaattagataaagctattgaagatattaaggctattcaaaagcacgctcgtgaaagtggtgatgactcaatgccacaatggccaatgcttgttttacgtgcaccaaagggatggactggtcctaagtttgatttagatggtaacccaattgaaaattcatttagagctcaccaaattccaattccagtagatcaagaacatatggaacataaagatatgcttattgattggatgaagagctacaagccagaagaattatttaatgaagatggctcaccaaaagatatcgttcttgaaaatacagttcaaggcgatcaaagaatggcaatgaatccagtcacaaatggtggtattaatcctaagcggcttcacttacctgattggagaaattatgcaattgattttgataagccaggtagtgttgaaaagcaagatatggcagaatggtctaaatatctaaatgaaattgctaatttgaatccaactaacttccgtggctttggtcctgatgaatctaagtctaaccgcttgttcactattttagatggacaaaagcgtcaatggatggaagatattgaagaaccaaacgatgaagatttagctcgttctggtagaatgattgattctcaattgtcagaacaccaagcagaaggatggcttgaagggtatgtcttaacaggtcgtcatggcttctttgcaacttacgaagcttttggtagagttgttgactcaatgctaactcaacatatgaaatggctcagaaaggctaaagaacaatactggagacatgattacccagcacttaacattgttgatacttcaactgttttccaacaagatcacaacggatacactcaccaagatccaggtcttttaacccacctctttgaaaagaatcgtccagatttaattcatgaatacttgcctgctgatactaactcattacttgctgtaagtaataaagcttttgcggaccgtgaatgtatcaatgttttggtaacttcaaaacaacctcgtcctcaatggtttagtaaagaagaagctcaaagattagttgaaaatggccttagttatattgactgggcatcaactgatgaacatgctgaaccagacgtagtctttgcttcaactggtacagaaccaactttggaaactttagcggcaattgatttattgcacaagaatttcccagaacttaagattcgttacattaacgtcttggatgtaatgaagatgcaaagtcaacgtaagaatccaaatggtttatcagatgaagaatttgatcgtttgtttactaaggataagccagtaatctttgcatggcatggcttcaagccaatgatggaatcaatttggttcgatcgtcataatcataatgtatcaattcatggttatgaagaaaatggtgacattactactccatttgatatgcgtgtattaaatgaaattgaccgtttccacttagccaaagatgctgttgaacatcttgatttaccagcagcaggctttattgatgaaatggatagacttttatctaagcaccacacttacattcgtgataatggtaaggatattcctgaagttactgaatggaaatggaaaggcttaaactaa

SEQ ID NO: 170 - DNA, 2391 bp, Lactobacillus buchneri ATCC 11577
atgacagtagattacgattccaaagaatatttggatcttctagacaagtactggcgtgccgcaaattacctttcagtaggtcagttgtacttgcgtgacaatccattgctcaagcgtcctttgaagtcagatgatgttaagatcaagccaattggtcactggggtactatcgtttcccaaaacttcatctacgctcaattgaaccgtgccatcaacaaatatgatttaaacatgttttatattgaaggctcaggtcatggtggccaagttatggtttctaactcataccttgatggtagttattcagatatttatccaaatatctcacaagacgaaaaaggtatgcaaaagttgttcaagcaattctcattcccaggtggagttgcttcacatgccgcaccagaaactccaggttcaatccatgaaggtggagaacttggatactcactttcacatggtaccggtgctatcttggataacccagatgtaatcgctgctgttgaaattggtgacggtgaatcagaaaccggtcctttggccgcatcatggttctcagacaagtttatcaatccaatcactgatggtgcggtattgcctatcattaacatgaacggtttcaagatttctaaccctactatcctttcacgaatgagtgatgcagacttaactgattactttaaaggtatgggctgggaagcacactttgttgaagctactgctgacactgatcatgcaaaagttgaagcagaatttgctaagacattggatactgttattgaaaagatcaagtccattcaaaagaatgctcgtgaaaacgaaacacctgacaatgttaagttgccggtatggccaatgatcatcttccgttcacctaagggctggactggtcctaagaaggatctcgatggtaaccctattgaaggctcattccgtgctcaccaagttccaattcctgttgatgcaaatgacatggaacatgccgatgaacttgttgactggttgaagtcatacaagccagaagaattatttgatgaaaatggtactttgaagcctgaacttcgtgcacttgcacctaagggcgaacaacgtatgtcagttaacccaatcacaaacggtggtatcaagccagaaccattaaagcttcctaacgttcgtgactttgaagttaagtttgacaagcgtggtactgaacaaaagcaagatatgatcgaatggtccaagtggttggatgcagttgctaaattgaatccaacaactttccgtggcttcggtcctgatgaaaccaagtcaaaccgtctttatagtttgcttgatgatggtaagcgtcaatggatggaagacattcatgaaccttatgatgaagatctcgcaaaccacggccgtgttattgactcacaactttcagaacaccaagcagaaggttggcttgaaggttatgtcttaactggtcgtcatggattctttgctacttacgaatcatttggacgtgttgtggattcaatgttgactcaacacttcaagtggttacgtaaggcttcagaacaatactggagaaagcaatacccatcattgaactttgttgatacttcaacagtattccagcaagatcataatggttacacccaccaagatccaggcctgttgactcatttagctgagaagaagcctgaattcatccgtgagtatttgccagccgatgctaacgaattgttagccgttggtgattcagcatttagaacctacgaaaagattaacttgattgtgacatccaagcatccacgtcgtcagtggtactcaatggatgaagcacaaaacttggttaagaacggtcttggatacattgattgggcttcaactgatcaaggtcaagaacctgatgttgtctttgctgccgcaggtagcgaacctaacttggaagccttggctgctatctcaatcttgaacaaggaattcccagagttgaagattcgctttatcaacgttgttgatatcttgaagcttaactcacctaagaaggatcctcgtggcttgagcgacgaagaattcgataacttgttcaccactgacaagcctgtcatctttgcatggcatggtttcgaagatatgatcaaggatatcttcttcgatcgtcataaccacaacctttacgttcatggttaccgtgaaaacggtgatatcactacaccatttgatatgcgtgtattgaacgaattggatcgtttccacttagctgctgatgctattcgtcatattccagcatacgccgttaagggtggttacttcatccaacgtatgaacaacatcgttgacaagcataaccgttacatccgtgaggttggtactgaccttccagaagtaacatcatggaactgggaaccacttaacaagtaa

SEQ ID NO: 171 - DNA, 2409 bp, Oenococcus oeni ATCC BAA-1163
atgattaacaaggagaatctacggatgactattaattatgattcaaaggattatttgaaatatgttgatgcctattggcgggctgccaattatctttcagttggtcaacttttcttgagaaacaatccgttacttaaagacgaacttcagtccaaagacgttaagatcaagccgatcggtcattggggaacggttgcaccgcagaattttatttatgctcatttaaatcgagcaattttaaaatacgatttaaatatgttttatattgaaggctccggccatggtggtcaggtaatggtttccaattcatatttggatgggtcttataccgaaacttatccaaaaataactcaggatattcaaggaatgcaacgtttattcaaacaattctcttttcctggtggaattgcttcgcatgctgctccggaaactcctggatcgattcacgaaggaggagagctgggttattcgatttcgcatggagttggtgctattttggacaatcccaacgtgattgctgctgttgaaatcggggatggtgaatcagaaacggggcctttggccgcctcgtggttttccgacaaattcattaatccgattcacgatggtgctgtgctgccgattgttcaaattaatggatttaaaatttccaatccaacaattctttctcgcatgagcgatcgcgatttgaccaattattatcagggaatgggttgggagcctttgttcgttgaaactgatggttcagataattttaaagtgcatgccgagatggccgatgccgttgataaagccattgaaaaaattaaagctattcaaaaaaacgcccgtaataataatgatgattcattgccaatctggccgatgattgtattacgtgctcctaaaggctggaccggtccaaaaaaagatttggatggtaatccgattgaaaattcttttcgggcgcatcaggtgccgattccagtcgatgcaaatcatttggaacataaagatatgctgattgattggatgaagtcctacaaaccggaagaattgtttaatgaggatggcagcttaaaagaaattgttaaggtaaatcagccaaaaggccaacggcgaatggcaatgaatccaatcacgaatggtggaataaagccaaggacattgaatatgcctggtatagaacgatttgcttttccgaaaaataacttgaaaaacaataaaaaaccagggatggatcttcaggttgtttcaacatttattgccgaaataatgaagaaaaatcctatcaatttccgtcagttcggtcccgatgaaacaatgtccaatcgtctctgggacgagtttaaagtcactaatcgtcagtggatgcaagcagtccatgaaccaaatgatcaatatatggctcattctggtcgtattctagatgctcaattgtctgaacatcaggccgagggatggatggaaggatacgttttgaccggccgacacgctttctttgcgtcctacgaagcctttacgcgtgtaattgattcgatgctgactcaatattataagtggttgcgaaaagcggtcgagcaagattggcgtcacgattatccttcgttaaatgtcattaatgcttcacatgcttttcaacaggaccataatggttatactcatcaagatcccggtatgcttactcatatggctgaaaaaggtcatgagtttgtcaatgaattcttgccagccgatgctaattcccttttggcagttatgaataagtctctgcaggttagaaacaaaattaacattattgtcgcttccaaacacccacgaactcaatggtttacgatcgacgaagccaaggaattggttgacaacggtttgggaattattccatgggcttccaacgatgacggagtggaaccggacgttgtttttgcagccggtggaacggaagcgactatggaaagtttggctgctatttcgctcttgcatgaaagcttccctgaattgaagttccgctttattaatgtaatcgatttgttgaaactgcgcaaaaaaggggataacgatgattatcgcggtctaagcgatttggaattcgaccattactttacgcgtgaaaaaccagtagtcttttccttccacggctttgaaagtttggcacgcgacttgttctatgaccgccacaatcataatgttatttttcatggatatcgtgaaaacggagacattacaactccgttcgatatgcgtgtcctgaatcatcttgatcgtttccaccttgccaaagacgcaatcaacgcaactaagtacgctgatgtggctggccaatttggccaacgaatggatgatatgttgtccaaacataccgcttatatttgcgatcagggaacagacctgcctgaagtaacctcttggcagtggcaggatattaaataa

SEQ ID NO: 172 - DNA, 2367 bp, Lactobacillus plantarum WCFS1
atgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataa

SEQ ID NO: 173 - DNA, 2367 bp, Lactobacillus pentosus
atgtctacagattactcatcaccagcatatttgcaaaaagttgataagtactggcgtgctgccaactatttatcagttggtcaactttatttaaaagataatcctttattacaacggccattaaaggctagtgacgttaaggttcacccaatcggtcactggggcacgattgccggccaaaacttcatctatgcgcatcttaaccgggtcatcaacaagtacggtttgaagatgttctacgttgaaggtccaggtcatggtggccaagtgatggtctccaactcataccttgatgggacttacacggatatttatcctgaaattacgcaggatgttgaagggatgcaaaaactcttcaagcaattctcattcccaggtggcgtggcttcccatgctgctcctgaaacaccaggctcaatccacgaaggtggcgaacttggttactcaatttcacacggtgttggggcaatccttgacaaccctgatgaaatcgccgcagtcgttgttggtgatggggaatccgaaaccggcccattagcaacttcatggcaatcaacgaagttcatcaacccaatcaacgatggggcagtgttaccaatcttgaaccttaacggctttaagatttctaacccaacgatttttggtcggacttctgatgaaaagatcaagcaatacttcgaaagcatgaactgggaaccaatctttgttgaaggtgacgatcctgaaaaggttcacccagctttagctaaggccatggatgaagccgtcgaaaagatcaaagccattcaaaagaacgctcgtgaaaacgatgacgctactttaccagtatggccgatgatcgtcttccgcgcacctaagggctggactggtcctaagtcatgggatggcgacaagatcgaaggttcattccgagctcaccaaattccaattcctgttgaccaaaccgacatggaacatgccgatgcgttagttgactggttggaatcatatcaaccaaaggaactcttcaatgaagatggttctttgaaggatgatatcaaagaaattatcccaactggcgatgcacggatggccgctaacccaatcactaatggtggggttgatccaaaggccttgaacttacctaacttccgtgattacgccgttgatacgtctaagcatggtgccaacgttaagcaagatatgatcgtttggtcagactacttgcgtgatgttatcaagaagaacccagataacttccggttatttggccctgatgaaaccatgtcaaaccggttatatggtgtctttgaaaccactaaccgtcaatggatggaagatattcacccagatagtgaccaatacgaagcacctgctggccgggtcttggatgctcaattatctgaacaccaagctgaaggttggttagaaggttacgtcttaactggtcgtcatggcttgtttgcaagttacgaagccttcttacgggttgtcgactcaatgttgacgcaacacttcaagtggttacgtaaggccaacgaacttgactggcggaagaagtacccgtcactcaacattatcgcggcttcaactgtgttccaacaagaccataatgggtacacccaccaagatccaggtgccttgactcatttggctgaaaagaagcctgaatatatccgcgaatatttaccagccgacgccaactccttgttagctgttggggacgtcatcttccgtagccaagaaaagatcaactacgtggttacgtcgaagcacccacgtcaacaatggttcagcattgaagaagctaagcaattagttgacaacggtcttggtatcattgactgggcaagcacggaccaaggtagcgaaccagatatcgtgtttgctgctgccggaacggaaccaacgcttgaaacgttggctgcaatccaattgctccatgatagcttcccagacatgaagattcgtttcgtgaacgtggtcgacatcttgaagttacgtagccctgaaaaggaccctcgtggcttgtcagatgctgaatttgaccattacttcactaaggacaaaccagttgtcttcgccttccatggttacgaagacctggttcgtgacatcttctttgatcgtcacaaccacaacttacacgtgcatggctaccgtgaaaatggtgacattacgacaccattcgatgtccgggtcatgaaccaaatggaccgtttcgacttagcaaaatctgcaattgcggcgcaaccagcaatggaaaacaccggtgcagcctttgttcaagacatggataacatgcttgcaaaacacaacgcatacatccgtgacgccggaaccgacttgccagaagttaacgactggcaatggaaaggtttgaaataa

SEQ ID NO: 174 - DNA, 2364 bp, Lactobacillus sakei subsp. sakei 23K
atgacagattattcaagtaaagaataccttgctaaagttgatgcattttggcgagcagctaactatatctcagtaggccaattatatttaaaagacaatccattattacaacgtcccttagaagcaaaagacgttaaagttaaaccaatcggacactggggcacaatctcaggacaaaacttcttatacgcacatttgaaccgtgccattaacaagtacgacttgaacatgttctacgttgaaggcccaggtcatggtggccaagtcatggtttcaaattcatacttagacggtagttatacagaaatctacccagaaatttctcaagatgttgatgggatgaagaaattattcaaacaattctcattcccaggcggcgttgcttctcatgctgctcctgaaacacctggttcaatccacgaaggtggcgaacttggttattcattatcacacggtgttggtgcaattttagacaacccagacgtcatcgcagctgttgttgttggtgatggggaagctgaaactggcccattggcagcatcatggttatcaagcacatttatcaatcctaaaaatgatggtgctgtcttaccaatcttgaacttaaatggtttcaagatttctaacccaacaatcctttcacgtaagagtgacgaagaattaacaaaatacttcgaaggtaacggttgggcaccaatctttgttgaaggcgacgatcctgaaaaaatgcacccagcaactgctgctgcaatggatgaagccatcgaaaaaatccaagcgattcaaaaagctgctcgcgaaaacggcgatacatcacgtccagtatggccaatgatcgtcttccgcgctcctaaaggctggactggtcctaagacatgggatggcgtaccaatcgaaaattcattccgtgcacatcaaattccagtgccaattgatagcactgacatgcaacatgccgatgcattagttgattggatgaagtcatatcgtccagaagaattatttacagctgaaggtcaattaaaacctgaaatcgctgcaatggcacctaagggcgacaaacgaatggctgctaacccaattacaaatggtgggattgatcctaaaccacttcgcttgccagattaccgtgactacgctgtggataacacagaacatggtaaagttgttgcgcaagacatgattgttttaggtgaatatgtccgcgatattattaaagacaatgatcaaaacaaaaacttcagaatctttggccctgacgaaacaatgtcaaaccgtttgaaccacatctttgatgtgacaaaccgtcaatggatggaaccaatcaaagaaccaaatgatcaattcatggcaacagaaggccgtgtccttgattcacaattatcagaacatcaagctgaaggctggttagaaggctatgtcttaacaggtcgtcacggcttcttcgcaagttacgaatcattcttgcgcgttgtggattcaatgttaacacaacacttcaagtggttaagaaaagcagacgaacaagcatggcgtaacaagtatccttcattgaacgtgattgcaacttcaactgttttccaacaagatcacaatggttacactcaccaagatccaggtgtcttaacgcacttagctgaaaagaaacctgaattcatccgtgaatacttaccagctgatgccaacacattattggcaacaatgaatactgtcttccaaagccaagaaaaaattaacttagtgattgcttcaaaacacccacgtcaacaatggttctcaattgatgaagcaactgtcttagttaaaaacggcttgaagattattgattgggcaagtacagatcaagatgctgaaccagacgttgtgattgcagctgctgggacagaaccaacacttgaaagtttggctgctatctcaatcttacacaaacaatatcctgacatgaagattcgtttcattaacgttgttgatctattgaaacttcgttcacctaaagtggatcctcgtggcttaacagatgaagaattcgatatgtactttacaaaagacaaaccagttgtcttcgctttccatggtttcgaaggcttagtgcgtgacatcttcttcgatcgtcacaaccataacctccatgttcatggctatcgtgaaaatggtgatatcacaacaccattcgacatgcgtgtcttgaaccaaatggatcgttacaacttatctaaagaagtcgcaattgacgtgcttggtgaccaagccggccaattcgcacaatcaatggatgatatggttgctaaacacaaccaatacattcgtgatgaaggtactgatttacctgaagttgaagaatggcaatggacaccactccgttaa

SEQ ID NO: 175 - DNA, 2364 bp, Pediococcus pentosaceus ATCC 25745
atgacagattattcatcaaaagaatattttgacaagcttgaaaaattttggcgtgctgctaactatctttcagtaggacaattatatttaaaagacaatccgctattaaaacgcgacattaaaccagaagatgtaaaagttcatccaattggacactggggaacaattcctggacaaaactacatctatgctcatttaaaccgtgttatcaacaaatacggtgtaaacatgttttatgttgaaggaccaggtcatggtggccaagttatggtatctaactcataccttgatggttcatacactgaagcatacccagctatcactcaagatgaagaaggtatgaagaaactcttcaaacaattctcatggcccggtggggttgcttcacatgctgctcctgtaacaccaggttcaattcatgaaggtggggaacttggttactcattatcacatggtgttggtgctatcttagataacccagaccaaatcgctgctgttgtagttggtgatggtgaagctgaaacaggtcctttggctgcttcatggcaacataaccgtttcatcaaccctattactgatggtgctgttcttcctattttggatattaacggctataagttaagtaacccttcacttacatcacgtatgtcagatgaagaattaactgaattcttccatggtcaacattgggacccatactttgttgaaggtgatgattcagaagctatggatcctaagatggctgaagtaatggacaaggctatcgaaaagattcaagaaattcaaaagaatgctcgtgaaaaccacgatgaaactatgccatactggccagtaattgtattccgttcacctaagggttggacaggtccaaagacttgggataacaaggttattgaaggtacattccgtgctcatcaaattccaatcccagtagaccaaaagaaccttgaacatgttgatgctttgattgactggatgaagtcatacaagccagaagaactatttgatgaaaatggtcgcgtattacctgaaattgcagaaattgcacctaagggtgaaaaacgtatggcatctaacccaatcacaaacggtggagttaacccaactgacttgaacttgccagattatcgtgactacgctgttgatacaacaaaacgtggacaaaacatcaaacaagatatgttggtatggtcagactacttacgcgatgttataactaagaacccaactaacttcagaatgtttggtcctgatgaaacaatgtcaaaccgtctatatggtttgtttgaagttacaaatcgtcaatttgttgctccaatcaagaaggactgggatgaagcacttgctcctgaaggtcgtattcttgatgctcaactttcagaacattcagctgaaggttggctagaaacatacacattgactggtcgtcatggtatcttcactagttacgaagcattcctacgcgttgtggattcaatgattacacaacacttcaagtggttacgtaaggctgatgaattagattggcgtaatgattatccatcattgaaccttgtatctacatcaactagtttccaacaagatcacaatggttacactcaccaagatccaggtcttttgactcacttggctgaaaagaaaccagaattcattcgtgaatacttgccagctgatgcaaactcattgcttgctattagcccactagttatgaacgatcgtaacaagatcaacttgattattgcttctaagcaacctcgtcctcaattctactcaatggaagaagcagaagttcttgctaagaacggtttgggtattattgactgggcaagcacaactaatggtgaagaaccagacgttgtcttcgctgctgctggtacagaaccaaatatggaaagtttagctgcaatcaacatcttgcatgataacttcccagacttgaagattcgtttcatcaacgttgttgacttattgaaacttcaaagtcctaaggttaaccctaatggtctaagtgatgaagaatttgatcgttactttactaaggacaaaccagttatctttactttccatggtttcgaagacttaattcgttcaatcttctttgaccgtcataaccataacttacacgttcatggttaccgtgaagaaggggacattacaactccattcgacatgcgagttcttaacgaactagatcgtttccacttagcacaagatacaatcaattctattccagaatttgctgaaaagggtgcagacttctctcaacaaatggataacacacttgaacgtcattaccaatacattcgtgataacggtgatgatcttccagaagttactaactggacttggaaagatgttaactaa

SEQ ID NO: 176 - DNA, 2388 bp, Lactobacillus rhamnosus GG
atgagcatggatacaaaagtaaagaccgttgattactcatccaaggaatactttgacaagatgaccgcttattggcgggcagctaactatgtgtcagttgggcagctttatttgaaggacaatcctttgttggaacgaccactgaaaagtgaagatgtgaagccacatccgatcggccactggggaacgattgctgggcaaaacttcatttatacgcacttgaatcgggttattaataagtacgatctcaatatgttctatattgaaggtccgggtcatggtggccaggtcatggtttccaactcctacctcgatggttcgtattcagagatttatccacgggtttctcaggataaagaagggatgaagaacctgttcacccaattttcctggccgggtggtgtggcatcgcatgcgagcgcccagacgccgggctcaattcatgaaggtggggagctaggttatgcgctgagccatgcaaccggggcgattttggataatcctgatgtgattgccgcggttgtcaccggtgatggcgaaacggaaacgggtccgttagccgcatcttggtttagtaataccttcattaatccaatcagcgacggagcaattttaccgatcgtgcatatgaacggcttcaagatttctaacccaacgattctgtctcggaaatcagatgaagatctgaccaagtactttgaaggcatgggttggaagccatactttgttgaaggcgatgacccaaccaagctcaatcctgagatggcaaaagttatggacgctgcgatcgaagaaatcaaagcgattcaaaagcatgcccgtgaaaccggcgatacgacaatgccgcattggccagtgattattttccgctcaccaaagggctggacgggtcctaagagctggaatggcgaaccaatcgaaggctcgttccgtgcgcatcagattccgattccggttgatgctgaagatatggaacatgccgattcgttggctggctggctgaagtcgtaccatccagaagaattattcgatgaaaatggcaagttgattccggaactggccgcgttaccgccaaagggtgacaaacggatggccgctaacccgatcaccaatggcgggcttgatcctaagccattagtattacctgattatcgcaagtatgcactggataataccgagcatggcaagcaaattaagcaggatatgattgtgtggtcagactatctgcgtgatttgatcaagctgaacccgcataatttccggatctttggccctgacgaaaccatgagcaaccggctttacagtctgtttgaagtcaccaaccgccagtggctggaaccaattaaggagccagctgatcaatacatggcaccggctggccggattattgattcgcagctgtcagaacaccaggcggaaggctttaatgaaggctatacgctgactggccggcatggtttgttcacaagctatgaagcattcctgcgcgtggttgattcgatgctcacccagcacttcaagtggattcgtaaggcccatgaggaaccatggcacaaggcttatccaagcttgaacgtggtttcgacttcgacgtccttccaacaggatcacaacggttacacccatcaggatccaggcattttgacccacatggcggagaagaaagccgaatacatccgcgaatatctgccagctgatgcgaatagtttattggccatttcaccaaaactattcagctcacaaaacacggttaatgtgctgattacttccaagcagccgcggccacagttctacagtattgatgaagcaactgttttggccaatgctggcttgaaacggattgattgggcttccaatgatgatggtgttgagccggatgttgtcattgctgctgccgggaccgagccaaacatggaaagccttgctgcaatcaacttgttgcatgacgccttcccagacttaaagattcgcttcattaacgtgcttgatcttttgaagctgcgcagtccagaaatcgatccgcgtgggttgagtgatgctgaattcaacagttacttcacgacggataagccggttctgtttgcctatcatggctttgaaggcttgatccgtgacatcttctttacccgtcagaatcgtaacgtcctgattcacggttatcgtgaagaaggcgatatcacaacgccatttgatatgcgggttctaaacgaacttgatcggttccacttggccaaggatatcattcagcatgtaccggcatatgctgaaaaagcggctgcctttgttcagaagatggatgatacgttgcaatatcaccacgacttcattcgggcaaacggcgaagatattcctgaagttcaggagtggacttggaagtcaattaagtaa

SEQ ID NO: 177 - DNA, 2412 bp, Lactobacillus brevis subsp. gravesensis ATCC 27305
atggcaaattctacagatagtaaccaagctttaaaagaaagagaaaccgattattcctcaaaagactactttaatttaatgaccaagtattggagagctgccaattacatctctgttggtcaattgtacttaaaggacaatcctttattaaaacgcccactgacaaaagcggatgttaagtttcacccgattggccactggggtacaattgccggtcaaaactttatttacacacatttaaaccgtgttatcaagaagtacggtctggacatgttctatattgaagggtcaggtcacggcggccaggtcatggtctccaattcctatcttgatggcagttatacagatatttatccaaatattacccaagatgaaaagggattgcaacgtttgttcaaacgcttctcatttccaggtggtgttgcctctcacgcggacgctaagacgccaggctccattcatgaaggcggtgaattaggttattcactgtcacatggtgtcggtgccatttttgataatccaaatgtcattgctgccgttgaaattggtgatggtgaagctgaaaccggcccccttgcaacttcctggttctcaaatgtcttcattaacccggttaatgatggtgccgtcttacccattttaaacttaaatgggttcaagattgccaacccaactatcctctctcgtaaatcagatgaagaattaaccaagtactttgaaggtatgggctgggaaccgacttttgttgaaggtgacgatgccggcaagttaaatccggttatggctaaagccatggattcatctatcgaaaagatccatgctattcaaaatcaggctcgtgaaagttctgcagatgatgcaacgcgtcctgtatggccaatgatcattttacgtgcaccaaagggttggactggtcctaagatgtgggacggcaagccaattgagggctcattccgtgcccaccagattccaattcccgttgattcggaacatatggaacacgctgacgctttggtagaatggttaaagtcatataagcctgaagaactgttcgataaaaatggtgctttaaaaccggaaattaaggccacagttcccgttggtcattctcgaatggctgccaatccaattactaatggtggtaaggatcaaaaacagcttgacctgcccgactggcgtaattatgcattggacaattcaaagcgcggtgccggtgaagaacgtcaagacatggttgaattaggcaaattcttccgtgatgttatcaagaataaccctaagaactttcgtctgtttggtcctgatgaaactgcttcaaaccaattgcaggaagcctttgcggttaccaaccgtcaatggatggaaccaattcacaatccatatgatcagtggatgaaggcagacggccgtatcattgactctcaactttccgaacaccaagacgaaggctggttggaaggctacaccttaaccggtcgacacggtgtcttcacgagttacgaagctttcttaagagttgttgattcaatgttgacgcaatacttcaagtggattcgcgaagctaatgaacaaccttggcgtcaaaaatatccatcattgaacatcatttcgtcatcaacatcgttccagcaggatcataatggttattcgcaccaggatccgggtattttaactcatttagccgaaaagaagcctcgctatattcgtgaattcttgccggccgatgcaaattcactgcttgccgttatgcacaaagcattgaatatgaagcaaacattgaatgtgacaattgcttccaaacatccacgtccacaattttactcagtccaagaagctgaacaattagtagatcaagggttgaaagtcattgattgggcaagcaccaccaagcccggtgaagaaccagatattgtgatggctgctgcaggaaccgaaccaaaccttgaaagcttggctgcaattgacattttgcatcaacaattccctgatttgaagattcgctttattaatgttgttgacttgcttaagctgcattcaccgcaatttgacccacgtggtcttagcgatgaagaatttgacaattactttactaaagataagccgattgtctttgcattccatggctatgaagatttgatcgaaagcctattcttcaatcgtcataatcacaatttacacgttcatggttatcgtgaagatggtgatattaccaccccatttgatatgcgtgtattgaaccacttggatcgattccacttggctaaggaagttgcggaagatgtttacggtgataagtcttccgaattcacttcgcacatggatgacaaattacagcaacatcatgactacattcgtgaaaccggagctgatttacctgaaatcagaaattgggaatggaaatcacttaaataa

SEQ ID NO: 178 - DNA, 2361 bp, Lactobacillus salivarius ATCC 11741
atgacagattattcatcccaagaatacttagataaattagatgcttattggcgtgctgctaactatgtttcagttggtcaattatacttaaaagataatcctttacttcgtcgtcctttaaaggcagaagacgttaaggttaaaccaattggtcactggggaactatcgctggccaaaacttcatttatgcccatttgaaccgtgtcatcaacaaatatgacttgaatatgttctatgttgaaggccctggtcatggtggtcaagttatggtttctaactcatatcttgatggttcttactctgaaatttatcctgaaatttctcaagatgaacaaggtatgaagcgtctatttaaacgtttctccttcccaggtggtgtagcttctcatgctgctcctgaaacaccaggttctattcatgaaggtggcgaattaggttactctatttctcactctgttggtgcagttttagataatcctgatttgattgttgctgcagttgtcggtgatggtgaagctgaaactggtccattagctgcttcatggcaatctaataaatttatcaaccctattcatgatggtgctgtcctaccaattttagatcttaacggatttaagatttctaaccctactatcctttctcgtgaaagcgatgaaactttgactaagtactttgaaggtatgggttggcatccaatctttgttgaaggcgatgatcctaagttgatgcatcctgcaatggctaaagcaatggatgaagcaattgaagaaatcaaggctattcaaaagaatgctcgtgaaaataacgatcctagtcttccagcatggcctgttattatctttcgtgctcctaaaggttggactggtcctaaagaatgggatggcgaaccaattgaaaaatcattccgtgcccatcaaattccaattcctgttgaccaaaatgatatgcaacatgctgatgctttggttgactggcttgaaagttataaacctgaagaattattcgatgaaaatggtaagttgaaagctgaaattgctgaaatcacacctaagggcgacaaacgtatggctgctaaccctcacacgaaccctggtaaattaatcagagaagttatcaagcctgatttccgtgatttcgccgttgatacatctgttccaggtaaagaagttgctcaagatatgactgttttaggtaaataccttgaaaaagtactttctgataaccgtcataactatcgtgtctttggtcctgacgaaacaatgtctaaccgtttggcacctatctttgacgtaactaagcgtcaatggttagctgaaattaaggaacctaacgatcaatacttagctccatcaggtcaagttattgattctcaattatcagaacaccaagctgaaggtttcttagaaggatatgttttgactggtcgtcatggtttctttgcaagttatgaatcattcttgcgtgtagttgactctatgttgacacaacacttcaagtggttacgtaaagcaactgaacaaccttggcgtacatcaattccatcattgaatgttattgctacatctactgtattccaacaagatcacaatggttacacacaccaagatcctggtattttaggtcacttagctgataagaaacctgaatatattcgtgaatacttacctgcagatgctaactcattattggctgtattcgacaagactattaatgatcgcgataagattaacttgattgttgcttctaagcacccacgtcaacaattctactcagctgcagaagctaaggaattagttgataaaggtttgaagattattgattgggcttcaactgataagaatgctgaaccagatgtagttatcgctgctgctggtacagaaccaaacttagaagcattagctgcaatttctatcttgcatgaaaaattacctgacttgaagattcgcttcatcaatgttgttgatatcttgaagttacgtagtcctaaggtagatcctcgtggcttaagcgatgatgaatttgatgcttactttacaaaagacaagccagttatctttgctttccatggttatgaaggcctattacgtgacatcttctactaccgtcacaatcataacgttgctttccacggctatcgtgaaaatggtgatatcacaactccattcgatatgcgtgtactaagccaaatggatcgcttcgatcttgtaaaatctgttgcactttctcttccagatgctgacaagtatggtcaacttgttgctgaaatggatgctaaagttgctaagcatcatcaatacattcgtgatgaaggtactgatttaccagaagttgaaaactgggaatggaagcctcttgattaa

SEQ ID NO: 179 - DNA, 2370 bp, Lactobacillus ruminis ATCC 25644
atggccaaagattactcatcaaaagaatatttcgcaaaacttgatgcttactggcgcgctgccaactatatttcggtggggcagctttatttgaaagacaatccgttgctgagacgtccgcttgaatcatccgacgtcaaggcaaagccgatcggacactggggcacaattgccggacaaaatttcatctatgcacaccttaaccgcgtcatcaacaaatatgacctgaacatgctttacatcgaaggtcctggtcacggcggacaagtaatggtttcaaattcctaccttgacggaagctatactgaaatctaccctgaaatcactgaagatgaagaaggcatgaagaagctcttcaagcgtttctcgttccctggcggcgttgcttctcacgctgctccagagacgccgggatccattcatgaaggcggggaactcggatattcgctttcacacgctacgggcgccatccttgacaaccccgatttgattgcagcagccgtcgtcggtgacggtgaagcagaaaccggcccgttggcaacttcctggcagtcaaacaagttcattaatccgattcatgacggggccgttttgccgattcttgatctgaacggcttcaagatttcgaacccgacgatcctttcgcgcgaatcaaacgaaacgctgacgaagtacttcgaaggtctcggatggcatccgatcatcgttgaaggagaagaccctgaaaaactccatccggaacttgcccgggcaatggacgaagcaatcgaagaaatcaaggcgatccaaaagcatgcaagagaaaccggtgatgattcgctgccgacatggccaatgatcatcttccgtgcgccaaagggctggacgggcccgaaggaatgggacggcaagccgatcgaaggctcattcagagctcaccagattccgattccggttgaccaaaacgacatggaacatgccgacaaactggtcgcttggctcaagagctaccgtccggaagaattatttgacgaaagcggcaagctgaagcctgaatttgccgaaatcgctccaaaaggcgacaagcgcatggcggccaacccgcacacgaaccccggcaacctgattcgcgaccttatcctgcctgacttcagagaatttgctttggaaaatgcagagcacggaaagactgtcgctcaagacatgaccgttcttggcaaatacctcgaacgcgtaatcgagcttaacgccaaaaatcgcaacttcagaatttttggacctgacgaaacaatgtctaaccgcctggcaccgatttttgacgaaaccaaacgtcaatggatgcaagatatcaaagaaccaaatgacgaatttttggcacattctggtcgcatcattgattcgcagctgtccgaacaccaggatgaaggtttccttgaaggctacgtcttgaccggtcgccacggtttcttcgcatcgtatgaagcttttctgcgcgttgtcgattcaatgctgacgcagcatttcaaatggctcagaaaagcaaaggaacagccttggcgcagcgaaattccttcactcaacgtcgtttcgacgtcaaccgtgttccaacaggatcacaacggctatacgcaccaggatcctggaattttgggtcacttggcagataaaaagcccgaatttatccgcgaatatttgccggccgatgccaataccttgctcgcggtttttgacaaagtcctgaacgatcgcgaaaaaatcaatctgatcgtttcttccaagcatccgcgtccgcaattctatacggccgctgaagccaaagaacttgttgacaagggtctcaaaatcatcgattgggcttcgacggatcacaatgctgaacctgacgtcgtcattgctgcttgcggaaccgaaccgaaccttgaatcattggctgccgtttcgattctgcacgaaaagctgcctgatttgaagattcgtttcatcaacatcgtcgatctgctcaaattacgatcgccaaaacatgatcctcgcggtttgagcgacgaagaatttgatgccttcttcacgaaggataagccgattctctttgccttccacggctatgaaggtctcgttcgcgacctgttcttcgatcgtcacaaccacaacgtcatgattcacggctaccgcgaaaacggcgacatcacgacaccgtttgacatgcgcgttttaaatcagatggatcgtttcgatcttgtcaaagacgttgtcttgaatctgccggatgctgacaaatatggtcagatcgcggctgagatggacagcatcattgccaaacacaatcaatatatcagagacgagggcgcagatcttccggaagtcgaaaactggacatggaaaccccttgaataa

SEQ ID NO: 180 - DNA, 2385 bp, Bacillus coagulans 36D1
atggaaatggcagcttcgcaagtcgcttattcctcccctgcttatctgaaaaatttagatgtatactggcgtgcagccaactatatttcggttggccagctttatttaaaagacaatccgttattaaaagaacccgtaaagccttctgatctgaaagcaaaaccgatcgggcactgggggacgatttcagggcagaactttatttacgcccatctgaaccgagtgatcaacaaatacgatttaaatatgttttatattgaagggccggggcacggcggccaggtgatggtatccaattcttatcttgacggcagttatactgaaatttatccgaatgtaacacaggacatagaagggatgaagagactgtttaaacagttttcattcccgggcggcattgcttcccacgcggcaccggaaacgccgggatcgatccatgaaggcggcgaactgggctattccctttcacacggcaccggcgccattttggaccagcccgatttaatggccgctgttgtcgtcggcgacggggaagcggaaaccgggccgcttgccacttcctggttgtccaaccggttcatcaacccggtaacggacggcgccgttctgccaattttgcttttaaacggttttaaaatcagcaatccgaccatgctctcccgtatgtctgatgaacaactggcgctttattttgaagggatcggctggcggccgtatttcgttgaaggagaagacccggaagaaatgcaccgcgatatggcgtatgtaatggaccaaatgatcgaacagatccaagccatccagtcacatgcccggaaaaccggtgacaccacccgccccgcttggccaatgcttgttttccgtgcgccaaaagggtggaccggccctaaggaatgggacgagaagccggttgaacattcattccgcgcccaccagattccggtgccggtcgaccaggaccatatggaacatctcgatgttttaatcaactggatgaaaagttacaggccggaagaattattcaatgaaaacgggcggctgagaccggaaattgccaagatcgccccgaaaggcagcaaacgaatggcgatgaatcctgccaccaatgccggcttccatatcaaagaccttgatctgccggatttccgcgattatgcgctggacaacaaggaacatggaaaacagatggcgcaggatatgaccgttttagggacatatttaaaagacgtgattttaaaaaatgaagccaaacgcaacttccggattttcggcccggatgaaacgatgtcgaaccgcctggcgccagtatttgaggccacaaagcggcaatgggtgggaaaaatcaaagaaccgaatgatgaatttttggcaccggacggccgtgtcattgactcgcaactgtctgagcaccaggcggaaggatttttggaaggctatgttttaaccggccgccacggtttctttgcaagttacgaagcgttcctgcgtgtcgtcgattcgatgatcacccagcatttcaaatggctgcggaaagcagcagaacaaaagtggcgtgcggatatcccgtcattgaatgtggtcgccacttccactgtattccaacaagatcataacggctatacccatcaggatccgggtattcttggccacctggctgataaaaaaccggaatttatccgggaatatttgccggccgatgccaatacgctgctcgctgtatttgacaaaatcctgaacgaccgtgggaaaatcaatctgattgtttcgtccaaacacccacgcccgcaatggtttaccgttgaagaagcggaagagctggcagaccgcggactgaaaatcattgactgggcaagcacggacgaaggcggcaatccggatattgtcattgccgcatgcgggacagaaccgttgcttgaaagcctcgctgctgtttcgattttgcacgaaaaactgccgaaattgaagattcgcatgatcaatgtgctcgatattttgaaattaagaagcccggcattggatccgcgcggcctttcggatgaagcgttcgacgcctattttacaaaggacaaaccggttgtttttgccttccacggttacgaaggcctgatcaaagacttgttttttgaccgtgcaaaccacaatctgcatgtgcacggctaccgtgaaaacggggatatcacaacgccgtttgacatgcgcgtgatgaaccagatggatcggtttgaccttgtaaaagaagtggtgtcaagcctgcctgatacagcccggcacgcagccctcatcagcgaaatggacagcatgctgcaaaaacatcatgcgtacatccgcgaagaaggcacagatctgccggaaatcgaaaactggcagtggcaagcgataaaataa

SEQ ID NO: 181 - DNA, 2376 bp, Kingella oralis ATCC 51147
atgcaaaacacgcaatttgacactcccgaataccttgccaaagtagatgcttggtggcgcgctgccaactacatttccgccgcgcaaatgtatttaaaagacaacccattgctcaaaaaaccgctcactgccaacgatgttaaagcgcaccccattgggcattggggaacggtaccggggcaaaatttcatctatgcccacttaaaccgcgccatcaacaaatacgatgtagatatgttctacattgaagggccagggcatggcgggcaagtgatggtgtccaattcctatcttgaccacagctacaccgacatctatcccgaaatcacgcaagacgaagcagggctgaaaaagctgtgcaaaattttctcattccctggcggcatcgcttcgcacgccgcgcctgaaacccctggttctatccacgagggcggcgaattgggctacgccttgtcgcacgcatttggcgcggtgttggataaccccaacatcatcgccgctgccgtgattggcgatggcgaagcggaaactggacctttgtgcgcaggctggtttggcaacacctttatcaaccctgtaaacgatggcgcagtattgccgattttgtatttaaacggcggcaaaatccacaaccccaccattttggcgcgtaaaaccgatgccgaattaacccaatatttcaacggcatgggctgggagccgatttttgtggaagtgagcgaccccgcccatagccacgccatcatggcgcaaaaattagacgaagccgttgaacgcattttggcgatttggcaagatgcacgcagccgcagcgcaaacgatgccaccatgccccgttggcccgtgttggtggcacgcattcccaaaggctggactgggccgaaaacatggaacggcgagccgattgaaggcggtttccgcgcccaccaagtgccgattcccaccaattcacacgatatgagcaccgccgatgcgctggaagcatggctgcgcagctatcgccccgaagaattgtttgacgacaacggccgctttttagacaaatggcgcgaaatttcgcccaaaggcgcaaaacggatgtcggtgcacccgattaccaatggtggcgttgcgcccaaggctttggtgatgcccgattggacgaaacacgcgctaaaaattggcactcctggtagccaagatgcgcaagatatgattgagtgcggacgcttgatggcggatgtgattaccgccaaccccgataatttccgcatctttggcccagacgaaaccaaatccaaccgcttgaacgaagtgtttaaagtaaccaaccgtcaatggctgggcgtgcgcgatgcggcgtatgacgaatggattgcgcctgttgggcgtgtgattgattcgcagctgtctgaacaccaagccgagggctttttggaaggctacgttttaacggggcggcatggcttttttgccagctacgaatcgttcttgcgcgtggtagattctatgattacccagcatttcaaatggttgcgcaaatgcaaaacccacgcgccttggcgcaaggattatccatcgctgaacttgattgccacttccaccgtgttccagcaagaccacaatggctacacccaccaagaccccggcttgctcacccatttggcagagaaaaagcccgaatttgtgcgcgaatatttgcccgccgatgccaacacgctgttggcggtgatgagtgaagccttaacttcgcgcgaccgcatcaatttaatcgtgtcgtctaaacacttgcgcccgcagttttacagcgcggacgaagccaaagaattggtgcgcgagggctacaaaatcatcgaatgggcatccacttgccacgatggcgagcctgatgtggtgattgcggcggcgggcacagagccaaacatggaagcgttggcggcgattaacgtgttgcacaaacactatcccgaaatgaaaatccgctttatcaacgtggtggacattttgaaactgcgccaccccagcatagacccgcgcggtttgagcgatgaggcgtttgacgcgctgtttacgcgcgacaaacccgttgtattctgcttccacggctatgaaaacatggtgcgcgacattttcttcccgcgccacaaccgcaatgtgcgcattcacggctaccgcgaaaacggcgacatcaccacgccgtttgatatgcgcgtgttgtcggaaatggaccgattccacgttgccaaggatgccgcgcaagccgtttacggcgaaaaagcagcggattttgccaacaaaatggatgaaaccatccagttccaccgcagctatatccgcgaacacggcaaggatattcccgaagtggcggaatggaaatggcagccgttggctaaataa

SEQ ID NO: 182 - DNA, 2370 bp, Granulicatella adiacens ATCC 49175
atgacacaatttgatacaccagaatacttagcaaaggtggatgcttggtggcgtgcagcgaactacatttcagtagctcaaatgtacttaaaagataacccacttttacgtcgtccaatccaaaaagaagacgttaaacttcatccaatcggacactggggaacaatcgcaggacaaaactttatttatgcgcacttaaaccgtgctattaataaatatgatttagatatgttctacattgaaggaccaggtcacggtggacaagtaatggtttctaactcttacttagatggatcttacacagagttatacccacaaatcactcaagatgaagcagggttcaaacaattatgtaaaatcttctcattccctggaggaattgcgtctcacgcggctccagaaactcctggttcaattcacgaaggtggagaattaggttactcattatcacatgctacaggtgctgttttagataatcctaacgtaattgcagcagcagttattggtgacggagaagcagaaacgggtcctttagcagctggttggttctcaaacacatttatcaacccagtaaacgatggtgcagttttaccaatcctttacttaaacggtggtaaaatccacaacccaactattttagctcgtcgtacggatgaagagttaacacaattcttcaatggtttaggatgggatccaatcttcgtagaaggaacagatcctgaaaaagttcacccattaatggctgctaaattagatgaagctattgaaaaaattcaagcgattcaaaaagaagctcgtgctaagagcgccgaagaagctacaatgcctcattggccagtattagtagtacgtactcctaaaggttggacaggtccaaaagaatggaaccatgaaccaatcgaaggtggattccgtgctcaccaagttccaatcccagtatctggagaagctatggaacatgtcgatgcattagtggactggttgaaatcataccgtccagaagaattattcgatgaaaatggtaaattagtagaagaaattgctgcaatttctcctaaaggcccacgtcgtatgagcatgaacccaatcactaacgcaggggttgtaaaaccaatggaaattactgattggactaaacatgccatcgatacatctaaaccaggtgctatccaaaaacaagatatgattgaatttggtaaatttgctgctgacttagttaaagcaaacccagataacttccgtatctttggaccagacgaaactaaatctaaccgtttaaacgaagtcttcaaagcaacgaaccgtcaatgggttggtcgtcgtgacgaaagctacgatgaatggatttcaccagttggtcgtgttatcgactcacaattatcagaacaccaagctgaaggattcttagaaggttatgtattaacaggtcgtcacggattcttcgcatcttacgaatcattcttacgtgtagttgactcaatgattactcaacacttcaaatggttacgtaaagctaaaactcacgctccatggcgtaaaaactatccatcattaaacttgattgcaacatcaacagtgttccaacaagaccacaatggatatactcaccaagatccaggtttattaacacacttagctgagaaaaaacctgaattcgttcgtgaatacttaccagcggatacaaacagtttaatggctgttatggctgaagctttaagttcagaagataaaattaacttaatcgtttcttcaaaacacccacgtccacaattctactcagtagaagaagctaaagaattagtgagcgaaggttacaaagtaattgattgggcttcaacagtgaaagaaggagaagaaccagacgtagtaattgctgctgcaggtactgaacctaacttagaagcattagcaggtatttcaatcttgcacaaacaattcccagaattgaagattcgcttcattaacgtagtagatatcttgaaattacgttctccaaaagtggatccacgtggtttatctgacgaagaatttgataaattatttactactgataaaccagttgtattctgcttccacggttatgaaggtatgattcgtgatttattcttcgatcgcaacaatcataatgttcatatccacggataccgtgaaaacggagatatcacaactccattcgatatgcgtgtattatctgaaatggaccgcttccacgttgctaaagacgctgcagttgctgtatatggcgaaaaagctagcgaatttgctgcgaaaatggacgaaactgtggaattccaccacagctacatccgtgaacatggggaagatattcctgaagttgtgagctggcaatgggaaaatgtgaataaataa

SEQ ID NO: 183 - DNA, 2385 bp, Streptococcus gordonii str. Challis substr. CH1
atgacaacagattataattctaaggcttatttagaaaaagttgatgcttggtggcgtgctgctaactatatttcagcggctcaaatgtacctaaaagacaatccgcttttgaaacgcgatgtggtagctaatgatctaaaagctcacccaatcggacactggggaactgttccagggcaaaacttcatctacgctcatttgaaccggacgattaataaatatgacctagatatgttctacattgaaggacctggtcatggtggtcaggtaatggtttcaaactcatacctcgacggctcatatacagagttaaatccaaatattcctcaaaacgaagaaggcttcaaacatttgtgcaagatcttctcattcccaggggggatcgcttctcacgcggcacccgaaacaccaggttctatccatgaaggtggagaactcggttatgccctatctcatgcagcaggagctatcttggataatccagatgtgattgcagcaactgttatcggtgatggtgaaggggaaactggtccattgatggcaggttggttgtcaaatacttttatcaaccctgttaatgacggtgctattcttccaattttctatcttaacggtggtaaaattcacaacccaactatctttgaacgtaaaacagacgaagaattgaccttgttctttgaaggtttaggttggaagcctatttttgctgatgtaacagctatttcagaaaatcatgaagctgctcatgctctttttgcggctaaattggacgaagcaatcgaagaaattaagaaagtccaagctgaagctcgtaaaggatcagctgaagaagcaactcaagctattttcccagtattggttgcccgcattccaaaaggatggactggtcctaagtcatgggaaggtactccaatcgaaggtggtttccgtgctcaccaagtgccaattccagtagatgctcaccatatggagcatgttgatgcccttcttaattggttgaaatcttaccgtccagaagaattgtttgatgagtctggaaaagtcttgcctgaaatcgctgcgattggaccgaaaggtgaccgccgtatggctatgaacccaatcactaatgctggtgttatcaaaccaatggacactgctgattggaagaaacacgcccttaagtttggaactccaggtgagatcgtggctcaagacatgattgagtttggtaagtacgctactgacttggtagatgctaacccagataacttccgcatctttggcccagacgaaacaaaatcaaaccgtctgcaagaagttttcactcgtactagccgtcaatggttgggccgtatgagacctgaatacgatgaagctttgagcccagcaggtcgtgttattgactcacaattgtcagagcaccaggctgaaggtatgttagaaggttacgtcttgactggtcgtcatggcttcttcgcatcttacgaatcattccttcgtgtagtagattcaatggtgacacaacacttcaaatggttgcgtaaatgtaagactcatactacatggcgtaagaactacccagccttgaacttgattgcaacttcaacagtcttccaacaagaccataatggatatactcaccaagatccaggtatcttgactcacttggcagagaaaactccagagtttatccgcgaatacttgcctgcagatacaaacagcttattggctgttatggataaagccttcaaggcagaagacaaggttaacttgattgttacttcaaaacacccacgtccgcaattctactcagctgaagaagcagaagaattggtgcgtgaaggttacaaggttatcgactgggcttcaactgtgtctaacaatgaggagcctgatgttgtttttgcagcagcgggaactgagccaaacttagaagctcttgctgcagtatctattctccacaaggccttcccggagcttaagattcgctttgttaacgtggttgatatcttgaaattacgtcacccatctgtagatgcgcgtggactttcagacgaagaattcgaccaagtcttcacaacagataagccagtcatctttgcattccatggttatgaaggaatgattcgtgacatcttcttcaaccgtcacaaccacaaccttcgtgttcacggttaccgtgaaaatggagatatcacaactccgtttgatatgcgtgttatgtcagaattggatcgcttccacttggctcaagatgcagcaaatgcagcacttggtgaagatgcagctgtcttctctgctaaaatggatgagacggtggcttaccacaatgcttacatccgtgaaaatggtgatgatatcccagaagttcaaaactggaaatgggaaaacattaataaataa

SEQ ID NO: 184 - DNA, 2379 bp, Streptococcus agalactiae NEM316
atgtcagaatttgatacaaaatcatatttagaaaaacttgatgcatggtggagagcagctaattatatttctgcagcacaaatgtatctaaaggataatcctctcttgagacgagagctagttgaaaacgacttaaaggttcatccaattggtcactggggcactgtacctggacaaaactttatctatgctcacttaaatcgcgctattaataaatacgatttagacatgttctatattgaaggtccaggtcatggtggtcaagttatggtatctaattcatatttagatggttcatatactgaattaaacccaaatattgagcaaacagaggatggctttaagcagttatgtaaaatcttctctttcccaggtggaattgcatcccatgcagcaccagaaacaccagggtcaattcatgaaggtggtgaacttggttacgcactttctcatgcgacaggtgccatcctagacaatccagatgttattgctgcgactgttattggtgatggtgaaggtgaaacaggaccacttatggctggttggctatctaatacctttatcaatccagtaaatgatggtgctgttctaccaatcttctatttaaatggtggtaaaatccataacccaactatctttgaacgtaagacagatgaagaattatctcagttttttgaaggattaggttggaaacctatttttgcagatgttgttgaactctctgaggatcatgcggctgctcatgctttgtttgcagaaaaattagatcaagctattcaagagattaaaaccattcaatcagaagcacgacaaaaaccagcagaagaagctatccaagcaaaattccctgtcttggttgcacgtattcctaaggggtggactggtccaaaagcttgggaaggaacaccaattgaaggtggcttccgcgctcaccaagtaccaattccagtagatgcccaccatatggaacatgtcgattctcttttgtcatggcttcaatcataccgtccagaagaattatttgatgaaagtggtaaaatcgttgatgagattgctgctatttcaccaaaaggtgatcgtcgcatgtccatgaatccaataaccaatgctggtattgttaaagcaatggatacagcagattggaagaaatttgctcttgatattaatgttccaggtcaaattatggcacaagatatgattgaatttggaaaatatgcagcagatttggtagatgctaatccagataatttccgtatttttggtccagatgaaacgaaatcaaatcgtcttcaagaagtgtttacacgtactagccgtcaatggcttggtcgtcgtaaaccagattatgacgaagctttaagtccagctggacgtgttattgattcccaattgtctgaacatcaagcagaaggtttcttagaaggttatgttttaactggtcgtcacggcttctttgcttcatacgaatcattccttcgcgttgtagattcaatggtaacacaacatttcaaatggttacgtaaatcaaaaacacacacaacatggcgtaaaaattatccagcgcttaacttaattgcagcttcaactgttttccaacaagatcataatggttacactcaccaagatccaggtatcttaactcacttagctgaaaaaacacctgaatacattcgtgaatatttaccagcagatactaactcacttctagctgttatggataaagcgtttaaagctgaagataaaattaatttaattgtgacatctaagcaccctcgtccacaattttactctattgctgaagcagaagagttagtggcagaaggatataaggtgattgactgggcttcaaatgtgtcgcttaatcaagagccagatgttgtctttgctgcggcgggaacagaacctaacttagaagctttggcagctattagtattcttcataaggctttcccagaacttaagattagatttgttaatgtattagacatcctaaaacttcgtcatccttcacaagatgctcgcggtttatcagatgaagagtttgacaaagtctttaccacagataaacctgttatttttgctttccatagttatgaagatatgattcgagatattttctttagtcgtcacaatcataatttgcatacgcatggttaccgtgaaaatggtgatatcacaacaccatttgatatgcgcgtgatgtcagaattggaccgattccatctggcacaggatgcagctcttgcttctttaggaaatgaagcacaagccttcagtgatgaaatgaatcaaatggttgcttatcacaaagactatattcgtgaacacggagacgatattccagaagtgcaaaattggaaatgggaaaatatcaagtag

SEQ ID NO: 185 - DNA, 2376 bp, Listeria grayi DSM 20601
atgactgattattcatctccaaattatttagcaaaggttgatgcgtggtggcgggcagcagattttatttctgtcggacaattgtatttgaaaggaaatccattgcttcgtagaccacttgaaaaagaagatctcaaagttcatccaattggccattggggcacgatctccggtcaaaatttcatttatgcgcatttaaatcgtgttatcaataagtatgatctgaatatgttttacattgaagggccaggtcacggcggtcaagtaatggtatccaattcttatctggatggcagctatacggatacttatccaacgatcacacaagatgaagttggtctgacaaaattgtataaacaattttctttccccggcggcattgcttctcatgctgctcctgaaacacctggttcccttcacgaaggtggcgaactcggctacgcgctctctcatgctactggctcgatcttagacaaccctgacgtgatcgctgctacagtaattggcgatggcgaagcggaaacgggtccattatccgcaggctggttctccaatacctttatcaatccagttaacgacggcgccgtccttccgatcttatatttaaacggagcaaaaatctccaatccgacgatcctctcccgcaaaacggataaagaacttacctcctttttccaaggattgggctgggacccgattttcgttgaaggagaagatcctgcgaaagttcacccgcttatggcagaaaaactagatcaggccatcgagaaaatcaaagccatccaaacagaagcacgcaaagaagccgcagataaagcaacaatgccaacatggccagtgattctcttccggacaccaaaaggctggacaggtcccaaagaatggaataacgaaccaattgaaggaagcttccgcgcccaccaagttccgatcccagttgatcagcatcattttgatcatgtcgacgcattggaaaactggctgcagtcttatcgccctgaagaactgttcacagaagaaggctcgttaaaagaagaaatcaaatcccttgcaccaaaaaaccgcatggctacgaatccgatcacgaatggcggaatcgatccgcaaccactgcgcttacctagttggaaagattatgctgttgagactgcaaataaagacgtcattacccaagatatgattgaactcggtggtttcgttcgcgatatcgtcaaggaaaaccctgataacttccgtattttcggaccagatgaaacaaaatcaaaccgtttgaataaagtctttgaagtgaccaaccgccaatggatgagcaaagcagaattcccacgtgacgaatggttggcaccagctggccgcatcatcgatgggcagctttccgaacaccaagcagaaggctttttggaaggatacgtcctcactggtagacatggctttttcgccagctatgaatccttcctacgcgttgtcgattccatgctgacccagcatttcaaatggcttcgcaaagcaaaagaacaaacatggcggaacagttacccatcgctgaatgtgatcgcgacatcgactgttttccaacaagatcataatggctatacacatcaagatccaggtgttttaacacatctagcagagaaaaagccggaatttatccgcgaatatctgccagctgatacgaactcgctgctagcagtcatgaacgaagcttttcgttcagaagagctgatcaacttgatcgtgtcttctaaacatccgcgtccgcaattctattctgctgaagaagcagaaatactagtgaaggacggcttgaaaatcatcgactgggcctccacagtaagcgaagccgaagagccagatgtcgtcattgcttctgccggtacagagccaaacttagaagcacttgcagcggtcacacttttaaatgaagccttcccttcgttgaagatccgctttatcaatattgtcgacattttgaaattacgccatccggatattgatccgcgcggcttgacggatgaagaattcgatcgttattttacaaccgataaaccgatcattttcgccttccacagctatgaaggcatggttcgcgacatcttcttcaaccgtcacaaccataacttgttcattcacggctaccgcgaaaacggcgatatcaccacaccattcgacatgcgtgtccttagcgaaatggatcgcttccaccttgcgaaagatgctgcagaggcggtttatggcgagatcgcaacatctttcgccgctgaaatggacgctgttttaagcaaacatcatcactttatccgcgaaaatggcgaagatctaccagaggtggaaaattggaaatggcaagcattgaagacagatttattggaagtataa

SEQ ID NO: 186 - DNA, 2367 bp, Enterococcus casseliflavus EC30
atgaagacaacctacgatacaccagagtattatcagaaaatgaacgcttggtggcgagcagccaactacctttccgttggtcagatttatttgaaagacaatcccttattgcgccgccccatcgaagaaaaagatttgaaagtgaatccgattggtcactggggaacgattgcagggcaaaattttatttacacccatctcaatcgcgtcatcaataagtacgacttaaacatgttttatatcgaaggaccaggccatggcggacaagtcatggttgcgaatgcttatttagacggcagctacagcgagatctatccaaaagccacccaagacgaagcaggaatgaaacatctattcaaaaccttctctttcccaggtgggatcgcttctcatgcggcacctgaaacgccaggttcgatccatgaaggcggcgagctaggctattccatcgcccacgctaccggagctattttagacaatcccgatgtcattgcagcagtagtggtcggtgatggcgaagccgaaactggaccattagcgggcagctggttttcaaatacctttattaatccagtcaatgatggcgcaattttgcctatcttgcatttgaatggcgccaagattgccaatccaacgattttggctcgtaaaagtgaccaagatctcacgaaatattttgaaggcatgggttggaccccttatttcgtagaaggggacgatccagaagccgttcatccgcaattggcacagaaaatggatcaagccatcgaacagatccacgcgatccaagcagaagcccgcaaaggttctgcggaagaagccgctatgcctcattggcctgttttgatcgttcgcacaccgaaaggctggactggaccgaaagtctgggatggcgagccgattgaagggggcttccgtgcccaccaagtgccgatccctgtcaatgcgaaacatatggaacacgtggatgctttgacggattggctgcagtcttatcgtccagaagagctttttgacgaaaacggccgcatcaaagctgagattcaagaattggcaccaaaaggagagcagcggatggcggtcaacccaatcaccaatggggggatcgatccgcaaccgctacgcttgccagattggcaagcacatgccattgcgatcgagacaccaggggaaacgactgcccaagacatgatggtctttgggaaatttgctcgtgacatcatcaaagaaaatcctgacaacttccgcatttttggcccagatgaagccaaatctaatcggttgaaccatgtgtttgaagtcacggaccgccaatggttggagccaaaacatcctgattatgatgaatggctgtcttcagtgggccgtgtgattgattcacaattatcagagcatcaagcagaaggcttcttggaaggctatgtgctgacgggtcgtcatggcttctttgccagctacgagtcattcttaagagtcgttgattctatgatcacgcaacacttcaaatggttacgaaaagcccatgatcttgactggcgcaacccgtacccctcattgaatttgatcgcttcatcaacggtcttccaacaagaccataatgggtacacccaccaagatccagggatcatgacccatattgcagagaaaaaagccgactttgtgcgggtctacttaccagccgatgccaatagcttgatggctgtcatggcagaaacgctcgcttctgaagaaaagatcaatctagtggtctcttcaaaacacccacgtccgcagttttattcggcggatgaagcgaaagtgcttgtcaaagatggcttgaaagtcatcgactgggcatcgacagatgaaggacaagaacccgatattgtgatcgcagctgctgggacggaaccgaatttggaagctttagctgctgtttcgttgctgattgaagccttcccagagttgaaagtccgcttcatcaatgtggttgatctattgaaattgcgtcgtccagaagtcgatcctcgtgggttgagcgatgaagcattcgaagcctactttacgaaagacaaaccgatcgtgtttgctttccacgggtatgaaggactgattcgcgacatcttctttggccgtcgcaaccaacagcttcatattcatgggtaccgagaaaatggcgacatcacgacaccgtttgatatgcggatcctttctgaattggatcgcttccacttagccaaagacgccgccgaatgggtctatggagaaaaagcaacggactttgcccaaaaaatggcagacaccgttgcgtatcaccatgactttattcgagaaaacggctatgatatcgccgaagtcgaagagtgggaatggaaaccattgcgttga

SEQ ID NO: 187 - DNA, 2364 bp, Enterococcus gallinarum EG2
atggagacaacatttgatacccaagagtattttgacaaaatgaatgcttggtggcgggcagccaactatctttctgtcggacaaatctatttgaaagacaatccactgttacggcggcccattgaagaaaaagatctgaaagtcaatccgattggtcactggggcaccattgctggtcagaattttatctacacccacttgaatcgtgtcatcaataaatatgatttgaatatgttctacattgaaggacctggtcatggaggtcaggtgatggtttcgaatgcctatctggatggaagttatacggaaatctatccagaagtaacccaagatgaggccgggatgcagcatcttttcaaaattttttccttcccaggaggaattgcttcccatgcggcaccagaaacaccaggatcgatccatgaagggggcgaactaggttattccatcgcgcatggaacaggagctgtccttgataatcctgatgtgatcgctgctgttgtggttggagatggcgaagctgaaaccggtccgttagcgggcagctggttttctaatacatttatcaatccggtaaatgatggggctgttctgccgatcttacatctgaacggtgctaaaatctctaatccaacgattctggctcgcaaatcggatgaagacctaaccaagtattttgaaggaatgggttggacaccttattttgttgagggagatgatcctgctactgttcatccgcaaatggcgagagcattggaccgcgccgttgagcagatcaaagcgattcaaaccaaagctcgtcaaggaaaagctgatgaagcagtcatgccccactggcctgttctgatcgtgcgcacacctaaaggatggacaggaccaaaaatttgggagggagagccgattgaaggcggttttcgcgcccaccaagtacctatcccagtcaatgcgcatcagatggagcacgtggatgcactaatcgattggctgaaatcgtataagccagaagaactctttgatgaatctggccgcatcaaggctgagattcaagaactcgcgccgaaaggacagcaacggatggcaatgaatcccatcactaacgggggaatcgatcctcaaccgttgaaaatcaccgattggcgacagcatgcgatcgatattggtgttcctggctcaaccactgctcaagacatgatggagttcggaaagtttgctcgggatttgattgttgaaaacccgactaattttagaatctttggtccggatgaagccaaatccaatcgtttgaaccatgtttttgaagtgacaaatcgccaatggttagaaccaaaacagccaaactatgatgaatggctaagtgctaccggacgggtgattgattcccaattatcggagcatcaagcagaaggcttcctagaaggctacgtcttaactgggcgtcatggcttttttgctagctatgaatctttcttgcgagtggttgattccatgatcactcagcactttaagtggacgcgtaaatcgaaagaattgccttggcgccatgcctatccgtcattgaatttgattgcttcctcaaccgtattccagcaagaccataatgggtatacccatcaagacccagggatcatgacacatatcgctgagaaaaaagcggaattcgtacgggtctatctaccagcagatgccaatagcttgatggctgtaatggcagaaacattccaaactgaagaacagatcaatctgattgtttcttcgaaacatcctcggccgcagttttatacggcagaagaagcggagatattggtaaaagacggcttaaagatcattgattgggcttcaacagaccaaggagaacctgatttggtgatcgctgcagcagggacagagccaaatttagaagctctcgctgctgtaagcctgctgaatgaggcgtttccagagttgaaaatccgctttatcaatgttgttgatttattgaaaatacgtcatccggatgtcgatcctcgtggattgacagatgaagaatttgaggcttactttactaaggacaagccaatcatttttgctttccatggctatgaaggactgattcgggacattttcttcggccgcaagaatcagcgtctgcatattcatggctatcgtgaaaatggcgatatcaccacaccatttgacatgcggatcttatctgaacttgatcgcttccatttagcgaaagacggcgctgagtgggtctatggcgaacaagctgccgactttgcgcaacgaatgacagagacggttgcctatcactatgactttatccgtgagaatggctatgacattgctgaagtccaagattggcaatggaaaccattgaaatag

SEQ ID NO: 188 - DNA, 2373 bp, Enterococcus faecium Com12
gtgttacgtatggattattctagtaaagaatactttgataaaatgacggcttggtggcgtgctgccaattatctttctgtcgggcaaatttatcttaaagataaccccttactgagacgtacgttgaaaccagaagatgtcaaaaaacatccaatcggtcattggggaacgattcctggccaaaattttatttatgtccatttgaacagagtcatcaataaatatgatttgaacatgttttatatcgaagggccaggacacggcggacaagtcatggtgtcgaatgcttatttagatggaagttacacagagatctatccagaagtaacggaagatgagacaggaatgcaaaaattattcaagcgattttcatttcctggtggcattgcttctcatgcagcgccagaaacaccaggttctatccatgaaggcggagagctcggatactctctttcacatggagttggagctgtattagacaatcctgaagtaatttctgctgtcgtgattggtgatggtgaagcagaaaccggtcctttagctggaagctggttctcaaatgtctttatcaatccggtgacagatggagctgttttaccaatccttcatttaaatggtgctaaaatagccaacccaacgatcttggcacgtaaatcagatggagaattagcaaattactttaacggacttggctgggaacctttctttattgaaggaaatgatccagaaaaattaaatcctgttatggctgaaaaaatggatcaagcaattgagaaaatcaaatccatccaaaaagaagctcgtctgaagacagcagcagacgccatgatgccaaaatggccagtattgatcgtacgtacaccaaaaggatggaccggtccagaagaatgggatggggagccaattgaagggactttccgagcacaccaagtaccgattcctgtagatcaagaacatatggatcatgcagatgctttactccgttggttgaaatcctatgaaccagaaaaattatttgatgcacaaggacgtattttagaagaaatcagagaaattgcgcccacaggtgaccacagaatggcaaaaaatcctatcaccaatggcggaatggatccgaaaccgcttattatgccagattggaaaagatatactttacaatttgaaaaaccgggctccgttacagcagaggatatgaccgaacttggtaaattcgttcgcgagatcattgagaaaaatccagaaaatttccgtatattcggaccagatgaaacaaaatcaaatcgattgaatcaagttttcaaaacgacaaatcgccaatggatggaaaaaatcgaaccagaaaatgatgaatggctttcgccatctggccgcgtcatcgacagtcaattatcggaacatcaagatgaagggttcttagaagggtacgttctgactggacggcatggtttttttgcaagttacgaatcatttttgcgagtggttgactctatgctgactcagcacttcaaatggatgcggaaatcacgtgacctttcttggcgaaataattatccttcgctgaatctcattgcaagctcaacagtcttccagcaagatcacaatggatatagccaccaagatccaggaatattgacacatttggcagaaaaaaaggcggagttcatccgtgaatatctgcctgcggatgcaaatacgttgctcgcagtcatggacaaagcattccgctcgtcagaaaaaattaatttgatcatctcttccaaacatccgcgtgctcaattttactcagcagaagaagcagccgtcttagtgaatgaaggcttgaaaatcattgattgggcttcgacagcaaaagaggaggaacctgaattggtcattgctgctgcaggaacggaatctaacttagaagcattagcagctgtgactttgctgctggaagaattcccaaaactaaaaatccggttcatcaatgtcgtagatttattgaaattacgtcatccgagtcaagatccgcgtggattgagcgatgaagaatttgacaaatattttacaaaagacaaaccgatcttatttgctttccacggttatgaaactttgatccgcacgattttctttgatcgtcataaccatcatttaatgattcatggctacaaagaaaacggagatatcacgacaccgtttgacatgcgtgtggtaaatgaacttgaccgttatcatttggcaaaagatgcagctttaaaaatcaaaggaagtcaagcagaagattttgcaaaaaaaatggatcagaaattacaagaacatcaaaactatattcgtgaaaatggtattgatctgccagaagtattggattggaaatggaaaaatcttgaccaataa

SEQ ID NO: 189 - DNA, 2379 bp, Mycoplasma fermentans PG18
atgaacaaaaaagaattcgacagtaaagaataccttgaaaaagttgatgcttgatgaagagctgcaaactatctttcagttggtcaaatttacttaagaaataatcctcttttaaaacatcctttaacttctgatgatgttaaagtttacccaattggtcactgaggaactatttctggacaaaactttgcttatgcacacttaaacagagttattaacaaatatgacttaaacatgttctacattgaaggaccaggacatggtggccaagttatgacatctaactcatacttagatggaagttacacagaattattcccacatgtaacacaagatgaagccggaatgcaacatttatttaaatacttctcattccctggtggaacagcttcacatgctgctcctgaaacccctggatcaattcatgaaggtggagaattaggttactcaatttcacacgcaacaggtgcaattttagataaccctgatgttattgctgctactatcgttggtgatggtgaagctgaaacaggacctcttgcaactagctgattctcaaactcatttattaacccagtaaatgatggtgctgtattacctattcttcacttaaacggtggaaaaatttcaaaccctacaattttaagccgtaaaagtaatgaagaactacaacaatactttagaggtatgggctgagaacctcactttgttgaaggcgacaaacctgaagttatgcatgaattaatggcaaaaactttagactcagttattgaagaaattcaaagcattcaaacaaaagctcgtaaaaaaccagctgacaaagctaaaagaccagtatgaccaatgatcgttcttagaacacctaaaggttgaacaggtcctaaatcatgaaacaaagaagctattgaaggaagcttccgtgcacaccaagttccacttccaattaatgcagaaaacatggaacatgcagatgcacttgaaaaatgattaagatcatatcgtcctgaagaattatttgataaaaaaggtaaattggtaaaagaaatcgctgctattgctcctaaaggcaaaagaagaatgggcatgaaccctattacaaacggtggtattaatcctaaagttatgaaacttggagactgaagaaaatttgctcttcactttgatagaccaggttcagttgttgctcaagacatggttgaattaggaacatactttgctgacttagtaaaaagaaatccagaaaactttagaatttttggaccagatgaaactaaatcaaaccgtctttacaacttattcaaagttacaaaccgtcaatgaatggaaagaattgattctaaattagatgaagctcttagtccagtaggtagaatcattgactcacaactttcagaacaccaagctcaaggtttcttagaaggttatgtattaacaggtcgtcatggtatctttgcttcatatgaatcattcttaagagttgttgactcaatggttacacaacacatgaaatgattaagaaaagcaaaagaaattaactgaagaaaagattatccatcattaaacattatggctacttcaactgctttccaacaagaccacaatggttatacacaccaagacccaggtattattggacacatggcagataaaagaccagaactaattagagaatacttaccagctgatacaaacacattattagccgttatggataaagcatttacagaaagaaatgtaattaacttaatcgtttcttcaaaacaaccaagacaccaattctactcagtagaagaagctgaaacattggttgaaaaaggtttagacattattgattgagcttcaacatgttcaagaaatgaaactccagatcttgttgttgttgctagtggtacagaacctaacttagaagctttagctactatctcaattcttaacaaagaatatccaagtatgaaaattagatttgttaacgttgtagatttacttaaattaagacatccaaaaattgacccacgcggtttaagtgatgaagaatttgatgaaatctttacaaaagacaaaccagtattatttgctttccatggttttgaaggtattttaagagacatcttctttgaccgtcacaaccacaatttaattgctcacggttatagagaaaatggtgacattacaacatcattcgacattcgtcaattaagtcacatggacagattccacatggctagcgatgctgctgcagctgtattcggatcatcaaaagcaaaagaattcatggacaaaatggaagaaacaatccaattccacaacaaatacattcgtgaagttggtacagatattcctgaagttaaaaactgaaaatgagaaggtcttattaaataa

SEQ ID NO: 190 - DNA, 2382 bp, Mycoplasma arthritidis 158L3-1
gtgaaaaaaacaaactacgattcaaacgaatattttaatttaattgacaaatgatttcgtgctgctaattatttaagtgttggacaaatttatctacgtaataatccgcttttaaaaactaagttagttgctgatgacgtaaaaatttatccaattgggcactgaggaactattcctggacaaaatttcatctatgcccacttaaatagagtaattaataaatatgacctagaaatgttttacattgaaggaccaggacatggtggacaagtaatgatttctaattcatatttagatggctcatacaccgaaatttatcctgaaatcactgaagatgaagccggcctaaaaactatgttcaaacgcttttcattccctgggggtacggctagtcacgccgctcctgaaactccaggatcaattcatgaaggtggcgaacttggatacgctcttagtcacgctactggtgcaattttagacaatccaaatgtcattgctgctactgttatcggcgatggtgaagccgaaactggtcctttagcggctggatgattctcaaattcatttattaatccagtaaatgacggtgctgttttaccaataattcacttgaatggtgccaaaatttctaatccaacaattttaagtcgcaaaagtaatcaagaattagaaaattacttttcagggttgggctgagaaccattatttgttgagggcgatgatcctaaactaatgcatccattaatggcgaaaaagcttgatgaagcaattgaaaaaattcaaatgattcaagctagtgctagaaaacacaaagcttcagaagcgacccgccccgtatgaccaatgttgattgtgcgtacccctaaaggatgaactggacctaaagactgaaatggtgaagttgttgaaggaagttttagagcccaccaagttcctataccagtaaatgctctaaatatgacccatattgataaactagaagcttgactaacttcatatcacccagaagagttatttgataaaaatggcaaaattcttgaagagattcgtgctttagcacctaagggtctaaaaagaatggcggttcacccaatcactaatggtggaataaatcctcgcacgcttaagttaagtagctgagaaaaatttgcaactaaatttgaaacaccaggacaaattaaagggcaagatatgatcgaacttggaaaatattttgctgaaattattactttaaataaagacaattttagaatcttcggaccagatgaaaccaaatcaaatcgaatgaatgcagtctttaatgttactaagcgtcaatgactagaaaaaattgctcctacttacgatgaatgaatgtcaccagaaggcagagtaattgattctcaattaagtgaacatcaagccgaaggtttcttagaaggttatgtaattaccggtagacatggtgtttttgctagttacgaagcttttttaagagtcgtagactcgatgcttacccaacacatgaaatgaatgaaaaaatcacttgaacttccttgaagaaaagattttccatcattaaatgttattgctacttcaactgcctttcaacaagatcataacggttacactcaccaagatcccggacttctagggcacttagccgataaacgtcctgaactaattcgcgaatatctaccagctgatactaattgtttattagcaactatggaaaaagccttaaaagaccgcaacgttattaatctaattgtcgcttctaagcaaccacgtgaacaattctattcagttgaagaagcaagcgaacttgtacaaaaaggctacaaaattattaattgagcatcaaatgtttcaaaaaatgaagaacccgatgttgtcttcgccgccgctggggttgaacctaacctggaagctttagcagcaatttcaattcttaacaaggaatttcctaacctaaaaattcgatttgttaatgtgcttgatttattaaaactaaaaagtccaaaacacgaccctcggggcattagtgacgaagaatttgatcaaattttcactaaaaataaaccaattatttttgcatttcatggttatgaagggttgttgcgtgacattttctttgatcgtcacaaccataatttaattacacatggttatcgtgaaaatggcgacatcactactagttttgacatccgtcaactaagtcatatggatcgtttccatatcgctaaagacgccgcaatagcagcacttggcaaagatggcgaaatgtttgcaaaaaaaatggacagtaaactgcaagaacacactagttatgttcgtgaatatggctacgatcttccagaggttgtcaattgaaaatgaacaaacctaaaaccaattaaataa

SEQ ID NO: 191 - DNA, 2388 bp, Mycoplasma agalactiae PG2
atgaaaaagtcacacgattttgacagtaaggaatatctaaatttagttgacgcctgatgaagagctgctaactatttatcagttggtcaaatgtatttaagaaataatccacttttaaaaataccacttaccagtaatgatgtaaaaatttacccaattggtcactgaggaacagttcctggtcaaaactttatttatgcacacttaaacagaatcataaacaaatacgaccttaatatgtttttcattagtggtccaggccatggcggtcaagttatagcttcaaacacatatcttgatggctcatatactgaattatttcctcatgttactaaagacatcaaaggaatgacacacttatttaaatacttctcattccctggtggaacagctagtcacgctgctcctgaatgtcctggttctattcatgaaggtggtgaattaggatattcattatcacatgcagcgggtgcagttttagataaccctgatgttattgctgctactgttattggtgacggtgaatcagaaactggtcctctttcagctggttgatttataaattcatttattaaccctgctaatgatggagcggtattgcctatcttgcacgtaaatggcggaaaaatttcaaacccaacaatttgatcgcgtagatcaaatgaagaattagtttcatatttcacaggcgctggttgaaaaccatttattgttgaaggcaatgaacctgaatatatgcaccatgaaatggccaaagcacttgatgcaagtgtggaattaattaaacaatatcaagctgaagctaggaaaaatggcgccaataaagctaaaaggccacagtgaccaatgattgttcttaagtcaccaaaaggatgaactggacctaaagaatgaaatcatgaagcaattgaaggaagtttcagagcacaccaagttccagttcctgtatcagctgaaaagatgcaacacattgatgcgcttgaaaactgattaagatcatatagaccagaagaattatttgacgaaaatgcccaattgaagcctgaaatagctgctattgcaccaaaaggtgacagaagaatgggcaaaaaccctattgctaatggcggcattaatcctagagccataaatgttggagattgaacaaaatttgcactagatattaaacaacctggcaaagttattaaccaagatatggttactttaggttcatatttaggtgaattaagtctactaaacaaagataatttcagagtttgaggacctgatgaacataagtcaaacagactatatgaaatgtttaaagtaactgaccgtcaatgattagacagaattgatgaaaaatatgatgaatttttatcatctgtaggtagaattattgactcgcagctatctgaacaccaagctgaaggtatgcttgaaggatatgtgctaacaggaagacatggtgtttttgcttcatatgaatcatttttaagagtagttgattctatgcttactcaacacatgaaatgagttaaaaaagcactagacattccttgaagaaatgattatccttcacttaatgttatagcaacctcaaacgctttccaacaagatcataatggttatactcaccaagatccaggattaattggacacttagctgacaaaagacctgaattaattagagaataccttccagctgatacaaacacattgcttgcaacaatggctaaagcattgcaagacagaaatgttattaacttaattatttcatcaaaacaacctagacatcaattctttagcattgaagaagctactgaattagttgaaaaaggtataaaaatcattgattgagcatcaaatattaagccaaacgaagaacctgatttagttgttgctgcatcaggaaccgaatcaacaattgaatcattagcaacaattacataccttcgtgctcatttccctgaattaaaaattagatttgttaatgtacttgacttactaaaactaagacatccaagcattgaccctagaggattaagcgattctgaattcgactcaatctttacaaaagataagcctattttatttgccttccacggttatgaagcaatcttaagagatatattcttcttgcgttcgaatcacaacattattactcacggttatagagaaaatggcgatataacaacagcatttgacattcgtttacttagcgaaatggacagattccatatgacagctaatgttgctaaaaaattagcaccagttgttggagaatctaaagcaaatgaattagtaaaactaatggaagataaaattaaagaacatagagcatatattaaagaatacggtactgacttgccagaagttaaagagtgagaatgaacaccatataaataa

SEQ ID NO: 192 - DNA, 2388 bp, Lactobacillus casei BL23
atggaccaaacaattgagaaaactatcgattattcctcaaaggaatatttgaatgaggttgataaatactggcgggctgctaactatctgtccgttgggcaactgtacctgaaggacaatccgttactgaagcgacccttgaaggcaactgatgtcaaagttcatccgattgggcattggggcaccattgcaggtcagaatttcatttatgctcatctgaaccgggtcatcaataaatacaacctgaatatgttttacattgaaggtccgggacatggcggccaagtcatggtctctaattcttatcttgatggcagttatacagagctctatccaaaaatttctcaagatgagcaaggattgcaacgtttattcaaacaattttcattcccgggtggcgttgcgtctcacgccgatcccaagacgcctggatcaattcatgaaggcggtgaattgggctattccatccttcatggcgctggtgccgttcttgataatccggatctcattgccgcagttgttgttggtgatggtgaatctgaaacaggtccacttgccacctcttggcaagtaaataagtttttgaacccaattacagacggtaccgttttgccaatcttgaacttaaatggtttcaaaatcgccaatccaacggttcttgctcgggagtcgcacgaagagttagtggactactttaaaggtctcggttgggatccacattttgttgaaggatcggatcctgataagatgcatccccaaatggcagctgagatggataaaatcgtcgaagaaattgagtctattcgtaaaaatgccaaagataacaatgacgagagtcgtccagtttggccaatgcttgttttacgggcaccaaagggttggacaggtcctaagacgtgggatggcgagccaattgaaggctccttccgtgcgcatcaaatcccgattccggtggatcaaaaagacatggaacatgcagacgatctagtcgcttggttggaatcatacaaaccaaaggaacttttcaatgacgatggcaccctcaaagctgacattgaagccatcattcctaaaggcagccttagaatggcaatgaatcctgttaccaatggcggcattcttgccaaacatctcgaaaaaccaaatccgagcgattatgctgtggacaataaggatcacggtgctaatgaagcgcaggatatgactgtgctcggcgcttatatccgggatctcatcaaattgaatgataagaacagaaacttccgcggatttggaccagacgaaaccttatccaatcgtttaaacaaggtttttgaagccaccaatcggcaatggatggaaccgatccataaaccttatgatgccttactagctagccatggtcggattattgactcaatgctatcggaacacatggatgaaggcatgctggagggatacacgttaactggtcgttatggtttctttgccagctacgagtccttcttacgggtggttgattccatgcttacccagcatttcaagtggttacggaatgcacacgaagaagctgattggcgggctgatgtacctgccttaaacgttatcgcctcttctactgctttccagcaagaccacaatggctactcgcatcaggatcccggtgtcatcagtcatctagctgaaaagaagacaaagtatattcgcgcttatctgccagcagacgcgaacaccttggttcgtgtcttcgataaatccgttgatgctaaacaagtcattaatctgattgtttccagcaaacatccacgaccacaatggttcacagattcagaggcaaagtctttggttgaaaaaggtctgggtatcattgattgggcaagcacggatcaaggtgcagaacctgatttggttattgccgcggctggttcagaaccaacacttgagagcttggctgccatctcaatcttgcacaaggcattgcctagtttgaggatccgcttcatcaatgtcgttgatttgttaaaacttaagaaagacgaccctcgcggcctatcagatgaagagtttgatatgtactttacaaaagacaaaccggtcatctttgcttatcacggctacgatgatctgatcaaggacattttcttcgatcgtcataatcacaacgttcgcgttcacggctatcgtgaagaaggtgacatcacgacaccatttgatatgcgtgttcgtaacaagttggaccgctttaacttggtcaaagaagccgttctcgatgtccctgaattcaccgaaaaaggtgcccatctcattcaagatatggatgatgagcttcagaagcaccacgacttcatccgcgaggaaggtaccgatttacctgaagttgaagagtggaaatgggaaccgttaaagtag

SEQ ID NO: 193 - DNA, 2412 bp, Lactobacillus plantarum WCFS1
ttgcaaaggagttgcaaaataatgagtgaagcaattaaatccaaaacagttgattactcttctgatgaatatctaaaacgcgttgatgaatattggcgtgctgctaactacatctcagttggtcaactctatctactaaataacccgttacttcgggaaccactaaaggcgaccgacgtgaaagttcatccaatcggccattggggcacgattgctggtcaaaactttatttatgcccatttaaaccgggcaatcaataagtatggcttgaacatgttctacattgaaggccctggtcatggtggtcaagtaatggtttctaactcctacttagatggcacctatacggaaacgtatcctaaaatcacccaagacaaagctgggatgaaacgcttattcaagcaattctcattcccaggcggggttgcttcccatgccgatcctaagacgcctggttcgatccatgaaggtggcgaacttggctactcaatcctgcatggtgctggtgcagtattagataatccaggtttaattgccgctaccgttgttggtgatggtgaatctgaaactgggccattggcaacttcttggcaagttaacaagttccttaacccaattacagacgggacagtcttgccaatcttgaacttaaacggcttcaagatttctaatccaacagttctttcacgtgaatcacatgaagaacttgaagactactttaaaggtctaggctgggatccacactttgttgaaggtacagaccctgccaagatgcacaaaattatggctgaagaattggataaagtcattgaagaaatccacgcaattcgtaagaacgccaaggataacaatgatgaatctcgtcctaagtggccaatgattgttttccgggcacctaagggctggaccggtcctaagagttgggacggcgaaccaattgaaggttcattccgggctcaccaaattccaattcctgtcgatcgcaatcacatggaacacgccgacaaattagttgactggctcaaatcatacaaaccagaagaattatttgatgaaaatggtactttaaaaccagaaattgccgcaatcatccctgaaggccaagctcgtatggctgctaaccccgttactaacggcggtaagttaactaaagacttaattacaccaaatatcgatgattatgctttggacaacaagagtcacggtaaggaagacggttcagacatgactgaacttggtaagtatatccgtgatttaattgagttgaacaaagacaacaagaacttccgtggctggggtcctgacgaaaccttatctaacaaactaggcgctgcttttgaagataccaaacgtcagtggatggaaccaatccacgaacctaatgatgctttgttagcacctcaaggccggattattgactccatgttgtcagaacacatggatgaagggatgttggaagcttacaatttaaccggacgttacggtttcttcgcaagttatgaatcattcctgcgcgttgtggattcaatgttaacccaacacttcaagtggttacggaattctcacgaagaaaccccttggcgggctgatgtaccttcactgaatgtgattgcatcatcaacagccttccaacaagatcacaatggttactctcaccaagatccaggtatcatttcacacttggctgaaaagaagaccgaatacgttcgtgcctatcttccaggtgatgccaatactttgattgcaacctttgataaggctatccaaagcaaacaattgattaatttaatcattgccagcaagcaccctcgtccacaatggttcacaatggacgaagctaagcgcttagttcgtgatggccttggtgttgttgattgggcaagcactgatcatggtgaagaacccgacgttgtcttcgcaactgccggctctgaaccaacgactgaaagcttagctgccgtatcaatcttgcatgcacgcttccctgaaatgaagattcgcttcattaacgttgttgatcttctgaagctgaagaaagacgaccctcgtggtttatcagatgctgaatttgatgctttcttcactaaggacaaaccagttatctttgcttatcatgcatacgacgacttagtaaagaccatcttcttcgatcgccataaccataacttacacgttcatggttaccgcgaagaaggcgacattacaacgccattcgacatgcgtgttcgcaacgaactcgatcgtttccacttagtcaaagctgccttattagcaacgccagcttatgccgaaaaaggtgcccatgtcattcaagagatgaacagcattttagacaagcatcatgactatatccgtgctgaaggtaccgatattccagaagttgaaaactggaaatggactgcattgaagtag

SEQ ID NO: 194 - DNA, 2430 bp, Lactobacillus salivarius ATCC 11741
gtgaaaacgttattatataactgtaaatattttgcaaagaaaagacaaggagatgcaaatattatgacaataaattattcatcaaaagaatacttagaattagtagatagatactggcgtgcagctgattatgtttctgtaggtcaattatatttgaaagataatcctttattggatcgtcctttagttccaacagatgttaaagttcatccaattggacactggggaacaatttcaggacaaaacttcatttatgctcatttgaatcgtgtaattaataaatatgatttagatatgttctatatcgaaggccctggtcatggtggccaagttatggtttctaactcttaccttgacggtagttatacagaaacatatcctgaaatcactcaagacaaagctggaatgcaaaaattattcaaacgtttctcattccctggtggtgttgcatcacatgctgatccaaagactcctggttcaattcatgaaggtggagaattaggttattcactactacatggtgcaggtgcaattttagataatcctaacttaattgctgctacagttattggtgacggtgaagctgaaacaggtcctttggcaacatcttggcaagttaataaattcattaaccctatcaatgatggtactgtattgccaatccttgatttaaatggtttcaagatttccaaccctactgttctttcacgtatgtcacatgaagagctaacaagctacttcaaaggtcttggatggaatcctcattttgttgaaggaacagatcctaaagaattacatgtcaaaatggcagatgaattggatagcattattgaagaaattatggctattcgtgaaaacgctgttaagaataatgatgaatctcgcccagcatggccaatgttagtattccgtgctcctaaaggttggggtggtcctaaagaatgggatggagatatgattgaaggttcattccgtgctcaccaaattccaattccagtagatcaaaatcatactgaacatcttgatagcttagtaagttggttaaaatcttataaacctgaagaattatttgatgaaaaaggtgtcctattagatgatattaaagctattatccctgataaagatcatagaatggcatcaaatcctgttactaatggtggtaaattatcaaaacctttaattttaccagatccagctgacttcgaatttaagacagaccatggtacagaagatggctcagatatgactgaacttggtaaatatatcaaggctgtatttgaattaaataaagataataagaatttccgtggttggggacctgatgaatccttatctaataagttaagtgcagtatttgaagaaacaaaccgtcaatggttggaaccaattcatgatggtagcgatgccctacttgctcctcatggtcgcatgattgactccatgttatcagaacatatggatgaaggtatgcttgaagcttatacattaactggtcgtcatggtttctttgcaagctatgaatcattcttacgtgttgttgattctatgttgacacaacacttcaagtggttacgtaactcccatgaagaaactccttggagagaagatgttccatcattgaatattatttctacttcaactgcattccaacaagatcataatggttattctcaccaagatcctggtattgtaactcatttagcagaaaagaagacaaaatatattcgtgaatacttccctgctgatgctaacactttaattgcagcatttgataaatccttacaaacaaaacaagttattaacttaattgttgcaagtaagcaccctcgtttgcaatggtactcagcagctgaagctaaggaacttgttaataacggattgaagatcattgattgggcaagtaatgttcctgaaggcgaagaaccagatgtagtatttgcttctgctggttctgaaccaaacttagaaagtcttgctgcaatctctattttaagaaagcaagcaccttctttgaagattcgctacgttaacgttgtagatcttttgaagttaaagaaagatgatcctagaggtctttctgatgcagaattcgatgcttacttcactaaagataaaccagttatctttgctttccatggttatgtagacattcttaaagatatcttctttgatagacataaccataacttacacttacatggctataaagaagaaggagatatcactactccattcgatatgcgtgtaagaaatgaacttgatagattccacttagttaaagatgcacttgaagttgttcctggagttagcgaaaaatatgctacagtcttacaagatatggacttactacttcaaaaacatcatgactatatccgtagcgaaggtgacgatattgaggaagttcgcacttggaaatgggatcttgactaa

SEQ ID NO: 195 - DNA, 2367 bp, Leuconostoc mesenteroides subsp. mesenteroides ATCC 8293
atgaatatcgattcaacagattacctgaacaatttagatgcctactggcgagctaccaattatttgtcagttggacaactctatttgttagataacccattgcttaaggaaaagttaacggcagaacaagttaaaattcacccaatcgggcactggggcacgattcctagtcaaaactttatttatgcccatttaaatcgtgctattaataaatttaatttgaatatgttttacattgaggggcctggccatggcggacaagtaatgatttcaaatgcttatcttgatggtagttataccgaagcatttccagaaatcacacaggatgaagcgggtatgcagaaaatgtttaagcgtttctctttccccggtggcgttgcttcacatgctgatcctaaagtacctggatcgattcatgaaggtggtgctttaggctattctatcttgcacggtgctggtgctgtattggataatccagacctcattgctgcggttgttgttggcgatggtgaagcagaaacagcacccctagccacttcatggcatgttaataaatttttgaatcctaaaaatgatggtactgtattaccaattttgaatttaaatggcttcaagattgcgaatcccacagttctctctcgagaatctgatgaaacactaaccgattatttccacagtctgggatggcacccttactttgtaagttcttttgacaaaccgattatgcaagttcatgaagaaatggcaaaaaccatggacacagtatttactgagattaaagacattagagaaaaagccgttcagcagacaaatgaagagattacacgaccactttggccaatgattgttttacgttcacctaaaggctggacagggccaaaaacttgggatgacaaaccaattgaaaattcatttcgtgcacaccaaattccaattcctgctgaccaaaatcatcctgaatatataccacaacttgttgattggttacaatcttacaaaccagatgaattatttgatgaaaacggtcagttaacacaatctatccaagaagtattaccgaaaaaagagctacgtatggccaataattcggtcaccaatgctggtattatcaaacctttgattttacctgacattgacaattacttggtagaaaataatcagccagacaataacttagctcaagatgctattttgttaggtgactatttgcgtgatatcatcaaacttaatcctactaacttccgtggctttggcccagatgaaacagcttctaatcgtttccaagacatttttgaaacaactaatcgccaatggctattaccaatcaaagaacctaatgatcaattcatggcacctgaaggccgtattattgattctatgttatcagagcattatgatgaggggatgcttgaagcttatacgctaaccggtcgtcatggattctttgccagttatgaggtctttattcgtgaagttgatgacatgattgtgcaacattttaagtggttgaatcattctcatgacgtttcatggcgtaaggacgtaccggcattaaatattattgctgattcaaccgttttccaacaagaccataatggttactcacaccaagatcctggtgtaacaacaatgttgtatgaaaagcaaccagacttcattcgcgagttcttcccagcggatgctaatagcttggtcgcaacatttgaacatgctgcgcaagcaacgcaacagattaattatattgtggccagcaaacatccccgcttacagtggttctcacctactgaggccaaacagcttgttacgcagggattacgtgtcattgattgggcaagtactgacaaaggtgaaaaacctgatattattattacttcagctggttctgaaccaacgacagaaagtttagcagcaatacaaattttgcacgaacacataccatcattaaaaatacgttacatcaatgtattggatctatttaaactacgggccgatgccagctatggcttaagtgatgatgaatttgatgcttacttcactactgacacaccagtattatttgcattccatggctatgaaccaatgattgaatctattttcttcaaacgacacaatcaccacttagcagttcatggttaccgagaagttggtgacattacaacaccatttgatatgcgtgttcttaacaaaattgatcgatttaatttagttaaagctgctattaatctcttgccagaaaatattcgcaccaagcaagcagccctcgtgcaagaaatgaccgataagctcgacctacacgttgcgtatactaggtcaaagggaacggacttgcccgaagtagaagattggcgctggcgaccacttaagtga

SEQ ID NO: 196 - DNA, 2460 bp, Lactobacillus brevis ATCC 367
atggcagtagattacgattccaagtcttacttggaaaaagttgacgcttggtggcgtgccacgacttacctttccggtggtatgatttttctgaagagcaacccattgttctcagttacaaacacacccatccaaaaggatgatgttaaggttaagcctattggacactggggaactatctccggccaaactttcctgtacgcacatgctaaccgtttgatcaacaagtacggcttgaacatgttctacattggtggtcctggtcacggtggccaagtaatggtaaccaactcttacttggatggcacctacacggatgcttaccctgaaattacccaagacctcgaagggatgtcccgtttatacaagcggttctcattcccaggtgggattggttctcacatgactgctcaaactccaggttctctccacgaaggtggcgaacttggttactcactttcccacgcaactggtgctgtcttagacaacccagaccaaattgccttcacggttgttggtgatggggaagttgaaacgggccctgcaatgactgcatggaactccatcaagttcttgaaccctaagaacgacggtgctgtgttgccaattcttgaccttaacgggttcaagatttctaacccaacgatcttctcacggatgagcgatgacaagatcgctaagttctttgaaggtttgggttggtcacctcgtttcctcgaaaacgatgacattcatgattacatgacttaccacgaaaaagcggctaagttatttgatcaagcaattgctgatatcaagcaaatccaaaaagacgctcgtgaaaacggcaagtacgaagatgggactatcccagcttggccagttgttattgcgcgcttaccaaagggttggggcggtcctaagaagaacttggacggcgatccaatcgaaggttcattccgtgctcaccaagttccacttggtctgagccaaaacaacttcaaggaactccctgaatttgaagaatggatgaactcatacaagccagctgaattgttcaatactgacggttcattgaaggcagaagtcgctgactttgcacctaagggtgacaagcggatggctgctaacccagttgctaatggtggccgtgctcgtggcgaaaagccagaaacactcgacttaccaaactggaaagactacgctaacgacatcaacgaatctaaccgtgggactttgttaccagatggcaacaagaacatggatatgaacgttctgtcaaccttctttgctggcgttgccacaaagaacccatcatcattccggatcttcggacctgatgaaacgatgtctaaccgtctttgggaaatgttcaagattacgaaccgtcaatggatgagtaaggtcaaggaaccaaatgaccaatatgaagctccagaaggccgtattttggatgcccaattatcagaacaccaagctgaaggttggcttgaaggttacaccttaactggtcgtaccggtgtgttcacttcttacgaatcattcttgcgggttgttgactcaatgaccacgcaacacttcaagtggattcgtcaagccgctgcagaaccatggcggaatgattacccatccttgaacttggtttcaacgtccactgtgttccaacaagaccacaatggttacactcaccaagatccaggtatgttaacccacttggctgaaaagaagtctgactttatccgtcaataccttccagctgatgggaacacgttgttagctgtctttgaccgggccttcaaggaccgtcaaaaggttaaccacattgttgcttctaagcaacctcgtcaacaatggttctcaatcgacgaagccgaagaattggctacgaagggtcttaagaccatcgactgggcttctactgttgctgaaggtgaagatgctgatatcgtctttgcttctgctggtgttgaaccaaccatcgaaacgttggcagctgttgacttgatcaacgatgctttcccagctgttaagatgcgttacgtgaacgttgttgaactagaacgtctgcaaaagaagaacggcccattgaacgatgaccgtgcacttagcgacagcgaattcagttcattcttcggcgaatctggtacgccagttgtctttggcttccatggttacgaagacttgatcgaatccttcttctacgaacgtcaacaccttggtttacacgttcatggttaccgtgaagatggtgatatcacgactgcttacgacatgcgtgtatactccgaattggatcggttccaccaagctaaggatgctgttaacaccttgattgccaagggcgttatcgacgaagctgccggcaaggccttcgacaagaagatggacgacatcttagctaagcactttaagattacccgtgacgaaggtcgcgatattgaagaattcactaagtgggaatggaccccattgaagaagtaa

SEQ ID NO: 197 - DNA, 2460 bp, Weissella paramesenteroides ATCC 33313
atggcagtagattttgattcaaaagcatatctagaaaaggttgatgcttggtggcgtgctaccaactacctttcagcaggtatgatctttttgaagagcaacccattgttttcagtaactaacacaccactacaagcggatgacgttaaggttaagcctatcggtcactggggaactatctcaggacaaactttcttatacgctcatgctaaccgtttgatcaacaagttcgatttgaacatgttctacattggtggtcctggtcacggtggccaagttatggttacgaactcatacttggatggtacttatactgaaaattatcctgagatcactcaagatgttgaaggtatggcccgtttgtttaagcgtttctcattccctggtggaattggatcacacatgactgcacaaacaccaggttcattgcacgaaggtggtgagttaggttactcactatcacacgcaactggtgctgttttggataaccctgatcaaattgctttcgcagttgttggtgatggggaagccgaaactggtccttcaatgactgcatggcactcaatcaagttcttgaaccctaagaacgacggtgctgtattgccaatcttggacttaaatggatttaagatttcaaacccaactatcttctcacgtatgagtgatgaagagattactaagttctttgaaggtttgggatattcaccacgtttcatcgaaaatgatgacatccacgattacatggcataccacgaattggctgctaaggtattcgaccaagctatcgaagacattcaagctattcaaaaggctgcccgtgaagagggccgctatattgatggtgaagttgctgcatggccagttatcattgctcgcttgccaaagggttggggtggaccaactcataacgctgctggtgagccaattgaaaattcattccgtgcccaccaagtgccacttcctttggcacaacaaaagttggacactttgcctgaatttgaagaatggttgaattcatacaagccagccgaattgtttaacactgatggttcattgaaggcagaagttgccgaaatggcaccgaagggtgacaagcgtatggctgctaatccagttgctaatggtggtcgtcgtcgtggtgaagaacctactgatttggcattgccaaactggaaggactttactaacgaagtgactgctgacaaccgcggaactgaattgtcagatggtaaccgcaacatggacatgaacgtgttgtcaacttactttgctgcagtttcaaagttgaacccaacatcattccgtatcttcggacctgatgagacgatgtcaaatcgtttgtgggagatgttcaagattactgaccgtcagtggatggaagaggttaaggaacctaatgaccaacacgaagctcatgaaggtcgtatcttggatgcacaattgtcagagcaccaagctgaaggttggctagaagcatacacattgactggtcgtgttggtgtcttcgcatcatacgaatcattcctacgtgttgttgattcaatgattacacaacacttcaagtggttgcgtcatgcttcagaacaaccatggcgtaatgattacccatcattgaacttgatttcaacttcaactgctttccaacaagaccacaacggttacactcaccaagatccaggtatcttgacacacttggctgagaagaaggctgactttatccgtcagtacttgccagccgatggtaacactttgttggctgtctttggtcgtgcatttactgaacgtcacaagatcaaccacatcgttgcttcaaagcaaccacgtcaacaatggttctcagttgctgaagctgaagagttggctactgaaggtgttaaggtcattgactgggcttcaactgttgctgaaggtgaagatgctgatatcgtctttgcatcagctggtgttgagccaacaatcgaagttcttgctgcattgcacttgatcaacgaggcattccctgcagttaagatgcgttatgtcaatgttgttgaattgcaccgtttgctaaacaagaatggtaagatgaaccacgaacgtgccttgtcagatgacaagtttactgcattgttcggtgaatcaggaacaccagttatgtttggcttccacggattcgaagacttgattgagtcaatcttctacgagcgtcagcacttaggtgcacacgttcacggttaccgtgaagatggtgacatcacaacaacttacgatatgcgtgtatactcagagttggatcgtttccaccaagctaaggaagctgcaaacatcttggctgacaagggtgtaatcaatgctgatgaagcaaaggcctttgatgagaagatggatgctatcttggcaaagcacttcgatgttactcgtaatgagggacgcgatatcgaagagtttactgactggaagtggactgctttaaacaagtaa

SEQ ID NO: 198 - DNA, 2454 bp, Leuconostoc citreum KM20
atggcagatttcgattcaaaagagtacttggaactcgttgataagtggtggcgtgcaactaactatttgtcagcagggatgatcttcttgaagagcaacccattgttctcagttactaacacaccaatccaagccgaagacgttaaagttaagcctatcggtcactggggaactatttcaggtcaaacattcttgtatgcacacgcaaaccgtttgattaacaagtatgacttgaacatgttctacatcggtggaccaggacacggtggccaagtaatggttactaatgcctacttggatggcgaatatactgaagattacccagaaatcactcaagatttggaaggtatgagccgcttgttcaagcgtttctcattccctggcggaatcggatcacacatgacagcacaaacaccaggttcattacatgaaggtggtgaattgggttattcattgtcacacgcctttggtgctgttttggacaatcctgatcaaattgcttttgctgttgttggtgatggtgaagccgaaacaggcccatcaatgacatcatggcactcaacaaagttcttgaatgctaagaatgatggtgctgttttgccaatcttggatttgaacggatttaagatttctaacccaacaatcttctcacgtatgagtgatgaagaaatcacaaagttctttgaaggtttgggttactcacctcgctttatcgaaaatgatgacatccatgactatgcagcttatcacgaattggctgctaaggttttggatcaagctattgaagatattcaagctatccaaaaggatgcgcgtgaaaacggtaagtacgaagatggtacaatcccagcatggcctgtaattattgcacgcttgccaaagggttggggtggaccaacacatgatgaagatggtaaccctatcgaaaattcattccgtgctcaccaagtgccattgcctttggcacaaaataagttagaaacattgtcacaattcgaagactggatgaattcatacaagccagaagaattgttcaatgctgatggttcattaaaagatgaattgaaagctattgcacctaagggtgacaagcgtatgtcagctaacccaatcgctaacggcggacgtcgtcgtggtgaagaagcgacggatttgacattgccagattggcgtcaattcacaaatgacattacaaatgagaatcgtggacacgagttgccaaaggttactcaaaacatggatatgacaacactttcaaactacttggaagaagttgctaagttgaacccaacatcattccgtgtctttggacctgatgaaacaatgtcaaaccgtttgtggagtctctttaacacaactaaccgtcaatggatggaagaagttaaggaaccaaatgatcaatatgttggcccagaaggtcgtatcattgactcgcaattgtcagagcaccaagctgaaggttggcttgaaggctacacattgactggccgcgttggtatctttgcttcatacgagtcattcttgcgtgttgtggatacaatggttacacaacacttcaagtggttgcgtcacgcctcagaacaagcatggcgtaatgattatccatcattgaacttgattgcgacgtcgactgcgttccaacaagatcacaatggttacacacaccaagatccaggtatgttgactcatttggctgaaaagaagtctaacttcattcgtgaatacttgcctgcagatggtaactcattgttggctgttcaagatcgtgcgttctcagaacgtcacaaggttaacttgattattgcttctaagcaaccacgtcaacaatggtttactgctgatgaagctgatgaattagctaatgaaggtttgaagattattgattgggcttctactgcaccatctggtgatgttgatattacattcgcatcatctggtacagaaccaacaatcgagacacttgctgccttgtggttgattaaccaagccttcccagaagtaaagttccgttatgttaacgttgttgaattacttcgtttgcaaaagaagtcagaatctcacatgaatgatgaacgtgaattgtctgacgcagaattcaacaagttcttccaagctgataagcctgttatctttggtttccacgcttacgaagatttgattgaatcattcttcttcgaacgtaagttcaagggtgatgtttatgttcatggttaccgtgaagatggtgacatcacaacaacttatgacatgcgtgtttactcaaagttggatcgtttccaccaagctaaggaagctgccgaaattttgtcagctaatagcacaattgatcaagcagctgctgatacatttatcgaaaagatggatgctactttggcaaagcatttcgaagttactcgtaacgaaggtcgcgatatcgaagaatttactgattggaattggtcagctttgaagtaa

SEQ ID NO: 199 - DNA, 2442 bp, Leuconostoc mesenteroides subsp. mesenteroides ATCC 8293
atggcagatttcgattcaaaagagtacttggaacttgttgataagtggtggcgcgcaactaactatttgtcagctgggatgatctttttgaagagcaacccattgttctcagttactaatacacctatcaaggctgaagatgtaaaagttaagccaatcggacactggggtactatctcaggtcagacattcttgtatgcacatgctaaccgtttgatcaacaagtatggtttgaacatgttttacgttggtggtcctggtcacggtggccaagttatggttactaacgcttacttagacggcgcatatactgaagattatcctgaaattactcaagatatcgaaggtatgagccacttgttcaagcgtttctcattccctggcggtattggatcacacatgacagctcaaacacctggttcattacacgaaggtggtgaattgggctattcattgagccacgcttttggtgccgttttggacaatcctgaccaagttgctttcgcagttgttggtgatggtgaagctgaaacaggtccttcaatggcttcatggcactcaattaagtttttgaatgctaagaatgatggtgccgttttgcctgtcttggatttgaacggattcaagatttcaaacccaactatcttctcacgtatgagtgatgaagaaatcacaaagttctttgaaggtttgggttattcacctcgcttcatcgaaaacgatgatattcatgactacgcaacatatcaccaacttgcagcaaacattttggatcaagctattgaagatattcaagctattcaaaatgatgcacgtgaaaatggtaagtatcaagatggtgaaatccctgcatggccagtaattattgctcgcttgccaaagggctggggtggaccaacgcacgatgcaagtaacaatcctattgaaaactcattccgtgcgcaccaagtgccattgcctcttgaacaacacgatcttgcaacattgcctgaattcgaagactggatgaactcatacaagcctgaagaattattcaatgctgatggttctttgaaggatgaattgaaagctatcgctcctaagggtgacaagcgtatgtcagctaaccctattacaaatggtggtgctgatcgttcagacttgaagttgcctaactggagagaattcgctaacgatatcaatgatgatacacgtggtaaggaattcgctgatagcaagcgcaatatggacatggcaacattgtcaaactacttgggtgctgtttcacaattgaacccaactcgtttccgcttcttcggtcctgatgaaacaatgtcaaaccgtttgtggggattgttcaatgttacaccacgtcaatggatggaagaaatcaaggaaccacaagatcaattgttgagccctacgggtcgcattattgattcacaattgtctgaacatcaagctgaaggttggcttgaaggatatactttgactggtcgtgttggaatcttcgcatcatacgagtcattcttgcgtgttgtcgatacaatggttacgcaacacttcaagtggttgcgtcacgcttcagaacaagcatggcgtaatgactatccatcattgaacttgattgcaacttcaactgctttccaacaagatcacaatggatatactcaccaagatccaggtatgttgactcacttggctgaaaagaagtctaactttattcgtgaatatttgccagctgatggtaactcattgttggctgttcaagaacgtgctttctcagaacgtcataaggttaacttgttgattgcttctaagcaaccacgtcaacaatggtttacagttgaagaagctgaagtattggctaacgaaggtttgaagatcattgattgggcttctactgcaccttctagtgatgttgatattacattcgcatctgctggtactgaaccaacaattgaaactttggctgctttgtggttgattaaccaagcattcccagatgttaagttccgttatgttaacgttgttgaattactacgtttgcaaaagaagtcagaacctaacatgaatgatgaacgtgaattatcagccgaagaattcaacaagtatttccaagctgatacaccagttatcttcggtttccatgcttatgaaaacttgattgaatcattcttcttcgaacgtaagttcacgggtgatgtatacgttcatggatatcgtgaagatggtgacatcacaacgacatatgatatgcgtgtatattcacacttggatcgcttccatcaagctaaggaagctgctgaaatcttgtctgcaaatggtaagattgatcaagctgctgctgatacattcatcgctaagatggatgatactttggcaaagcatttccaagttactcgtaacgaaggtcgtgatatcgaagaattcactgactggacatggtcaccacttaagtaa

SEQ ID NO: 200 - DNA, 2469 bp, Lactococcus lactis subsp. lactis
atgacagaatataattcagaagcttatttgaaaaagcttgataaatggtggcgagcagcaacttatcttggagcaggaatgatcttcttgaaagaaaatcctttgttctctgtgacaggtactccgattaaagcggaaaaccttaaagccaatcctattgggcactgggggacggtttcaggacaaactttcctctatgctcatgctaatcgtctaatcaataaatataatcaaaagatgttttacatgggtggccccggacatggtggacaagctatggttgttccttcttatcttgatggctcatatacagaagcttatccagagattacccaagatttggaaggaatgtcacgtttgtttaaacgtttctcatttcctggaggaatagggtcgcatatgacagcacaaacccctggttcacttcatgaaggaggtgagttgggttatgtgctatcacatgcaacaggggctattcttgatcaacctgaacagattgcttttgctgttgttggggatggagaagctgaaactggaccgttgatgacaagttggcactctattaaattcattaatcctaagaatgatggggcgattttaccaattcttgatttaaatggttttaaaatttcaaatcctactttgttcgctcgaacttcagatgttgatattcgtaaattctttgaaggattgggttactcacctcgttatattgaaaatgatgatattcatgattacatggcttatcataaattagcagctgaagtttttgataaagcgattgaagacattcatcaaattcagaaagatgcgcgtgaagataatcgttatcaaaatggagagattccagcttggccaattgttatcgcacgtttaccaaaaggttggggtggtccacgttataatgattggtcaggtcctaaatttgacggtaagggaatgccgattgaacatagtttccgtgcgcatcaagttccacttccgttatcttctaaaaatatgggaactttaccagaatttgtaaaatggatgacttcttaccaaccagaaactttatttaatgctgatggaagtttgaaagaagagttgcgtgattttgcaccaaaaggtgagatgcggatggcttcaaaccctgtaacaaatgggggagttgattattctaatttggttttaccagattggcaagaatttgcaaatccaatttctgaaaataatcgaggaaaattactccctgatacaaatgacaatatggatatgaatgttttgtcaaaatattttgctgaaatagtcaaacttaatcctacgcgtttccgtttgtttggtcctgatgaaaccatgtctaatcgtttttgggaaatgtttaaggtgacgaatcgtcaatggatgcaagtcataaaaaatccaaatgatgaatttatctcacctgagggtcgcattattgattctcaattatcagaacaccaggcagaaggttggcttgaaggttatactttaactggacgtacaggagtatttgcaagttatgaatcattcttgcgagtcgtggattcaatgttaactcaacatttcaaatggattcgtcaagcagcagaccaaaaatggcgccatgattatccttcgcttaatgttatttcgacttcaactgttttccaacaagaccataacggttatactcaccaagatcctggaatgttgactcatttggctgaaaagaaatctgattttatcagacaatatttgccagctgatggaaatactttgctagccgtatttgaccgtgcttttcaagatagaagtaaaattaatcatattgtagcctctaaacaacctcgtcaacaatggtttactaaagaagaagctgaaaaattggcgactgacggaattgcaacaattgattgggcttcaacggctaaagatggagaagcagtagatttagtttttgcctcagcaggagctgagcctacaattgaaacactggcagctttacatcttgtaaacgaagttttcccacaggcaaaattccgttatgtgaacgtggttgaactgggtcggttgcaaaagaaaaaaggggcactcaatcaagaacgtgaactctcagatgaagaatttgaaaaatactttggcccttcaggcactccagtaatttttggattccatgggtatgaagatttaatcgaatccattttctatcaaagaggacacgatggtttgattgttcatggttaccgtgaagatggtgacatcacgacgacttatgatatgcgggtttactctgagcttgaccgtttccaccaagcgattgatgccatgcaagttctttatgtcaaccgaaaagttaatcaaggtctagcgaaagctttcattgaccgaatggaacggacactagttaaacactttgaagtgacaagaaatgaaggagttgatattcctgagtttactgaatgggtttggtccgatttaaagaaatag

SEQ ID NO: 201 - DNA, 2454 bp, Oenococcus oeni PSU-1
atggcagctaatgcacctgcagttgattatgattcaactgaatatctagaactcgtcgataagtggtggcgtgcaaccaactacttgtcaggcggaatgattttcctaaagaacaatccgctctttagtattacaaagactcctttaaagtcggaagacgtcaagttcaagccaattggacactggggtacgatttcaggacagacattcatttatgcccatgaaaaccgtctcatcaataagtatggtttgaatgctttttatgtcgaaggacctggtcatggtggccaagttatggttactaattcataccttgatggttcttatactgaggattatcctgaaattactcaagatcttaagggtatgtccaagttattcaagcgcttttcatttcctggtggaattggatctcacgctaccgctcaaactcctggatcactccatgaaggtggcgaactaggctattcactttcccacggtatcggagctattcttgataatcctgaccaagttggtttcgttacggttggtgatggtgaagctgaaaccggtccagctatgacagcttggcacggtatcaagtttatcaaccctaagaccgatggtgctgtccttcctattcttgatttgaatggttggaagatttccaacccaacaatctttagccgtatgagtgatgaacagattgccaagttctttgaaggacttggctggtctcctcgcttccttgaaaatgatgagattcatgattttatgacttatcacaagaaggctgcaaagctttttgatcaagcgatcgaagatattaaacaaatccaaaaagatgctcgcgaaaacaacaaatatcaagatggcacaattcctgcatggccggttattattgctcgtttgccaaagggttggggcggtccaaagtttgatgaggatggtaatcctattgaaaatagtttccgtgctcaccaagttccattgaatttctcggcagagcacatggaagaattgccacaattcgaagagtggatgaattcttacaagcctgaagaactgtttaatgaagatggttctttgaaagccgagatttctgcaattgctcctaagggcagcaagagaatggctgcaaatccactggctaatgctggtgttgataattctgatttgaagcttcctgattggaaggaatattcaactggtgttactcctgagaatcgtggaaccgaaatgaaggatgctaacatgaacatggatatggttaccttgtctgggttcttggctggcgttgctaaactaaatccaactcgtttccgtttctttggacctgatgaaacgatgtctaaccgtctttggaaactctttgataagacacctcgtcagtggatgagcaagattaaattccctaatgatgctttgttggcgcctgaaggtcggattattgattctcaactttctgaacatgaagctgagggatggctggaaggctataccttgactggccgtgtcggcatgtttgcttcttatgaatcattcttgcgcgttgttgattcaatgattaatgaatacttcaagtggattcgccaagccgatgccgaaccatggcgtaataagtaccaatcattgaacttaatttccacctcgactgtcttccaacaagatcataacggttatactcaccaggatcctggaatgttgactaatttagccgagaagaaacaaaattatattcgtcagtacttaccggctgatggtaatgaattattagccgttgcttctcgtgcattggttgatcgtcaaaagattaatcatattgttgcttctaaacaacctcgtcaacagtggtttactgctgaagaagctgagaaactggttaacaatggtcttggtattgtcgactgggcttctacttctcctgatggggatgttgatattaccttcgcatctgctggtactgaaccaacgattgagactttggccgctttgtggttggtcaatcagagcttcccagacgtaaagttccactatgtcaatgttgttgaattaggtcgtttgcagaagaaggttggtccgttaaacgatgatcgttcactatctgatgaagaatttgataaattctttccagctggtaagccggttgtctttggcttccatggctttgaagatttgattgaagcaatcttctatgagcgcaatcatcataatcttcatgctcatggttaccgtgaagatggtgacattactacccaatatgatatgcgtgtttattctcatttggatcgtttccaccaagctatcgatgccgtttcagcattgaaagacgaaggcgttattgatggtgaaaaagccgatagctttatcgatgacatgaataaaattcttgataaacactttgaagttactcgtaatgaaggccgtgatattgaagaattcactgactggaactggactgctttaaagtaa

SEQ ID NO: 202 - DNA, 2376 bp, Clostridium butyricum 5521
atgacaaatataaattattcttcagaaagttatttgaagaaagtagatgcatattggagggcgactaactatatttcagttggtcaattataccttaaaggaaatcctttattaagagaaccattgaagccagaacatgttaaaaatgctgtttttggtcattggggtactatagcaggacaaaactttatttatgctcatttaaatcgtgtaattaataaatatgacttaagtatgctatatatttctggtccaggccatggcggacaagttatggtctctaactcttatttagatggaagctatagtgaagtttatcctgaaataactcaagatcttgaagggttatcaaaattatataaacagttctcattctcagggggaattggatctcatgcgacacctcaagctccaggctcaattcatgaaggtggagaattaggatactcgttagtacatggttttggtgctatattagataatccggatttaattgcaacagttgttgttggtgatggtgaagcagaaacaggaccacttgctacatcttggcaattaaataaatttataaatcctgttacagatggtgttgtactaccgatactatacttaaatggatttaaaataagtaatcctacaattatggcaaaaatgactgatgaagaattacaaaagtattttgaaggattaggatgggatcctatttttgtagaaggtgatgaacctgaagtaatgcatcagttaatggctgagaaaatggatgaagcaattgaaaagattcttacaattaaaaagcgtgcagtagaagaaaatgatatgagtagacctaagtggccagtcattcttaacagaacacctaaaggatggacaggacctaaggaattagatggaaagccaattgaaggctcattccgcgcacatcaggttccgattccttttgacagtaagcatatggagtgtgcagatgattttgtaaaatggatgaacacttatggtccagaagaattatttactgaagatggtaagcttgtagaagagattgcagaaataattcctaaaggtgatagacgtatgtcatgtaaccccgcaacaaatggcggaaagatcatgaagggtcttcgtttaccagattatcgtgaatacgctattgataataaagaaaaaggtaaaaatgttgcgcaagatatgcttattttaggaaaatatgtacgtgatgtcatgaaattaaatgataaggaacgtaacttccgtgtattcagcccagatgaagcagcatcaaaccgtttatatgcaatgtttgaagaaacaaaacgtcaatgggttggagaaatagatgaaccttatgatgaattcttagctccagacggacgtatattagattcaatgttaagtgaacatatagctgaaggtgctttagaagcttatctattaactggacgtcatggttttattcatagctatgaatcattcttacgtgttgttgactcaatgattacacaacatttcaaatggttaaaccaatgtgaagatattccatggagagcagatattccttcattaaacttaataaatacttcacatatctggcaacaggatcacaatggatatactcatcaggatccaggaatgcttggacatttagctgataaaaattccggattaattcatgaatacttaccagcagatgcaaatacattacttgtaacatttgataaatgtataagaagtataaatcaggtaaatgttatgacagcttcaaaacatccaagacaacaatggtttactattgaagaagcagaatatttagtgaataaaggtttaggtattgttgattgggcaagtacagataagaatggtgaaacagatattgtatttgcaatggctggagatacaccaacacttgaaggtttagcagcagtacaattattacatgactatttaccagatttaaaaattagatttgttaatatagttgatttattaaaattacaatctccagaagtatatgagcatggtatatctgatgaagaattcaatatgatattcactaaagataaaccaataatatttggtttccatggttatgaaaacttagtagatactttattctttaagcgtgataaccataatgtttctgttcatggttacagagataaaggagaaataacaactggatttgatatgcgtgtaatgaatgaattagatcgtttcaatcttgtaaaagatgcaatctatcatttaccacaattggctaataaaggtgcacatataatccgagaaatgaatgaaaaattagaaattcatactaaatttgttcatgaaaatggtattgatttacctgagattgctaattggcgatggaagggtcttaaataa

SEQ ID NO: 203 - DNA, 2394 bp, Clostridium carboxidivorans P7
atgaaagttataacaacaaaagaacatacaggtgaaggaaatattacaccagaatacttgaaaaaggtggatgcttactggcgtgctgctaattatttatctgcagcacaattatatttattagacaatcctttacttaaagaacctttaaagcctgaacatttaaaaggaaaagtagttggacattggggaactattcctggacaaaactttatttatgctcatttaaatagagttataaaaaagtatgatttagacatgatttatgtttctggaccaggacatggtggtcaagttatggtatccaattcttatttagatggaacttacagtgaggtttatcctaatgttgctcgtgatattcctggtttaaagaaactatgtaaacaattttctttcccgggtggaatttctagccatatggcacctgaaactcctggttctatacatgaaggtggagaattaggttattctttagctcactcatttggtgcagtttttgataatcctagtttaattactgcttgcgttgttggtgatggtgaatctgaaactggtccacttgctacttcatggcaggcaaataaatttttaaatcctattacagatggtgcagtacttccaatattacatttgaatggttacaaaattagtaatcctactatattatcacgtattcctaatgaagaattaaaaaagttctttgaaggaaatggatggaagccttattttgtggaaggcgaagatcctaaaactatgcatgaattaatggctaatacacttgatatagtaactgaagaaattcttaaaatacaagaaaatgctcgtaaaaataatgatgctactcgtcctaggtggccaatgattgttttacgtactccaaagggatggacaggtcctaaaatggttgatggagttccaaatgaaggttctttccgtgcgcaccaggtacctcttccagtagaccgttgtcacacagaacatttagatgatttggtaaaatggttaaagagctataaaccagaagaattatttgatgaaaatggtagattagttcctgaacttcaagaattaactccaaagggaaataagagaatggcatcaaatccacatacaaatggtggtttattattaaaggaacttcgtactcctgattttcgtgattatgctgtagatgtacctactccaggagctactacttcacaggatatgattgaacttgcaaaatacctacgtgatgtggttaaattaaacgaagaaaatcgtaacttccgtatctttggaccagatgaaactatgtccaaccgtttatgggcattatttgaaggaactaaacgtcaatggttaccagaaataaatgaaccaaatgatgaattcttggctcatgatggaagaattgtagactcaatgcttagtgaacatttatgtgaaggttggttagaaggatatttattaactggacgtcatggtttcttctcaagctatgaagctttccttcgtattgtagattctatgattactcaacatggaaaatggttaaaagtaacttcagaacttccttggagaaaagatatagcttctctaaatttaatagctacatctaatgtatggcagcaggatcacaatggttatacacaccaggatccaggtttacttggtcatatagtagacaagaaaccagaaatagttagagcttatttaccagctgatgctaatactctacttgctgtttttgatcattgtcttcatactaaacataaaatcaatgtattagttacatcaaaacatccaagacaacaatggttaactatggaacaagctgttaagcatgtagaacagggtgctagtatttgggactttgcaagtaatgaccagggacaagaacctgatgtagttataggtacttgtggtgatactccaactttagaaggtttagcagcagttacaattttgcgtgaacatttaccagagcttaaagttcgttttgtaaatgtagtagatatgatgaagctaatgcctgaaaatgaacatcctcatggattaagtgaacaagattataatacattgtttacaacagataagccaattatatttgctttccatggctatgctcatttagttaatcaattaacttatcatcgtgctaatcataacttacatgttcatggttatcaagaagagggtacaattacgactccatttgatatgcgtgttcagaataaattagatagatttaatcttgtaaaagatgtagtacaaaatttacctcaacttggaaaccgtggagcacaccttgttcaattaatgaacgacaaaatagttgaacataataaatacattcgtgactttggtgaagatcttcctgaggttgctaaatggcagtggcatgtgtaa

SEQ ID NO: 204 - DNA, 2391 bp, Clostridium acetobutylicum ATCC 824
atgcaaagtataataggaaaacataaggatgaaggaaaaatcacaccggagtatctaaagaaaattgatgcatattggcgtgcagctaattttatatctgtaggtcaattgtatttgctagacaatccattgcttagagaacctttaaaaccagaacatctaaaaagaaaagttgttggtcactggggtactattcctggtcaaaactttatttatgctcatcttaaccgtgttattaaaaaatatgatttagatatgatttatgtttctggtccaggtcatggtggacaagtaatggtgtccaattcttatctagatggaacctatagtgaagtttatccaaatgttagtcgtgatttgaatggcttaaaaaagctatgtaaacaattctcttttccaggtggaatttctagccatatggctcctgaaacaccgggttcaataaatgaagggggagaactaggctattctttagcacattcttttggtgctgtttttgataaccctgatttgattactgcttgtgttgttggagacggagaggcagaaacaggacctcttgcaacatcttggcaagcaaataaatttttaaatccagttactgatggagcagtgcttcctattttacatttaaatggatacaaaattagtaaccctactgtgttgtctcgtattcctaaggatgaacttgagaaattctttgaaggaaacggatggaagccttattttgtagaaggtgaagatcctgaaacaatgcataaattaatggcagaaacattagatatagtaacagaagaaattcttaatattcagaaaaatgctcgtgaaaataacgattgttcacgaccaaagtggccaatgattgtattgcgtacaccaaagggatggacaggtccaaaatttgtagatggtgttccaaatgaaggatctttccgtgcacaccaagtaccgcttgcagtagatagatatcatacagaaaacttagatcaattagaagagtggcttaagagttataaaccagaagaattatttgacgaaaactatagactaataccggaacttgaagaattaactccaaagggaaataagagaatggcggctaatttgcatgctaatggtggtttattattacgtgaactacgtacacctgattttcgtgattatgctgtagatgttcctactccagggagcacagttaagcaggatatgattgaacttggaaaatatgtgcgtgatgttgttaaattaaacgaagatactcgtaatttccgtatttttggaccggatgaaactatgtctaatagattatgggcagtttttgaaggtacgaaacgtcaatggttatcagaaattaaagagccaaatgatgaattcttatcgaatgatggacgtattgttgattcaatgctaagcgaacatttatgtgaaggttggttagagggttatcttttaacaggacgtcatggtttctttgcaagttatgaagccttccttcgtattgttgattctatgattactcagcatggtaagtggttaaaggtaacatcacagctaccatggagaaaagatattgcttctttaaatttaatagcaacatctaatgtatggcagcaggatcataatggatatactcatcaagatccaggtttattaggacatattgtggataaaaaacctgaaatagttagagcatatttaccagcagatgccaataccttattagccgtatttgataaatgccttcatactaaacacaagattaatttattagtaacatcaaaacatccaagacaacagtggttaacaatggatcaagcagttaagcatgtagagcaaggaataagcatttgggattgggcaagtaatgacaaaggacaagaacctgatgtagttatagcttcctgtggagatactccaacattagaggctttggcagctgttacaatccttcatgaacatttaccagaattaaaagttcgttttgtaaatgtagtggatatgatgaaattattacctgaaaatgagcatcctcatggcttaagcgataaggattataatgccttatttacaacagataagcctgtaatatttgcattccatggatttgcacatttaataaatcaattaacatatcatcgtgaaaatagaaatttacatgtacatggttatatggaagagggaactattacaacaccatttgatatgcgtgttcaaaataaattagatcgttttaatcttgtaaaagatgtagtagagaatttacctcagcttggaaatcgtggagcacatcttgttcagttaatgaatgataaattagtagaacataaccaatacattcgtgaggttggagaagatttgccagaaataactaattggcagtggcatgtataa

SEQ ID NO: 205 - DNA, 2376 bp, Coprococcus comes ATCC 27758
atggaagacaataaattatgtcttgaaaagcagccattatctgatgaactgctcaacaaaatgaatgcctactggcgtgctgccaactacctgtcagccggtcagttataccttcttgataatccgcttctgaaaaagccattgaccatggatcagatcaagaaaaaaatcgtcggacactggggaaccgtacctggacaaaacttcatctatgtacactgcaaccgtgtcatcaaacgttatgatctggatatgattcttctttccggtccaggacatggcggaaacttcctgatcgccaacacttatctggaaggttcttatagtgaagtttatccgaacatcagccagaatgaggaaggcatgaagaaaatgttcaagcagttctcattcccatgcggagttccgagtcactgtgctccagaaacaccaggttctatcaatgagggtggagaacttggatattcaattgctcacggctttggtgctgttctggacaacccagatcttatcgctacagttgttgtcggtgacggtgaagctgaaacagggccgcttgctacttcatggcagtccaacaaattcctgaacccgatcacagacggtgctgttcttccaatccttcatctgaacggatacaagatcagtaacccgaccattttctcacgtatttctcatgaggaagtagaaaacttcttcaagggctgcggatggaaaccttacttcgtagaaggtgatgatccgatgactatgcacagaaaaatggctgagactatggatgcctgcatcgaagaaatcaaagcaatccagaaaaatgcccgtgaaaacaatgatcctacccgtccgttctggccaatgatcgttcttcgtactccaaagggatggacaggaccaaaggttgttgacggactccagattgaaggatctttccgtgcacatcaggtaccgctttctatggaatcaccagaacatcttgaccttctgaaagaatggttggaaagctaccatgcagaagaactctttgatgaaaaaggacgtctgattccggaacttgcagaacttgctccaaagggagatgcccgtcttggtgcaaacccgcatgcaaatggcggacttcttctgaaagaccttcgtcttccggatttccgctcatacggaatcgaagtagaacctggcaagacaaaagcacaggatatgatcgaacttggcggatacatccgcgacatcttcaaattaaatgaagacagtaagaacttccgtatcttcggaccagatgaaagtatgtccaaccgtctgtacaaagtatttgaagaacagaaacgtgactggcaggcagacttgcttgacactgatgactgccttgcaagagacggacgtatcatggacggtatgttaagtgaacatatgtgtgaaggatggctggaaggatatcttctgacaggacgtcatggattctttgcaagctatgaagcattcatccgtatcgttgactctatggcagcacagcatgcaaaatggctgaaggtctgcaaccagctttcatggagacagccgattgcttcgctgaactttatcctgacatctaatgtatggcaacaggatcataacggatttacacatcaggatccaggatttctggatcacattgccaataaaaaggcagacgttgtccgcatgtatttaccaccggatacaaactgcttactctcatgcttcgaccactgcatcaagagtaagaactatgtcaatgcaatcgtagcgtctaaacatccaagctgccagtggctgactatggaacaggctgtaaagcattgtacacagggtatcggtatctgggaatgggcaagtaatgactgcggtgaagaaccagatgttgttatggcttgctgcggtgacactcctactcttgaagttatggctgctgttactatccttcgtgatgaaatgccagagctcaagatccgcgttgtcaatgtagttgacctgttcaaactggaatcagaccacaaacatccacacggattaagtgatgcagaatacgatgcaatcttcacaaaagataaaccggttatctttgcattccacggatatccgacactgattcatgagctgacatacgaacgtcacaaccacaatatttctgttcatggatatcaggaagaaggtacgatcactactccatttgacatgcgtgtacagaaccagattgaccgtttcaaccttgtaaaagatgcaatcatgcatctgccacagcttggcaataagggatcattcctgattcagaagatgaacgacaaactggttgagcacaagcagtacatcgctgaatatggacaggatctggaagaaatcagaaactgggaatggcataaataa

SEQ ID NO: 206 - DNA, 2376 bp, Ruminococcus sp. 5_1_39BFAA
atggaagacaacaaattatgtctggaaaagcagcctttaaaccaggaaatgcttgacaaaatcgatgcttactggcgtgcagctaactatctgtctgccggacagctctatcttctcgacaatccgcttctgagagagccattaactatggatcagatcaagaaaaaaattgttggtcactggggaactgtaccgggacagaacttcgtttatgcacactgcaaccgtgtcatcaaacgttatgaccttgatatgatcctgctttccggtcctggacatggcggaaacttcatgattgccaacacctatctggaaggttcttacagcgaagtttatcctaacatcagccaggatgaggaaggtatgaagaaaatgttcaaacagttctccttcccatgcggagtcccaagccactgcgcaccggaaacacctggttccattaatgaaggtggcgagcttggttactccatcgctcatgctttcggagctgtatttgacaacccggatctgattgcaactactgttgtaggtgatggtgaagctgagactggtcctctggcgacatcctggcagtccaacaaattcctgaacccgattacagacggtgctgtacttcctattcttcacttaaatggatataagatcagcaacccgactatcttctcccgtctttctcatgaagaacttgaatgcttcttcaagggctgtggctggaaaccatatttcgttgaaggtgacgacccaatgacaatgcacaagaagatggccgaaacaatggacacagtgattgaagaaatcaaagcaatccagaagaacgcccgtgagaacaataatccggaacgtccggtatggccaatgatcatccttcgtactcctaagggatggacaggtcctaaggttgttgacggacttcagattgaaggttctttccgtgctcatcaggttccgatcactatggaaaaaccggaacatcttgaacttctgaaggagtggctggaaagctatcgtcctcaggaactgtttgataaaaacggacgcctgatcccggaactggctgaactggctcctaagggaaatgcacgtctcggtgccaacccacatgcaaatggcggacttcttctgaaagatcttcgtcttccggacttccgcgattacggtattgaagtacagcctggcaaaacaaaagctcaggatatgatcgaacttggcggatacatccgcgacatcttcaaactgaatgaagaaaacaagaacttccgtatctttggaccagatgaaagcatgtccaaccgtctgtacaaagtatttgaatatcagaaacgtgactggaacgcagaaatgcttgatactgatgactgcctcgcaagagacggacgtattatggacagtatgctcagtgagcatatgtgtgaaggatggctggaaggttacctgttaacaggtcgtcatggcttcttcgcaagctatgaagctttcatccgtatcgttgactccatggcagcccagcatgcaaaatggctgaaagtttgcaatcagctttcctggagacagcccatcgcatccctgaacttcatcctgacatccaacgtatggcagcaggaccacaacggatttactcatcaggatcctggattcctggatcacattgccaataaaaaagcagacgtagttcgtatgtacttaccaccggacgctaactgcttactctcctgcttcgatcactgcatcaagagtaagaattatgtcaatgcaattgtagcttccaaacatccaagctgccagtggctgaccatggagcaggctgttaagcactgcacacagggtatcggtatctgggagtgggcaagcaatgactgtggtgaagaaccagacgttgttatggcctgctgcggtgatacacctacacttgagattatggctgcagttactatccttcgtgatgaaatgccggaacttaagatccgtgttgttaacgttgtcgacctgttcaaactggaatctgaccacaaacatccacacggcttaagtgacgcagaatatgatgcaatcttcacaaaagataaacctgtcatctttgcattccatggatatccaacactgatccatgagcttacttatgagcgtcacaaccacaatatctctgttcacggatatcaggaagaaggtactattactacaccattcgatatgcgtgtacagaaccagattgaccgtttcaatcttgtaaaggatgccatcatgcatcttccacagcttggaaacaaaggttccttcttaatccagaagatgaatgacaagcttgttgagcacaaacagtatattgctgaatatggccaggatctggaagagattcgaaactgggagtggcataaataa

SEQ ID NO: 207 - DNA, 2460 bp, Roseburia intestinalis L1-82
atgggaaattgccctccgaaaaaagattgtctaaaatataacaaacgagacaggaaatgtttcaataaaggaggaaaaagcagcatggcagaagtaaacgctgtggaaaagcagcctgttacccaagagtacctgaaaaaaatggacgcctattggcgtgcggcaaactatcttggagcagcacagttatatttactggacaacccgttattacgcgagccgttgacgatggatcatataaagaaaaagatcgtcggacactggggaaccgttccgggacagaactttgtatacgttcatttaaaccgtgtcatcaaaaaatatgatcaggatatgatcttaatttccggtcctggccacggtggaaacttttttgtggcaaatacatatttagagggaacttacagcgaggtatatccgaacatcggagaggatatggacggactgaaaaaactgtgtaaacagttttctttcccgggcggtatctcaagccatgttgcaccggaaactcctggttccatcaacgagggcggtgagcttggatattcactggcacactcttttggtgcggtatttgacaacccggatctggttgcagcatgtatcgtcggagacggtgagtccgagactggaccgcttgcaacttcctggcagtgcaacaaatttttaaacccgaaaacagacggtgcggttttaccgatcctgcatctgaacggatataagatcagcaacccgaccatcttagcacgtatttcccgtgaagaattagagcatttcttcgacggatgcggctggaaaccgtatttcgtggagggcgatgagccgatggatatgcacagcaagatggcggctgccttagatcaggcgatggatgagatcaaggcgatccagaaaaatgcgagagaaaatgatgatctgaccagaccgaaatggccgatgatcgtactccgcaccccgaagggctggacaggaccaaaggtagtggatggcaatcagatcgaaggctctttccgtgcacatcaggttccgatcatgatggacaaaccggaacatcttcagatgttaaaagactggctgttaagttatcatccggaggagctgtttgatgaggacggaaaactgattccggaattaaaggcattagcaccgaccggcgaccgcaggattggatcaaacccgcatgcaaacgggggtaaattactgcgcgatctgcgtctgcctgattttaaagattatgctgtggatgttccaaagccgggtgctgtggaagcgcaggatatgatcgaacttggcggatttgtcagagatattttcgagttaaatgaagatgcaaagaacttccgtattttcggaccggatgagacgatgtcaaaccgtcttggaaaagtatttgaggcaacgaaccgtgactggaacggtgaggcttatgatacggatgaattccttgcacatgacggacgtgtcatggactctatgttgagtgagcatatgtgtgagggatggttagagggatatctgttaaccggacgtcatggattctttgcaagttatgaggcatttatccgtgtggttgattccatgtgtgcacagcatgcaaaatggttaaaggtttgcaaccagcttccgtggagacagtccattgcatccttgaacctgattttaagctcgaatgtatggcagcaggatcacaatggatttacacatcaggatccggggttcttagaccacattgcaaataaaaaatcagacgtggtacgcctttatctgccgccagatgcaaactgtttattatcctgcttcgatcactgtatccgcagccgcaactatgtcaatgtgctcgtgacatccaaacatccgagacagcagtggctgaccatggagcaggcagtcaaacactgtacacagggtatcggcatctgggagtgggcaagcaacgaccagggcgaagagccggatgtagttatggcatgctgcggtgatacaccgacattagagacattggcagccgttacgatcttaagagaggcactgccggagattaagatccgtgtgatcaacgttgtcgatctcatgaaattagagccgaacacgaaacatccgcacggactcagcgatgcagaatacgatgcactctttaccaaagacaaaccgatcatttttgcattccacggttatcacacactgatccatgagctgacctaccgcagaaccaaccgcaacatccacgtttacggttatcaggaggaaggtacgattacaacaccgtttgatatgcgtgtacaaaacgaaatcgaccgtttccacttagtaaagaacgtcatcaaatatctgccacagcttggaaacagaggatcttatctggtacagcagatgaacgacaaactcgtagagcacaaacagtacatccacgagtacggtcaggatctgcctgaggtaagagactggaaatggaatctgtaa

SEQ ID NO: 208 - DNA, 2436 bp, Bacteroides capillosus ATCC 29799
atggctaagaccgcaaagcccgaatctaagcccgtacttaaatccgccgcccgtatgtcaaagcgggggccccttgatcaggagcagctacgcaagatggacgcctactggcgcgccgccaactatctgtccgtgggtcagctctacctgctggacaatcccctgctccgccagcccctcaagccggaacacctcaagcggcacactgtgggccactggggcaccgctccggggcagaactttatctacacccacctcaaccgggtcatcacccggaatgacctgaacatgatctacctggccggacccggccacggcggcgaggccgtggtggcacagacctatctggaggggacgtacagcgaggtgtaccccaacgtgggccaggacgaggagggcatgaagcggctcttccgccagttcgccttccccggcggcatccccagccatgtgggccccgaggcccccggctccatcaacgagggcggtgagctgggctactccctgtcccacgccttcggcgcagtgatggacaaccccgacctgattgccgcctgcgtggtgggcgacggcgaggccgagaccggccccctggccgccgcctggcagagcaacaagctcatcaatcccatcaccgacggcgctgtgctgcccatcttccacctcaacggcttcaagagcgccggtccctccatcttcggccggatcacccacgaggagctggagatgtacttcaagggctgcggctgggagccccggttcgtggagggggacgacgcgccccagatgcaccagaccatggccgccgctctggactgggcggtacgcgagatcagccgcattcaggagcacgcccgcacccagaacgaccccacccgtccccggtggcccatgattgtgttccgctcccccaagggctggacctgtcccgtgtctctggacggcttcccggtggagggcacctgcctggcccaccgcatccccttccccgccgacgccgcccaccccgagtacatcgccctgctggagtcctggatgcgcagctaccacccggaggagctctttgacgaaaacggacggctcatccccgagctgcgggagctggcccctgtgggcaaccgccgcatgggctccaacccccacgccaacggcggccaggtgctccgggacctccgccgccccgacttccgcaattacgcggtggacgtcccctcccccggcgaccacctgggcgaggacatgcaccagctgggcaagtacatgcgggatgtggtgcgcctcaacatggaggccagaaacttccgcatcttcgcccctgacgaggccaagtccaacgggctggagccggtctttgaagtcaccggccgccgctggaacacggatttcatcgacaacgacctgaacctggacaccgagggccgggtcatggacgccatgctctccgagcacatgtgccagggctggctggagggctacctcctcaccggccgtcacggcgcctttgtcagctacgaggccttcatccgcatcgtggattccatggtgtcccagcacgccaagtggctcaaggtggcctcccagctgccctggcggcaggatatcgcctccctgaactacgtgctggcctccaacgtgtggcagcaggaccacaacggcttcacccatcaggaccccggcttcctggaccacgtggccaacaaaaaggcggacgtggtgcggctctatctgccccccgacagcaactgcctgctgtccacctttgaccactgcatcaagagccgcaactatgtcaacgtgatcatcgcctccaagcacccccggccccagtggctcaccatggatcaggcggtgaagcactgcacccagggcatcggcatctggcagtgggcctccaatgaccagggcgctgagcccgacgtggtcatggcctgctgcggtgacacccccaccctggagactctggcggctgtgaccattctgcgcaagtatctgcccgagctccacatccgggtgatcaacgtggtggacctgatgaagctccagccccacacggagcacccccacggcctcaccgacgaggactacgacgcctacttcaccaccgacaagcccatcatcttcgccttccacggctatcccaccctggtgcacgaactgacctaccgccgccacaacaagaagctccacgtccggggctacaaggaagaggggaccatcacaacgccctttgacatgcgggtgcagaacgacatcgaccgctatcatctggtgatggataccgtcaaacgtctgccccagctgggcaaccgtggcgccttccttatccagctcatgcgggacaagctggtggagcaccggcagtatatcaccacctacggcgaggacatgcccgagatcaaggactggaagtggaacaacggcaggggaatggaataa

SEQ ID NO: 209 - DNA, 2508 bp, Phaeodactylum tricornutum CCAP 1055/1
atgaacgaaaagacttcctacaacgagaccaagacgcgaagaaaaactgttccatcagcctttctgatggtggatagatattggatggcatccaactaccttgttgttggacagatctatttaatggacaaaaatccactattgaagcagccgctcaaacctgaccatgtgaagtcgagactactcggacactttggtacctgcccaggtcagaactttatctacgtccacttaaaccgtatcatttgtgaacgaaaactcagcatgttttacgtttgtgggcccggtcacggcggccctgcgatgtttgctcaaacttaccttgagggctcgtttacagagcgctaccctgacatatcgaaggacgaagaaggtatcggaaaattgttcaagcaatttagtttccccggcggatttccgtcacacgcggcacccgagacacctggatccattcatgaaggaggcgaactgggctacagtttgtcgcatgccttcggcgcggtgtttgataagcctgatttgattgtggcttgcgtcgtcggggatggcgaagccgagactggccctttggctacgtcttggcactccaacaaatttttaaatcctgcaaaagatggagccgttttaccaatccttcatctcaatggttttaagattgcgaatccggtcgttttagctcgcataccagaggaagagttgctttctctttttcgaggctatgggtacaacccagtcattgtcgagggttctgatccggcggagatgcatccaaaattcgcggcagagctagactatgccgtggacactattctatcgatacagaaggaagcacgaactcatttagaagaggggctccagcttcgacgaccgacatggccagtaattcttctaaaaactccgaaaggctggacaggaccaagtgaagttgatggcgtcaagatcgaagggtcttacaaatcccaccaagtccctgtctcaaatccctcagaaaatttagagcacttagatattttggaaaaatggttaaggagttatcagccagaaaatgcattcgacgacaatgggaaattgctccccgagctacaagcactggttcctccacgacatctccgaatgggatccaacccctatacgaacccagttatttccccccttctcttacccagttacgaagcgtatggggtaaagattgacaaaaattcacgcgggaaagcgaaagcctccgatacttttaccttaggaacatatttgcgcgatgtgatcatcaagaatgttaagcacaagaactttcgaattttttcgcccgatgaaactgcgtcaaatcgccttcatgcagtgtatgaagccaccaacaagcaatggatgggctcgctgaatagcgacgatgatactcttgctgaccacggacgtgtgatagaaatgctctccgaacatcaatgcgaaggatggttggaaggatatctactcactggaggtcatggcctcttgaattcatatgaagcttttatccacatagtaagctccatgtttaaccagcatgcgaagtggctgaaaatctgcaaagaaactccgtggagaaacgagctctcaagccttaatattctcctttcgtcgcacgtttggcgtcaggatcacaatggtaaggcaattcctactgttcggtgttggatcgattcggatgctcttatccagtcttatctccttcaatttttcgtaggatttacacaccaagatccgggattcttgcagcatgtggctagtaagaaacccgggataattcgtatttatctgccaccggatgggaactgtcttctatcggtcatggaccattgtctctcctcgagacactacgtcaacatcgtggtagccggcaaacatccctcccatcaatggcttacgcctgcagaagcgagtgagcactgcacagagggaattggtatttggaagtgggcatcaaatgatataggtcgtgaacctgacataattgttgcttgtgcgggtgacgttccgacgctagaagctcttgccgcggtgtctattgttcgtaaaaaaatgccagagttccgtattcgatttatcaatgtcgtcgatctcatgaaattaaccaacacgagtcatcacccgcatggattgagcaatgaaaagtttgattcgctttttacaactgacaaaccagttttgttcgattttcatgcttatccagagctggtagaacagctaatattttgtagatcgaacagaaatttcactgttcgaggatacaaggaagaaggaacgatgagtacaccgttcgatggatgtgtgatgaacggagttgatcgcttccatctggtaattgatatatgcaatataattgagcaccattgcaggacggtgaccgaaaaaacccgttggcttgcaccttacgtcagtcaagacatgagacagctccttgccaaacacaaaaagtatatccatggcaacggtgttgatttggaagaggtggctgactgggagtgggaatgctaa

SEQ ID NO: 210 - DNA, 2355 bp, Rhodopseudomonas palustris BisB5
atgtttgacgtgctgtccgatgatttgatgcagaagatggacgcctattggcgggccgctaattatctgtcggtcggacagatctatcttcaggacaatccactgctcgaacaaccgctccggatcgagcacatcaagccgcgtctgctcgggcattggggaacgacgccggggctgaacctgctctatgtccaccttaaccgcctgatcagcgcgcacgacctcgacatgatctacatcatcgggccaggccatggcggcccgggtctggtggcgaattcgtatctcgaaggctcttacactgagcgctatccggcgatcgaacgcaatcgcaatgggctgcagcgtttgtttcgccagttttcctggccgaacggcgtgccgagtcatgtttcgccggaaacgcccggttcgattcacgagggcggcgagctcggctattcgctggcacacgcctatggtgcggccttcgataatcccgatttgatcgtcgcctgcatcgtcggcgacggagaggccgagacgggagcgctggcgacgagctggcactccaacaagtttctcaacccggcgcgggatggcgcggtgctgccgatcctgcatctcaacggtttcaagatcgccaatccgacgattcttgcgcggatcggccggcaggagctcaccgatctgatgcgcggttacggctacgagccgatcgtggtcgagggcgatgatcccaagcttgtgcatcatacgctcgccgcggcgctggagcgcgcactggccgatatccgcgcgatccaggccgcggcccgccatcaaggtgtaacggtgcggccgcgttggccgatgatcatcctgcgcacgccgaaggggtggactgggccaaagcaggtcgacggcaaacagatcgaggggacctggcgcgcgcatcaggtgccgatcgcaagtttcaaggacccgacgcacgtccagcttctggaaacatggctgcgcagctatcggccggaggagctattcgacgcctccggcaagttccgcgacgatctggcggcgctggcgccgaccggtcatcgccggatgagcgccaaccctcatgccaatggcggcgaactgctgcagccgctgtcgctgcccgacttccacgactatgccgtgacccaatccgggccggggacggtcaaggccgaggccacccgcgtgctcggcgcgttcttgcgcgatgtgatgaagtcgaatctcgacgccaagaatttccgtctgttcggacccgacgagacagcctcgaaccgcctggacgcggtcctcgaggtcaccgacaaggagtggatggcggagatcgaggatgtcgacgtcgcgctcggtcccgacggtcgggtcatggaagtgctgagcgagcatttgtgccagggctggctcgagggctatctgctgaccggacgtcacggctttttctcgtgctacgaggcgttcattcacatcgtcggttcgatgttcaaccagcacgccaaatggctgaagacgtgcgacgcgatcccgtggcgtcgcccgatcgcctcgctgaactatctgttgacctcccacgtctggcgccaggatcacaacggcctctcgcatcaggacccgggcttcatcgatcacgtcgtcaacaagaaggcgagcgtcgtccgggtctatctgccgccggacgcgaactgcctgctgtcggtggcggatcactgcctgcgcagccgcaactacgtcaatctcatcgtcgcaggcaagcagccggaatggcagtggctcgacatcgactccgcggtcaggcattgctcggccggcgccggaatctggcattgggcgagcaatggcgaggatgatcccgacgtggtgatggcctgcgcaggggacgtgccgacgttggagacgttggcagcggtgatgctgctgcgcgaatacgtgcccgacattcgcgtccgggtcgtcaacgtcgtggacctgatggtgctgcagccgagctccgaacatccgcacggcctcgatgacaagcgcttcgacgagattttcaccgtcgacaagcccgtggtcttcgcatttcacggctatccgtggttgatccaccgactgacttaccggcgacgcaatcacttcaacatccacgtccgaggttacaaagaagagggcagcacaacgacgccgttcgacatggtggtgctgaacgatctcgatcgttaccggctggccctcgacgcgatccgccggatcccgcgtctcgctggagaggtcgaggcggcgaccgcgcgatactgggcgacgatgcaacggcacaagctgtacatcggcgaacatggcgacgacatgcccgaggttcgcgactggagctggcaaggctga

SEQ ID NO: 211 - DNA, 2355 bp, Rhodopseudomonas palustris HaA2
atgtccgacgtgttgtccaacgatctgatgcagaagatggacgcctattggcgcgccgcgaactatctgtcggtcggccagatctatctgcaggacaatccgctgctggagcagccgctgcagctcgagcacatcaagccgcgcctgctcggccattggggcacgacgccggggctgaatctgctgtacgtccatctcaaccggctgatcaccgagcacgacctcgacatgatctacatcatcgggccgggccatggcggccccggtctggtggcgaattcctatctggagggctcctataccgagcgctatccggcgatcgaacgcaatcgcaacggcctacagcgtttgtttcggcagttttcctggccgcacggcgtacccagccacgtctcgccggagacgccgggttcgatccatgaaggcggcgagcttggttactcgctggcgcatgcctatggcgcggccttcgacaatccggatctgatcgtcgcctgcatcgtcggtgacggcgaggccgaaaccggcgcgctggcgacgagctggcattccaacaagtttctcaatccggcccgcgacggcgcggtgctgccgatccttcacctcaacggcttcaagatcgccaatcccaccgtgctggcgcggatcagccggcaggagctcaccgacctgatgcgcggttacggctacgagccgatcgtggtcgagggtgacgaacctgcgctggtgcaccatgcgctcgccgcggcgctggatcgggcgctcgccgacatccaggcgattcaggcggcggcccgtcaccagggcgtcaccgcgcggccgcgctggccgatgatcattctgcgcacgccgaagggctggaccgggcccaagcaggtcgacggcaagcaggtcgagggcacctggcgcgcccatcaggtgccgatcgccgatttcaaggatccggcgcatgtgcagcttctggaaacctggctgcgcagctatcggccggaggaattgttcgacgccaacggcaagttccgcgacgaactggcggcgctggcaccgaccggccattgccggatgagcgccaatccgcatgccaatggcggcgagctgctgcagccgctgtcgctgccggacttccgcaactacgcggtggcgctgtctgcgcccggtgcggccaaggccgaagcgacgcgggcgctcggcacgttcctgcgcgacgtgatgcgcgacaatctcgagacgaagaacttccgtctattcggtccggacgagaccgcctcgaaccgcctcgacggcgtgctcgaagtcaccgacaagcaatggatggcggacattgaggatgtcgacatcgcgctcggccccgacggccgggtcatggaggtgctgagcgagcatctgtgccagggctggctcgagggctatctcctcaccggccgccacggcctgttctcctgctatgaggcgttcattcacatcatcgattcgatgttcaaccagcacgccaaatggctgaaggcctgcgacgccattccgtggcgacgcccgatcgcctcgctcaactatctgctgacctcgcatgtctggcgccaggatcacaacggcttctcgcaccaggatccgggcttcatcgaccacgtcgtcaacaagaaggccagcgtcgtccgcgtctatctgccgccggatgcgaactgcctgttgtcggtggcggatcactgcctgcgcagccgcaactacgtcaacctgatcgtcgcgggcaagcagcccgagtggcagtggctcgacatcgacgccgcggtccggcattgcaccgccggcgctgggatctggcattgggcgagcaacgacgacggcgatcccgacgtggtgatggcctgcgccggcgatgtcccgaccgtcgagacgctggcggcggtgatgctgctgcgcgaatatgtaccggacatccgcatccgcgtcgtcaatgtcgtcgatctgatggtgttgcagccgagctccgagcatccccacgggctcgacgatcggcggttcgacgaactgttcaccgtcgacaagccggtggtgttcgcgttccacggctatccctggctgatccaccgactgacctaccggcggcgcaatcacttcaatatccatgtgcgcggctacaaggaggagggcagcaccaccacaccgttcgacatggtggtgctgaatgatctcgatcgctaccggctcgcgctggatgcgatccgacgaattccgaggcttgcggggcaggtcgaatcggcgaccgacaggtactgggctacgatgcagcggcacaagctgtatatcggcgagcacggtgacgacatgcccgaaatacgcgattggcgctggcaggcgtga

SEQ ID NO: 212 - DNA, 2352 bp, Rhodopseudomonas palustris CGA009
atgtccgacgtgttgtccaacgatctgttgcagaagatggacgcctattggcgcgccgcgaactacctgtctgtcggacagatctatctgcaggacaatccgctactcgatcagaagctgcagctcgaccacatcaagccgcgcctgcttggccactggggtacgacccccggcctcaatcttctctacgtgcatctcaaccggctgatcaccgagcatgatctcgatatgatctacattaccggtcccggccatggcgggcccggcttggttgccaacgcgtatctggaaggcacctacaccgagcgctatccggcgattgagcgcagccgcaacggcatgcagcggctgttccgacaattctcctggccgcacggcgtgccgagccacgtctcgccggaaacgcccggctcgatccacgagggcggcgaactcggctactcgctggcgcatgcctatggcgcggcgttcgacaatccgaatctgatcgtcgcttgcgtggtcggcgacggcgaggccgagaccggcgctctggcgacgagttggcactccaacaagttcctcaatccggcgcgcgacggcgcggtgctgccgatcctgcatctgaacggcttcaagattgccaacccgaccgtgctggcacggatcacgccgcaggaactcaccgacctgatgcgcggctatggctatgagccgcacttcgtcgaaggcgacgatccggcggtggtgcaccagacgctggctgcgacgctggaacgcgtgctcggcgagatccgggccattcaggacaaggctcgcaaccacggcgacaccgagcggccgcgctggccgatgatcgtgatgcggaccccgaaggggtggaccggccccaagcaggtcgacggcaagccggtggagggcacctggcgcgcccatcaggtgccgatcgcggacttcaagaaccccgagcatctgacgctgctcgaagactggatgcgcagctatcggcccgatgagctgttcgacgccaccggcaagctgcgcgacgagctgcaggcgctggcgccgaccggccgtcgccggatgagcgccaatccgcacgccaatggcggcgaattgctggagccgctgtcgctgcccgatttccacgactatgcggtgacgctgaccgggcccggcgcgctgaaggccgaggcgacgcgggtgctcggcaccttcctgcgcgacgtgatgaagaacagcctcgagagcgaaaacttccgcctgttcggaccggacgagaccgcatcgaaccggctcgatgcggtgctccaggtctcgccgaaggagtggatggcggcgatcgaggatgtcgacgtcgatctcagcccggacggccgggtgatggaggtgctcagcgagcatctatgccagggctggctcgaaggctatctgctgaccggccgccacggcttcttctcgtgctacgaggcgttcatccacatcatcgactcgatgttcaatcagcacgccaaatggctgaaggcgtgcgccacgatcccgtggcggaagccgatcgcgtcgctgaactatctgctgacctcgcacgtctggcgccaggatcacaacgggttctcgcaccaggatcccggcttcatcgaccacgtcgccaacaagaagtcgaacgtggtgcggatctatctgccgccggatgccaactgtctgctgtcggtggccgaccactgcctgcgcagccgcaactacgtcaacctgatcgtcgccggcaagcagccggaatggcagtggctggatatcgacgccgccgttcggcactgcaccacaggagccgggatctggcattgggccagcgacgagggcgagcccgacgtggtgatggcctgcgccggcgacgtgccgacggtcgagacgctggcggcggtcaagctgctgcgggagtacgtgccggacatcaagatccgtgtcgtcaacgtggtcgacctgatggtgctgcagccgagctccgagcatccgcacggcctggacgaccgccgcttcgacgagctgttcaccaccgacaagccggtgatcttcgccttccacggctatccgtggctgatccaccggctgacctatcgccgccgcaaccacgtcaacatccacgtccgcggctacaaggaagagggcaccaccaccacgccgttcgacatggtggtgctgaacgatctcgaccgttatcgcctggcactcgacgccatcctgcggattccgcggctcgccgatcagcgcgatgccgccacctcgcgctactgggcgacgatgcagcggcacaagctgtatatcggcgaacacggcgacgatctgccagaggttcgcgactggcgctggtcggcctga

SEQ ID NO: 213 - DNA, 2355 bp, Rhodopseudomonas palustris BisB18
atgcctgacccgttaacgtcggatctcctggaaaagatgcacgcctactggcgcgccgcgaactacctgtcggttggccagatctatcttcaggacaatccgttgctggaggtgccgctgaggctcgaccacatcaagccacggctgctcggccattggggcaccacgccgggactgaacctgctctatgtccacctcaaccggctgatcaagcagcacgatctcaacatgatatacatcatcggtcccgggcacggcggccccggtctggtggcgcagagctatctggagggctcttataccgaacgctatccggcgatcgagcgtagccgcaacggtatgcagcggctgttccggcaattctcctggccgcacggcattcccagccacgtctcgccggaaacccccggttcgatccacgaaggcggcgaactcggctattcgctggcgcatgcctatggcgcggcgttcgacaatcccgacctgatcgtcgcctgcatcgtcggcgacggcgaggcggaaaccggcgcgctcgccagcagctggcattccaacaaattcctcaacccggcgcgcgacggcgcggtgctgccgatcctgcatctcaacggcttcaagatcgccaatccgaccgtgctggcgcgcatcggccgggtggaactcaccgagctgctgcgcggctacggctacgagccggatttcgtcgagggcgacgatcccgccatcgtgcaccagctgttggccggcacgctggaccgcatcctggcgcagatccgccacatccaggatgaggcccgcaatcacggcgtcaccgcgaggccgcgctggccgatgatcgtgctgcgcaccccgaagggctggaccgggccgaaattcgtcgacaacctgccggtcgagggcacctggcgcgcgcaccaggtgccgatcgcggatttcaaggcgcccgagcatctcaagctgctcgaggactggatgcgcagctaccggccgcaggacttgttcgatgacaatggcaagctgcgcgacgagctggtcgcgctggcgccgaccggccaccgccggatgagcgccaatccgcacgccaacggcggcgagttgctgcagccgctgtcgctgccggatttccacgattacgccgtgacgctgccggcgcccggcgcggtgcgggcggaatccacaagggtgctcggcaagtatctgcgcgacgtgatgaaggccaatctggagtcgcagaatttccggctgttcggccccgacgagaccgcgtcgaaccggctcgaggcggtgttcgaagtgtccggcaaagaatggatggccgaggtcgagcacgtcgacatcaacctcagcgtcgacggccgggtgatggaagtgttgagcgagcatctgtgccagggctggctcgagggttacctgctgacgggccgccacggcctgttctcctgctacgaagccttcatccacatcatcgattcgatgttcaatcagcacgccaaatggctgaaggtgtgcgccacgatcccgtggcgcaagccgatcggctcgctgaactaccttttgacgtcccatgtctggcgccaggaccataacggcttctcgcatcaggatcccggcttcatcgaccacgtcgccaacaagaaggccgacatcgcccggatctatctgccgccggatgccaactgcctgttgtcggtgaccgaccattgcctgcgcagccgcaactacgtcaacgtcatcgtcgccggcaagcagccggaatggcagtggttggacatcgacgccgcggtgcgccactgcaccgccggcgccgggatctggcgtttcgccagcaacgacgccggcgatcccgacgtggtgatggcctgcgccggcgacgtgccgaccgtcgaggcgttggcggcggtgaaactgctgcgggagtacgtgccggacattcgcgtccgcgtggtcaatgtggtcgacctgatggtgttgcagccgcgcagcgagcatccgcacggcctcgacgaccgcggcttcgacgaattgttcaccaccgacaagccggtgatcttcgcgttccacggctatccgtcgatgatccacaaattgacctaccggcggcacaaccaccacaacatccacgtccgcggctacaaggaggagggcaccaccaccacgccgttcgacatggtggtgctgaacgacctcgaccgctatcggctgacgttggacgcgatcctgcggatcccgcggttgagcggccagcgcgaggcggcgaccgcgcgctactgggacagcatccagcgccacaagctgtatatcggcgagcatggcgacgatctgccggagatcgtcgattggcgttggacggcgtaa

SEQ ID NO: 214 - DNA, 2373 bp, Polaromonas naphthalenivorans CJ2
atgacgaccctgacccccgacctcctgcgcaagatgcacgcctggtggcgcgctgccaactacctctcggtggggcagatctacctgcacgccaacccgctgctcgaagagccgctgaccctggcacacatcaagccgcgcctgctcggacattggggcaccacacctggcctgaacttgctgtacgtgcacctgaaccgcctgatcagggagcacgatctggacatgatcaatgtcatcggccccggccacggcggacccgggctggtggcgagtacgtacctggaaggcacttacaccgaaacctatcccgacatctcgcgcgaccgggacggcatgcgcaagctgtttcgccagttctcgtggccgggaggcattccaagccacgtggcgccggaaacgccgggctcgatccacgaaggcggcgagctgggctactcgctggcgcatgcgtatggcgcggcattcgacaaccccgatctgatcgtggcttgcatcgtcggtgacggtgaagcagaaaccggcgcgctggcgacaagctggcattcgaacaagttcttgaacccggcgcgcgatggcgcggtgctgccaatcctgcacctcaacggcttcaagatcgccaaccccaccgtgctggcgcgcatcggccgggaggatctgacggccttgctgcgaggctacggccacgagccgcacttcgtggtcggcgacgatccgatgacggtgcaccagcaactggcgcagacgctggatgccgtccttgcgcagatccacaccattcaggctgccgcgcgtgcgccgcatgcgcccataccggcgtcacttccgcgctggccgatgatcgtgttgcagacgcccaagggttggaccggccccaaggaggtcgatggcctgccggtggaagggacgtggcgggcgcaccaggtgccgatcacgcagttcaccaacgccgagcacatccgccagctcgaagactggatgcgcagctatgcgccgcaggaactgttcgacgccaatggccgcttccgcgaagaattcgcagcactcgcacccaccggcaacaggcgcatgggcgccaatccgcatgccaacggcggtgcattgctcgcaccgctggtcatgccggacttccgcgacttcgcggtgccggtttcggtgccaggcggcacgatgggtgagtccacgcgcgtgctcggaaccttcctcgccgaggtgatgcgcaggaacaccggtagcgccaacttccgcctcttcgggcctgacgaaactgcatccaaccggctcggtgcggtggtggaagtcgccggcaaggcgtggatggccggcatcgacgcggtcgacctcaatctttcagccgacggccgggtgatggaagtgctgagcgaacacctgtgcgagggctggctcgaaggctatctgctgaccgggcgtcatggcctgttctcgtgctacgaggcgttcgtgcacatcatcgactcgatgttcaaccagcatgccaagtggctggaggtgtgccggcagattccgtggcgcttgcccatcgcgtcgctcaactacctgcttacctcgcatgtctggcagcaggaccacaacggcttttcgcaccaggacccgggcttcatcgatgtggtggcgaacaagaaagccgacgtggtgcgcatctatctggcacccgacgcgaactgcctgctctcgattgccgaccactgcctgcgcagccgcaactacgtgaacctgatcatcgccggcaaggcaccggcgttgcagtggctcgatatcgagtcggccgcacaccactgcgcagtaggcgccggcatctggccgtgggccagcaacgattccggtgatgcccaaggtgggcccgatgtggtgatggcctgcgccggcgacgtgccgacgctcgaaacgctggctgccgtcgcgctgctgcgcgggtatgtgccggacatccgcatccgtgtcgtgaatgtggtcgatctgatggcattacagccgcaatccgagcatccgcacggcctggacgatgacgcgttcgatgccatgttcacgctggaccggcccgtcgtgttcgccttccacggttaccccgggctgatccaccgcctcacctaccgccgccacaaccacgacaacctgcatgtgcgcggctacaaggaagaaggcacgacgaccacggcgttcgacatggtggtgctgaacaacatcgaccgctatcagctggcgctcgatgccatacgccgtatcccgcgactggcgcatcttgtggacgacgccacccggcgatatgaggcgagcatcacgcggcacaaggcctacatcagcgaacacggtgaggacttgccggaagtgcgtgactggcgctggccagcatga

SEQ ID NO: 215 - DNA, 2361 bp, Stigmatella aurantiaca DW4/3-1
atgtcgggtccgctgagcgaagaggagctggggaagatcgacgcctattggcgcgccgccaactacctgtccgtggggcagatctacctcaagaacaacccgctgctcgagcggcccctcaccctcgaggacatcaagccccgcttgctgggccacttcggcacgacgcccgggttgaacttcatctatgtgcacctgaaccgcatcatccgcctgcatcaggccaacatgatgtatttgattggccccggccatggcgcccccggcatcatcgccaacaccttcctggaaggctcctatacggagacctatcccaacatcgagcgcaacgccgatgggctcaaacggctgttccgccagttctcctggccctatggcgtccccagtcacgatgctcccgaggtcccgggctccatcagcgagggcggtgagctgggctactccctgcttcacgcctatggcgccgcctttgacaacccgggcctcatcgtcgcctgtgtcgtcggagatggtgaagccgagacaggcccccttgccgcgagctggcactccaacaagttcctcaaccccatcaccgatggggccgtgctccccatcctccacctcaacggctacaagatcgccaaccccaccctgctcgcgcgcatcgaccccgatgaactcgacgccctcttccggggctatggctatcgcccctatttcctcgaaggcgatgacccccggacgatgcaccaacagatggccgcggtgctcgataccctctatgccgagatccgcgccctccagcaccaggcccgcgagcagaaggatccgtcccgccctcgctggccgatgctgatcctcaagacccccaaggggtggacctgccctcgcaccgtcgacggcaagcccgtcgagggcacctggcgcgcccatcaggttccgctctcggaggtgcactcgaaccccgagcacctccggctcctcgaagagtggctgcgcagctaccggccccaggagctgttcgacgcccacggcaccttccgggaagcgctggcggacatcgctcccaagggccgcctgcgcatgggcgccaaccttcacgccaatggcggcaagctcctggtgcccctcgtcctgccgaacttccgtgactacgcggtgcccctcgacgtgccgggctcggtccagctgagcgccacccaggtgctgggcggctacctgcgcgacgtcatgcgcaagaacctcggggcgaacaacttccgcatgttcgcccccgacgagaacgcctccaaccggctccaggccgtctacgaggccagcggcaagcggtggaacgcccgctacgaagacgtggatgagtccctctccaccgaaggccgcgtgatggaggtgctcagcgagcacctgtgccagggctggctcgagggctatctgctcaccggccgccacggcttcttctcttgctacgaggcgttcatccacctcatcgactcgatgttcaaccagcacgccaagtggatcaaatccgccaaggagctgccttggcgtgcccccatcgcctcgttgaactacctgctgagctcccacgtctggcgccaggaccacaacggcttctcccaccaggatcccggcttcatcgaccatgtggccaacaagaaggccgacacggtccgcatctatctgcccccggatgccaacacgctgctgtccgtcaccgaccactgtctgcgctcgaaaaactatgtgaacctcatcatcgccgggaagcaggccgcccccgtgtggctcgaccgcgagagcgccgtgcgccactgcgcggccggcattggcacctgggactgggcgagccacggcgagggcgaacccgacgtggtcatggcctgcgccggggatgtgcccaccctggaaaccctggccgcggtgaccgtgctgcgcgagtgggcgcccgagctgaaggtgcgggtcatcaacgtcgtggacctcttcacgctggagaccgtgggcgagcacccgcatgggttgaaccatgaagacttcaaccgcctcttcaccttggacaagcccgtcatcttcgcgtttcacggctatcccaccatcgtgcacaagctcacgtacaagcgggtgaaccacggcaacatccacgtccacggctacaaggaagaggggaccaccaccacgcccttcgacatgaccgtgctgaacgacatggaccgctacaccctcgcgctcgacgccatccgccaggcgcccgccgcgcgccaccggctcgacgcggccgagcagcggtactcggaggtcagccagcgccacaagctctacgtctccgagcacggcgaggacatgcctgaagtcaaaggctggaagtggaccgcccgatga

SEQ ID NO: 216 - DNA, 2376 bp, Pseudomonas putida F1
atgagtgatttccccggtactgaagagctcgaaagcctggacgcctattggcgggcggcgaactacctcaccgttggccagatctatctgcaaggcaatgccctgttgaccaggcccttgaccttggccgatgtcaaacctcggctgctgggccactgggggacgtccccggggctcaacctcgtctatacccatctgaaccggttgattcaccagtacagcctcaatgtgctgttcgtcacggggcctggccacggcggtcctgccctggtcgctcaggcatacctcgacggtacctacaccgagctcaacccatcggtcgagcgcaacgcacttggaatggcccggctctttcggcagttttcctggccttatggcattggcagccatgtcggcccccatgtgcctggctccattcacgaagggggcgaactgggctattcgctggcccatgcctatggtgccgccctggacaatccgcaactgatcgtggcgtgcgtcattggtgatggtgaggccgaaaccgggccactggctgccagctggcactgcaacaagttcctcaaccccgcccgcgacggcgcggtgctgcccatcttgcatctgaacggttacaagatcgccaaccccagcgtgctgtcgatgatcagcgaggaggagctgaccagcctcatgtatggctatggctatgatccgtattttgtcgagggtgacgagccgatggaggtccatcgcgcgttggccaggacgctggatgtcatctacgagaagatcagccagatccagcgcctcgcgcggtatgccgaagacccgcaggtggtcgacaggcccttgtggccggtgctgattcttcgtacccccaaagggtggacggggcccaggtacgtggatgggcaacgcgtagagggcacctggcggtcccatcagttgccgttggcggacctcgacaaaccgccgcacctgatgcagctgcaacaatggctggaaagttaccgtccccatgagctttttgacgcacagggtacgttgttgcctgagctggccgcgctgaccccaactggccggcgacgcatgagcgcgaacccccatgccaacggcggtctcttattgcgggccctggatttgccgcactacgccgattactgcgtgccgatgccgggccctggtcaggtgcgggccgaggcgaccagagtgctgggtggttatgtacgcgatgtcatgaagaacagccttgcgtcgcagaatttccgcctgttcggccctgacgaaacggcgtccaaccgtctggatgcggtatttgaggtgaccgacaaggtgtggctggatgctcgggccagcgatgatagacacctttcggcacaggggcgggtcatggagatcctcagtgagcacatctgcgagggctggcttgaggggtacctgctgacgggccgccatggcctgttttcctgttacgaagctttcatccatatcgtcgattcgatgatcaaccaacatgccaaatggctcaagacagctgccgaggtgccgtggcgcaagccgatcgcctcattgaatatcctcctgacttcgcatgtctggcggcaggaccataatggtttctcgcaccaggacccgggcttgctcgacctgctggcaaacaagaaggccaaccttgcgcggatctatctgccacctgacgccaactgcctgttgtcggtggctgagcattgcctgcgcagccgtgggtacatcaatgtgatcgttgccggtaagcagatggagtggcaatggctcgattgcgaagcggccgccgtgcactgccaatcaggtatcgggcgctggggctgggcctgccatgatgacgagatgcccgaggtggtgcttgcctgcgcgggcgatgtgccgacactggaggtactggcggcggttacactgctgcaagagcaggctccagacgtgcgtgtgagggtggtgaatgtcgttgacctcatggcgctgcaactgtcgcaacagcaccctcacgggctgtccgacagcgatttcaacgggctgtttaccgaagatcgaccggtcatctttgccttccacggctatccggcgctcatccaccgcctgatctacaaacgcgccaatccgcaacggtttcatgtccggggctttcgcgaagagggcgcaaccaccacgccattcgacatggcagtcatcaacaatctggaccgctaccagctgctgctcgatgtgttcgagcgcgtgccacgtttgcagccccagctcgaacaggcccgcgcccgctattgggccacgatggagaagcacaagctctacctcatcgaacatggcgaagacatgcctgaagttgcgcaatggcgctggacatcagcgtcgcgtgcctga

SEQ ID NO: 217 - DNA, 2436 bp, Arthrobacter sp. FB24
atggccaacgccctcggtggggacacagtcagtgacaccacaacgaatgacgtgaggacagaggtagacagcagcgacctggggctcgtgcaccgctggtggcgggcggccaactacctgtccgtgggccagatctacctccgctccaacccgctgctgcgcgaacccctccgcgcggaggacaccaagtccaggctcctgggccactggggcaccacccccgggctcaacttcgtctacgcccacctcaaccgggtcatccggcgggaccggcaggagatgttgttcatcgccgggcccggccacggcggtcccgcggtagtggccaatgcttggctggagggcacctactcggagatctacagcaacgtgggcaacgatgaagcggggcttgcggagctgttccggcagttctcctacccgggcggcatccccagccacgcggctcccgagactccgggctccattagcgagggcggtgaactcgggtattccctggcgcacgcctacgggtccgtcttcgacaatcccaagctgattaccgccgtcgtgatcggtgacggcgaggccgaaaccgggccgctggcggccagctggcactcgcacaacttcctggaccccgtggctgacggtgccgtgttgcccatcctgcacctgaacggctacaagatcgccaatcccacggtcctggcccggatgccggaggcccagctcgaacagctgctccgcggctacggccacacaccccatttcgtcaccgtggaggacccggacgatttcgagggggcccaccgcgacttcgccgcggccgtggacacctgcctcgccgaaatccgcgccatccaggccgagcgccgcgccgccgggactccgtcggcagacgaggcaggggccccccaatggccgatgatcgtactgcgttcacctaagggctggaccggccccaagcaggtggacggcaaacaggtggaaggcacctggcggagccaccaggtgccgctgtccgaggtccgcaccaacccggagcacctggcgcagctggaacaatggctccagtcctaccggcccgaggaactcttcgacgacggcggacgtctgcggcccgacgtcgcgcaaaacgctccggcgggggaattgcgaatgagtgccacgccgtacgccaacggcggcatcctgctgcgcgacctcaagctgccggactaccgcaagcacgccgtcgaggtgccccggccgggcgttgagcgggtcagcgccatgctcaccctgggtggctggatgcgggacgttattgtccaaaaccctgagactttccggcttttcggccccgacgagacggcgtccaaccgcctgcaggacgtctacgacgtcacggacaaagtgtggcagtaccggatcgacgacgccgatgaacaccttgcgcgcgccggccgcgtgatggaggtgctcagcgagcacctgtgccagggctggctggaaggctacctgctgaccggccggcacggagtgttcagctgctacgaggccttcatccacattgtcgactcaatgttcaaccagcacgccaagtggctcaaggtccaccgggagctcgcctggcgccagccggtcgcatcgctgaactacgtcctgtcctcgcacgtctggcagcaggaccacaacggcttctcgcaccaggatccgggcttcatcgaccacgcagtgaacaaaaaggccgaggtcatccgtgtgtacctgccgccggacgccaacacgctgctgtccgtaatggagcattgcctggcgtcccgggactacgtcaatatcgtagtcagcggcaagcagccctcacccacctggctggggccggccgacgccgctcaccactgccaacggggactgggcatctgggagttcgccggctcggaggtgccgggggaggagcctgacgtggtcctcgcctgcgccggcgacgtacccacggtggaaaccgtggcggcggccgaactgctcaagaacggtgcgccggggctgaagatcagggtggtcaacgtagtggatctgatgcggctccaggacgccagcgaacacccccacgggctgacgtcacgcgattttgacggcatcttcactgcggacaagcccgtcatcttcgcttatcacggctacccgtccctgatccaccggctggcgtaccggcggaccaaccaggaaggcctgcacgtccggggatacaaggaagagggcaccaccacgacggcgttcgacatggccatgctcaacgggatcgaccgcttccagctggccatcgacgcgatcgaccgggttcccggcctggcggagcggcactccctgctgcgccagtcgctgcaggacagccgcatccgggcgcacaaccacacacgcagccacggcgaagaccaggccgagatcagcgactggacgctcggcggcgggtga

SEQ ID NO: 218 - DNA, 2463 bp, Arthrobacter chlorophenolicus A6
atgaccggcagcactgggaatgacgtcaagggaaacggcaacgcggggcaggcgaccgctgaacagggcaccctgggacgcggggaactcgagctcgtggaccgctggtggcgcgccgccaactacctgtccgtcggccagatctacctgcgctccaacccgctgctgcgcgaaccactgaagccggaggacaccaagtcccgcctgttgggccactggggcaccactcccgggcttaacttcgtgtacgcccacctgaaccgcgtcatccgccgcgacgctgccgagatgctctttattgccggtcccggccatggcggccccgccgtcgtcgccaacgcctggctggagggaacgtattcggagatctacggccacgtgggcaacgacgaagccgggctcgcggaactcttccgccagttctcctaccccggcggcatccccagccacgcggcgccggagagcccggggtccatcagcgagggcggcgaactcggctattccctggcccacgcctacggctcggtgctggacaacccgcagctggtgaccgccgtcgtgatcggcgacggcgaggctgaaaccgggccgctggcagccagctggcactcgcacaatttcctggacccggcggcggacggcgccgtgttgcctatcctgcacctcaacggctacaagatcgccaaccccacggtgctcgcccggatgccccaggaacagttggagcagttgctgcgcggctacgggcacgaaccgtacttcgtcacggtgcaggatccgggcaagaccggtcaggcgcaccaggatttcgccggtgtcctggaccaatgcctcgcggacatccgcgccatccaggctgaacaccgcggcgccggagacgtccacaacggggccggggacggcacctccggagaccacccgggacaccgctggcctatgatcgtcctgcgttcgccgaagggctggaccggtccgcggaccgtggacgggctgcaggtggaagggacctggcgcgcccaccaggtcccgctgtccgaggtccgcaccaacggcgaacaccttaaacagctggaggagtggctgcagtcctaccgtccggaagaactgttcgacggcgacgggcggctccgtgcggccgtcgccgaggcggccccaacaggggacttccggatgagtgccaccccgcatgccaacggcggagtgctgcggcgcgccctgaagctgcctccctaccgggactacgccgtcgaggtggaagcagcaggaactgagcgagtgagccccatgatcacgctgggctcgtggatccgggacgtgatcgcgcagaacatggagaacttccgcctgttcgggccggatgaaaccgcatcgaaccggctgcagaacgtctatgaggtcaccgacaaggtgtggcagtaccggattgacgacgccgacgagcaccttgccaggtccggccgcgtcatggaggtcctcagcgagcacctgtgccagggctggctggaaggctacctgctcaccggcaggcatggagtcttcaactgctacgaggccttcatccacattgtcgactcgatgttcaaccagcatgccaagtggctgaaggtgcaccgcaggctgccgtggcgccagccggtgccctcgctgaactacctgctgtcctcgcatgtctggcagcaggaccacaacggcttctcgcaccaggacccggggttcatcgaccacgcggtgaacaagaaggctgaggtcatccgggtgtacctgccgccggacgccaacaccctgctgtccgtcatggagcactgcctggcgtccacggactgcgtgaacgtagtggtcagcggcaagcagccctcgcccacctggttgggcccggcggacgcggccaaccactgccgccgcggcctggggatctggacgttcgccggctccgaggtggcgggcggggagcccgacgtcgtgctggcctgcgcgggcgacgtccccaccgtggagaccgtggccgccgcggaacttctgcgaaacggggtcccggggctgaaggtccgcgtggtcaacgtggtggacctgatgcgcctgcaggacgagagtgaacacccgcacgggttgccgggcagggacttcgacggcatcttcaccactgacaagcccatcattttcgcgtaccacggctaccccgcgctgatccaccgcctggcgtacaagcgcaccaaccaggagggcctgcacgtgcacggctaccaggaggaggggacaaccaccaccccgttcgacatggccatgctcaacggcatcgaccgcttcacgctcgccatcgacgcgatcgaccgggtgccaggcctggccgagaagtactcactcctgcggcaggaactgcaggaccgccgcgacagcgcccgcgaacacacccgcacgcacggcgaggacccggaggagatccgcaactggaaactgggcggctga

SEQ ID NO: 219 - DNA, 2526 bp, Sanguibacter keddieii DSM 10542
ttggagatcgtcatgtcacgctctgctcacggtgagaccactcggacgaacacccacgctctctcggacgcctggcgcccgcggcccgacgagcctctcgacgacgagacgctccgtcgcatcgacgggtggtggcgcgctgccaactacctgtccatcggccagatctacctgctgtccaacccgctgctgcgcaccgagctcacgcgcgacgacgtcaagccccgcctgctcggccactggggcacgacccccggcctcaacttcctctacgcgcacctcaaccgcgccatccgcgagcgcagcctctcgacgatgtacatcaccggcccgggccacggcggcccgggcctcgtcgcgaactcctacctcgagggcacctacaccgagacgtacccggacatcacccaggacgacgagggcctgcgccgcctgttccggcagttctcgttcccgggcgggatccccagccacgtggcgccggagacccccgggtcgatccacgagggcggcgagctcggctacgcgctgtcgcacgcctacggcgcggccttcgacaacccggacctgctcgtggccacggtggtcggcgacggagaggccgagaccggcccgctcgcgacgagctggcactcgaacaagttcgtcaacccggtgaaggacggcgtcgtcctgccgatcctgcacctcaacgggtacaagatcgccaacccgacggtgctggcacggatctcggacgacgagctcgagtcgctcatggtcgggtacggccacaagccgcacgtgttcgtcggcggcttcgacgacgaggaccacgtctcggtccaccggcggttcgcggtgctcctcgacgaggtgctcgacgagatcgccgcgatcaaggcccgggccgcggacggcgacgactcgcgcccgatgtggcccatgatcgtcttccgcacccccaagggctggacctgcccgcccgagatcgacggcaagaagaccgaggggtcgtggcgcgcccaccaggtgccgctcgcgagcgcgcgggacacgcccgagcacctcgaggtgctgcgcggctggctcgagacctaccgggcgcacgagctcttcgacgaggacggacgcctcgtcgacgacgtcgcggcgctcgcccccgagggcgcgctgcggatgagcgcgaacccgcacaccaacggcgggctgctcctcaaggacctgcgcctgccggacttccgcgacttcgcggtcgaggtcgagaaccccggcggctcgatcaccgaggccaccaaggtgctcggccagtggctcacggaggtcgtgcggctcaacccggacaacttccggatcttcggacccgacgagaccgcgtccaaccgcctccagccggtgttcgaggtgacggacaagcagtggaacgccgactacctccccgaggacctcgacgaccacctggcccgcgccggacgcgtcatggagatgctgtcggagcaccagtgccagggctggctcgagggctacctgctcaccggtcgccacggcctgttcagctgctacgaggcgttcatccacatcatcgactcgatgttcaaccagcacgccaagtggctgaagatcacgcgcgagatcccgtggcgccagccggtcgcctcgctcaactacctgctgtccagccacgtgtggcgccaggaccacaacgggttctcgcaccaggacccggggttcatcgaccacgtggtcaacaagaaggccgagatcgtccgcgtgtacctgccgccggacgccaacaccctcctgtcgacgtacgaccactgcctgcgcagccgcgactacgtcaacgtggtcgtcgcgggcaagcagccggccccgaccttcctcaccatggaccaggcgatcgcgcactgcacccgtggtctggggatctgggagtgggcgggcagcgaggtcgagggcgaggacccggacgtggtcctcggctgcgcgggtgacgtcccgacgctcgaggtcctcgccgcggccgacctgctccgccagcacctgcccgagctcaaggtgcgcgtcgtcaacgtggtcgacctcatgcgtctgcaggacgagaaggagcacccgcacgggctctccgaccgtgacttcgacaccctcttcaccacgaccaagccggtcgtcttcgcctaccacgggtacccgtggctcatccaccgcctcacctaccgccgcgccggacacagcaacatccacgtgcgcggctacaaggaggagggcaccacgaccacaccgttcgacatggtcatgctcaacgacctcgaccggttccacctcgtcatcgacgtcatcgaccaggtcccgcacctgggcagccgggccgccgtgctccggcagcagatggttgacgcgcgcctgcgggcgcggcagtacaccagagaccacggggaagacctccccgaggtccgcgactgggtgtggcccgacgcgggcgacaccgcgacccaggtgggcgggccacaggccgccaccgcagccactggaggcgacaacgagtga

SEQ ID NO: 220 - DNA, 2475 bp, Beutenbergia cavernae DSM 12333
atgacgacgacggcggatcccgccaccgcgtggcggctcggctcgggcgagggtgtgagcgaggagactctggagcgcgtcgaccgctggtggcgcgcggcgaactacctgtcggtgggccagatctacctgctcgcgaaccccctgctgcgcacgccgctcacgcgggacgacgtcaagccccggctcctcggtcactggggcacgacccccggcctgaacttcctgtacgcgcacacgaaccgcgcgatcgtcgagcgcgacctcgacgccatctacatcgccgggccgggccacggcgggccgggcctcgtggcgaacacctacctcgatggcacgtacagcgaggtgtactcccacatcaccccggacgaggaggggctgcgccagctcttccggcagttctccttccccggtggcgtgcccagccacgtcgcccccgagacgccgggttcgatccacgagggcggcgagctcggctacgcgctctcccacgcctacggtgccgtgttcgacaaccccgagctgctggtgctcgccgtcgtcggcgacggcgaggccgagaccggcccgctcgccaccagctggcactccaacaagttcgtcaacccggcgcgcgacggcgtcgtcctgcccgtcctgcacctcaacggcttcaagatcgcgaacccgacggtcctcgaccggatcaccgacgacgagctcgtcgccctcatgcgggggtacggccacgagccgtacctgttcgtcggcgggttcgacgacgaggaccacctcacggcgcacgcgcggttcgcgacgctgctggacgaggtgctcgacgacatcgccaggatcaaggaacgcgcgcgtgccggtgacctgacccgtccgcgctggccgatgatcatcttccgcaccccgaagggctggacctgcccgcccgagatcgacggcaagcagaccgagggctcctggcgggcgcaccaagtgccgctcgcgaacgcacgggacacgccggagcacctcgacgtgctgcgcggctggctcgagtcgtaccgggcggaggagctgttcgacgccaccgggcgactggagccggacatcgcgcagctcgccccgcacggtgagcgccggatgggtgcgaacccgcacgccaacggcggcctgctcacccgtgacctccgcctgcccgacttccgcgggttcgccgtcgacgtcccgacgccgggcggcgccatcgccgaggcgacgaaggtcctcggcgagtggctgcgggaggtcatccgcgccaaccccgacaacttccgcatcttcggaccggacgagacggcgtcgaaccggctctccgccgtctacgacaccacgagcaagcagtggaacgcggagtaccgcccgatcgacgacgacgaccacctggcccccgagggtcgcgtcatggagatgctgtccgagcaccagtgccagggctggctcgaggggtatctgctgaccggacggcacggcctgttcaccagctacgaggcgttcatccacatcgtcgactcgatgttcaaccagcacgcgaagtggctcaaggtgacgcagcgcatcccgtggcgtcggccgatcccgtcgctcaactacctgctctcgagccatgtgtggcgccaggaccacaacggcttcagccaccaggaccccgggttcatcgaccacgtgatgaacaagaaggccgagatcgtgcgcgtctacctgccgccggacgcgaacacgctgctgagcacgtacgaccactgcctccgcagtcgcgactacgtcaacgtcgtcgtcgccgggaagcagcccgcgccgcagttcctcacgatggagcaggcggtcgcccactgcacccgcgggctcgggatctgggagtgggcaggcacggaggtcgacggcgaggacccggacgtggtgctgggctgcgccggcgacgtgccgaccctcgagacgctggccgccgccgacctgctgcgccggaacatcccggacctcaaggtgcgtgtcgtcaacgtcgtggacctcatgcggctgcaggacgagcgggagcacccgcacggactgtcggaccgggacttcgacggtctgttcaccgacgacaagcccgtcgtcttcgcctaccacggctacccgtggctcatccaccgcctcacgtaccggcgggcgggccacgcgaacatccacgtccgcgggtacaaggaggagggcacgacgacgacgccgttcgacatggtcatgctcaacgacctggaccgctatcacctcgtcatcgacgtcatcgaccgcgtgcccgggctcggctcgcagtacgcggggctgcggcagcggatggtcgacgcgcggctcgcggcgcgccagtacacgcgcgagcacggggaggacatcccggaggtgcgggactgggtgtggccggacgccggcgacgccgtgggccaggaggcggccgccgcgctcgacacgggcggggacaacgagtag

SEQ ID NO: 221 - DNA, 2433 bp, Jonesia denitrificans DSM 20603
atgtctgaactcaccgacgagaccctcacaatcattgaccggtggtggcgcgcagccaactacctctcagtcgggcaaatctacctgctcgacaacccgctgctccgcacgccactgagccgcgacgatgtgaaaccccgtctcctcggccactggggaacaaccccaggcctcacgttcctctacgctcacctcaaccgggtgatcaaggaacgtcaacaatccaccctgtacatcacgggacccggccacggaggcccaggactcgttgcaggtgcctaccttgacgggacgtactccgagatctactcggacatcaccgaagacaccgaagggctacaaaaactgttcaaacagttctccttccccggtggtatcccctcccacgtcgcaccagaaacacccgggtctatccacgaaggtggtgaactcggatacgcgctctcacacgcctacggagccgcattcgacaaccctgacctccttattgcagcagttgtcggtgacggtgaagccgaaaccgggcccctagcgaccagctggcactccaacaagttcatcaacccagccaccgacgggacagtgctgcccatcttgcacctcaacgggtacaagatcgccaaccccaccgtccttgaccgcatctcacgcgacgaactcgaagcgctcatggtcgggtacgggcacaaaccccacttcttcgaagcaggatacgacgacgaagacgcatcatcattccaccgccggtttgctgagcttctcgacaccgtattggatgagattgcggccattaaagaacgcgcagcacagggcgacgaatcacggccacaatggcccatgatcgtgttccgcacccccaaaggatggaccggcccagccaccattgatgggaagaagacaactggttcgtggcgagcacaccaagttcctttggctagtgcacgcgacaccgacgaacacctccaggacctcaacgcctggttgcaaagctaccggcccgacgaactctttgacgagaacggaaaagttgctcaagacattgccagcctgacgcccaagggtgacctgcgcatgagcgcaaacccccacgccaacggtggggtactcatgaaggagctgcgccttccccccattgaagacttcgctgtggacgtccccacaccagggtcaaccatctcagaagcaccccgtgtgctggggtcctacctcaccgaagtgatccgtagaaacccagataacttccggatctttggccccgatgagaccgcgtccaaccggctccaaggcgtttacgatgtcaccgacaaacaatggaacgctgagttctttgacggtgacaccgacgaacacatggcccgcaaaggacgcgttgtcgagatgctgtccgaacaccagtgccaaggatggttggaaggctacctcctcaccggccgtcacgggctgatgacctcctacgaagcgttcattcacatcgtggattccatgttcaaccagcacgccaaatggttgaaggtcaccaaccacattccgtggcgccaacccatcccgtcactgaactacttgttgtcctcacacgtgtggcgccaagaccacaacgggttctcccaccaagaccccgggttcattgaccacgtggtgaacaaaaaggctgaggtcgtgcgggtgtaccttcccgctgacgccaacactttgctctccacatacgagcactgcctcaagtcgcgtcagtacgtcaacgttgtggtagctggaaaacaaccagcaccaaacttcctctccatggacgaagccaaagcacactgcgaacgcgggttaggcatttgggaatgggccggcaccgaaacaccggggcaagaccctgatgtcgtgcttgccgcagctggtgacgtgcccacccttgaggtccttgcagcagcagacattttgcgccgcgaactgcccgacctgaaggtccgtgtggtcaacgtcgttgacctcatgcggttgcaggacgaaaacgagcacccacacgggttgactgaccgtgactttgacacgatcttcacccgcaacaagccagtgatttttgcataccacggatacccatggcttattcaccgccttacctaccggcgtaacggccacgagaacattcacgtgcgcggctacaaggaagaaggcaccacgaccacaccattcgacatggtcatgctcaacgacttggaccggttccacctggtcatcgatgtcattgaccgggtcaaaggattgggtcagaagtacgctgggcttcgtcaaaagatggaagacgaacggattcgtgcccgtgcatacacccgcgaacacggacaagacctccccgaagttcgcaactgggtgtggcctgatgccgccaaccaagctgatggtgaaaaagtcgatgcgaccctcgacaccggtggcgacaacgagtaa

SEQ ID NO: 222 - DNA, 2487 bp, Xylanimonas cellulosilytica DSM 15894
atgacatcgacgacccccgcaacatccagcgggtggcgtgccaccggcgtggccgacctctccaccgagaccctcgagctgatcgacaagtggtggcgcgccgccaactacctgtcggtcgggcagatctacctgctcgacaacccgctgctgcgcaagccgctgcaccgcgacgacgtcaagccgcgcctgctcggccactggggcaccacgcccggcctcaccttcctctacgcgcacctcaaccgcgcgatcaaggagcgcgagcagtcgacggtctacatcacgggtcccggccacggcggccctggcctggtcgccgccgcctacctggacggcacctactccgaggtctactcggacatcaccaaggacgacgagggcatccgccggctgttcaagcagttctcgttccccggcggcatcccgtcgcacgtcgcccctgagacccccggctcgatccacgagggcggcgagctcggctacgcgctctcccacgcctacggcgccgcgttcgacaaccccgacctgctggtcgccgccgtcgtcggcgacggcgaggcggagaccggcccgctggcgacgtcgtggcactcgaacaagttcgtcaacccggcccaggacggcgtcgtcctgccgatcctgcacctcaacgggtacaagatcgccaacccgaccgtgctcgcccgcatcccgcaggacgagctcaaggccctcatggagggctacggccacaagccgcacttcttcgaggtcgaggacgagtccaccgaggacgccgcctcgttccaccgccgcttcgccaccctcctcgacgaggtgctggacgagatcgccgcgatcaaggcccgcgcggccgccggggacgagtcgcgcccgcagtggccgatgatcgtgttccgcacgcccaagggctggaccggcccggcgacgatcgacggcaagaagaccacgggttcgtggcgtgcccaccaggtgccgctcgcctccgcacgggacaccgaggagcacctgcacgacctcgagacctggctgaagtcctacggccccgaggagctgttcgacgaggatggtgccgtgctgcccgagatcaccgacgcgctgacgccgtcgggctcgctgcgcatgagcgacaacccgcacgccaacggcggtctgctgctcaaggacctgcgcctgccggacttccgcgacttcgccgtcgacgtccccaccccgggcggcgcgatcgccgaggccccgcgcgagctgggcaagttcttcaccgaggtcatccgccgcaacccggacaacttccggatcttcggcccggacgagaccgcctcgaaccgcctccaggccgtctacgaggagaccgacaagcagtggaacgccgacttctacggcggtgacgtcgacgagcacatgtcgcgcgccggccgcgtcgtcgagatgctctcggagcaccaggtgcagggctggctggagggctacctgctcaccggccggcacggcatgatgagctcctacgaggcgttcatccacatcgtcaactcgatgttcaaccagcacgccaagtggctgaaggtcaccaacgagatcccgtggcgccgcccgatcgcgtcgctcaactacctgctgtcgagccacgtgtggcgccaggaccacaacgggttcagccaccaggacccgggcttcatcgaccacgtggtcaacaagaaggccgaggtcgtccgcgtctacctgcctgccgacgcgaacaccctgctgtccacgtacgaccactgcctgcgctcgcgccagctcgtcaacgtggtcgtctccggcaagcagccctccccgcagtggctgacgatggacgaggccgtcgagcactgcacgcgcggcctgggcatctgggagtgggccggcacggagaccgacggcgaggagcccgacgtcgtgctggccgccgccggtgacgtgcccacgatcgaggtgctggccgcggccgacatcctgcgtcaggaggtccccgggctcaaggtccgcgtcatcaacgtcgtcgacctgatgaagctgcaggaccccaaggagcacccgcacgggctctccgacaaggagttcgacggcttgttcaccacggacaagccgatcctcttcgcgtaccacggctacccgtggctcatccaccgcctcacgtaccgtcgcaacgggcacgacaacatccacgtgcgcggctacaaggaggagggcaccaccaccacgccgttcgacatggtcatgctgaacgacatggaccggtaccacctggtgatcgacgtcatcgaccgggtgccgggcatggcgtcgcgctacgccggcctgcgccagcgtatgcaggacgcccgcatccgcgcccgggcgtacacgcgcgagcacggtgacgacatccccgaggtgcgcgactgggtgtggcccgacgctcagaacctcgcgtcgacgtcgcaggtcgacgccacgctcttcacgggcggtgacaacgagtaa

SEQ ID NO: 223 - DNA, 2481 bp, Cellulomonas flavigena
atgagcacgacgacggcggcgacgaccgcatggcagaccggacagggttcgcaggtctccgaggagaccctggggcgcatcgacaagtggtggcgcgccgccaactacctgtcggtcggccagatctacctgctcgacaacccgctgctgcgtgagcccctgacccgggaccacgtcaagccgcgcctgctgggccactggggcaccacccccggcctcaacttcctgtacgcgcacctcaaccgggcgatcgcggagcggagccagtcgacgatctacgtcacgggcccgggccacggcggtcccggactcgtggcgagcgcgtacctcgacggcacgtactccgaggtctactcggacatcacggaggacgtggagggcatgcgccggctgttccggcagttctccttcccgggtggcatcccgagccacgtggctcccgagacccccggctcgatccacgagggcggcgagctcggctacgcgctgtcccacgcgtacggcgcggcgttcgacaaccccgacctgctggtcgcggccgtcgtcggcgacggggaagcggaaacgggcccgctcgcgacgagctggcactcgaacaagttcgtcaaccccgcgcaggacggcgtggtcctgccgatcctgcacctcaacggctacaagatcgccaacccgacggtgctggaccgcatcggcgacgacgagctgcgcgcgctcatggtcggctacggccacaagccctacgtcttcgagggcggctacgacacggacgagccgatggtcgaggtgcaccgccggttcgcggcgctgctcgacgaggtgctcgacgagatcgccgcgatcaaggcgcgtgcggcggcgggcgacctcacgcggccggcctggccgatgatcgtgttccgcacgccgaagggctggacgggtccggacgtcatcgacggcaagaagacgacgggctcgtggcgcgcgcaccaggtgccgctcgcgaacgcacgggacaccgcggagcacctgcaggtgctcgagcagtggctcgagtcgtacggcgcggcggacctgttcgacgcgaccggccggctcgacccggacatccgcgcgctcgcgccgtcgggtgacctgcgcatgagcgcgaacccgcacgcgaacggcggcatcctcctcaaggacctgcgcctgccggacttccgcgacttcgcggtggacgtgcccaagccgggcggctcgatctcggaggcgccgcgcgtcctgggcgagtacctcacggaggtcatccgccggaacccggacaacttccggatcttcggtcccgacgagaccgcgtcgaaccgtctgcaggcggtgtacggcgtgacggacaagcagtggaacgccgagctgctgggtcccgaggtcgacgagcacctggctcgcgctggtcgcgtgatggagatgctctcggagcaccagtgccaggggtggctcgagggctacctgctcaccgggcggcacggcctgttcacgagctacgaggcgttcatccacatcgtcgactcgatgttcaaccagcacgcgaagtggctcaaggtcacgaacgacatcccgtggcgccggcccatcgcgagcctgaactacctgctgtcgagccacgtctggcgtcaggaccacaacggcttcagccaccaggacccgggcttcatcgaccacgtggtcaacaagaaggccgaggtcgtgcgggtgtacctgccgccggacgcgaacacgctcctgagcacgtacgaccactgcctgcgcagccgtcagtacgtcaacgtcgtcgtctcgggcaagcagcccgcgccgaacttcctcaccatggagcaggcggtcgcgcactgcacgcgcggcctcggcatctgggagtgggcgggctcggaggcgcccgacgaggagccggacgtcgtgctcgcggcggcgggtgacgtgcccacgctggaggtgctcgccgcggtcgacatcctgcgccgcgagctgccgcagctcaaggtccgcgtggtcaacgtcgtggacctcatgcgcctgcaggacgcacgggagcacccgcacggcctgacggacgcggagttcgacaccatcttcaccgccgaccgcccgatcgtgttcgcctaccacggctacccgtggctcatccaccgcctcacgtaccgccgcaacgggcacgcgaacctgcacgtgcgcgggtacaaggaggagggcacgacgacgacgccgttcgacatggtcatgctcaacgacctcgaccggtaccacctggtgatcgacgtcatcgaccacgtgcactggctgcgcgcgtcgcaggccggcctgcgccagcgcatggtcgacgcccgcctccgggcccgcgagtacacgcgggcgcacggcgaggaccttcccgaggtccgcgactgggtgtggcccgacgcgcaggacctgtccgactccggccaggtggccgcgaccgtcgcgacgggcggtgacaacgagtag

SEQ ID NO: 224 - DNA, 2472 bp, Mycobacterium gilvum PYR-GCK
atgaccaccgccaccactgccgagcgcaaaccgctgagcgaccaggacgtcgaccgtctggaccggtggtggcgcgccgccaactatctgtccgtcggccagatctacctgctcgacaatccgctgctgcgcaccccgctgacccgcgaggacgtcaaaccccggttgctcggccactggggcaccaccccggggttgaacttcctctacgcccatctcaaccgcgcgatcgcgcagcgacagcagtcgaccatctacgtgaccggtcccggccacggcggacccggcctggtggccaacgcgtatctcgacggcacctacagcgagatctactccgacatcacccaggacgacgagggtctgcgccggctgttccggcagttctcgttccccggcggcatcccgtcgcacgtcgcccccgagacgcccggctccatccacgagggcggtgaactcggctacgcgctgtcccacgcctacggcgccgcgttcgacaaccccgacctgctggtcgccgcggtcgtcggcgacggagaggccgagaccggcccgctggccaccagttggcattccaacaagttcgtcaacgccgccaaggacggcgcggtgctgccgatcctgcacctcaacggctacaagatcgccaacccgacgctgctggcccgcatccccaccgacgaactgcgcgcactgatggtcggctacggccatcacccgtacttcttcgaggtccccgacgacgagggcggtcccggcgtggaccatgcggatgcccaccggcgcttcgcggcactgctcgacgacgtcctcgacgagatcgacgacatcaagacccgcgcgcgcgagggtgacgagtcccgcccggcgtggccgatgatcgtgttccgcaccccgaagggctggaccggaccggactacatcgacggcaagaagaccaccggatcgtggcgggcccaccaggtgccgctgtccaatgcccgggacaccaaagagcatctggccgtcctgtcggactggctgtcctcctaccgcccggacgaactgttcgacgccgacggccgactgctgcccgagatcgccgagctcgcgccgtcggggcagctgcggatgagcgacaacgcgcacgccaacggcgggttgttgctcaaggacctgcgactgccggacttccgtgagtacgccgtggacgtgccggcaccgggtgcgaccgtcgccgaggccacccgcgttctcggtcagtggctgaccgaggtgatccggctcaatccggacaatttccggatcttcggtcctgatgagaccgcgtccaacaggttgcaggccgtctacgacgccaccgacaagcagtggaacgccgagttcttcggcgccgaggtcgacgaacacctcgcacgtgccggacgggtcgtcgagatgctctccgaacaccagtgccagggctggctggagggttacctgctcaccggcaggcacggcctgttcaactgctacgaggcgttcatccacatcgtcgactcgatgctcaaccaacacgccaaatggctcaaggtcaccaaccacatcccgtggcggcgacccatcgccagcctgaactacctgctgtcgagccacgtctggcgccaggaccacaacgggttctcccaccaggatcctggcttcatcgatcacgtcgtgaacaagagcgccaaggtggtcagggtgtatctgccgccggacgccaacacgctgctgtccacctacgaccactgcctgcgctcgcggcagtacgtcaacgtggtggtctctggaaagcagccgtcgccgaacttcctgaccatggaacaggcggtcgcgcactgcacccgcggcctcgggatctgggagtgggcgggttccgaggaactcggcaccgaccccgacgtcgtgctggcctccgcgggcgacatccccacgctggaggcgctggccgccgccgacatcctgcgccagcacctgcccgacctgaaggtgcgcttcgtcaacgtggtcgatctgatgcggctgcaggattcgaccgagcatccgcacgggctgcccgaccgcgacttcgacatgatcttcaccaccgacaggccgatcatcttcgcctaccacggctatccgtggctgatccatcgcctcacctaccgccgcgccgggcacgacaacctgcatgtgcgcggctacaaggaggagggcacgaccacgacgcccttcgacatggtcatgctcaacgacctcgaccgctatcacctggtcatggacgtcatcgaccgggttccgtcgctgggttcgacgtgtgcgacgttgcgccagcagatggcggacaagcgcatcgcggcacgtgagtacacgcgggcgcacggcgaggacatccccgaggtcaaggactgggtgtggcccgccgcgcgcgagtccggcttcggcaccgcgggcgctgacggcgcgtcgtcgacaggtggcgacaacgaatag

SEQ ID NO: 225 - DNA, 2499 bp, Mycobacterium vanbaalenii PYR-1
atgactaccacgaccacagccgagcagagcccgacgacctcgtggaggaccggggaccgccggccgctggccgatgcggagatcgatcagctcgaccggtggtggcgggcagccaactacctgtcggtgggccagatctacctgctcgacaacccgctgctacgcacccccctgacccgcgacgacgtcaaaccgaggttgctgggccactggggcacgacgccggggctcaacttcctctacgcccacctcaaccgggcgatcaaggagcgtgggcagtcgacgatctatctgaccggtccgggccacggcggcccggggctggtggccaacgcctacctcgacggcacctacagcgagatctactccgacatcacccaggacgccgaagggatgcgccggctgttccgccagttctccttccccggcggcatcccctcgcacgtcgcgcccgagacccccgggtcgatccacgagggcggcgagctcggctacgcgctgtcccacgcgtacggcgccgcgttcgacaacccggacctgctggtggccgcggtggtcggtgacggagaggccgagacgggtccactggccaccagctggcactccaacaagctggtcaacgccggcaaggacggtgtggtgctgccgatcctgcacctcaacggctacaagatcgccaacccgacgctgctggcccgtatccccaccgaggaactgcgcagcctgctgaccggttacgggcatcacccctacttcttcgaggtgcccgacgacgcggcccaggctgatcacgctgatgcccaccgacgcttcgcgaccctgctcgacgacgtcctcgacgagatcgccgacatcaaggccagagcctcagcaggtgacgagtcgcgcccgagctggccgatgatcgtcttccgcaccccgaaaggctggaccggcccggcctacatcgacggcaagaagaccaccggttcgtggcgggcccatcaggtgccgctggccaacgcccgcgacaccgccgaacacctcggagtgctcgccgactggctgggttcctaccgggccgaggagctgttcgacaccgacggaaagctgttgcccgacatcgcctctctggcgccggcggggccgctgcggatgagcgacaacccgcacgccaacggcgggctgctgctgaaggacctcaggctgcccgacttccgggagtacggcgtggacgtccccgcgcccggtgccaccatcgccgaggccacccgtgtgctcggccagtggttgaccgaggtgatccggctcaatccggacaacttccgcattttcggacccgacgagaccgcgtccaaccggctgcaggccgtctatgacgccaccgacaagcagtggaacgccgagttcttcggtccggaggtcgacgagcacctggcgcgggcgggccgggtggtcgagatgctctccgagcaccagtgccaggggtggctggagggctatctgctgaccggtcggcacggactgttcaactgctacgaggcgttcatccacatcatcgactcgatgctcaaccagcacgccaagtggctcaaggtcaccaacggcatcccgtggcggcggcccatcgccagtctgaactacctgttgtccagccatgtctggcgccaggaccacaacgggttctcgcaccaggacccgggtttcatcgaccacgtggtgaacaagagcgccaaggtggtgcgcgtctaccttccgccggacgccaacacgttgctgtccacctacgaccactgcctgcgctcgcgccaatacgtcaacgtcgtcgtcgcgggcaagcagccgtcgcccaatttcctgacgatggagcaggcggtcgcgcactgcatccgcgggctgggcatctgggagtgggccggttcggagcagttgggcaccgaccccgacgtcgtcctcgcggccgccggggacattccgacgctggaggcgctggccgccgccgacatcctgcggcgacacctgccggacctgaagctccgcttcgtcaacgtggtggatctgatgcggctgcaggaccgcaccgagcacccgcacgggctgtccgaccgcgacttcgacatgatcttcaccaccgatcggcccatcatcttcgcctaccacggctacccgtggctgatccaccggctgacctaccggcgtgcgggccacgccaacctccacgtccgcggttacaaggaggaaggcaccacgacgacaccgttcgacatggtgatgctcaacgacctcgaccgctaccacctggtgatggacgtgatcgaccgggtcccgtcgctgggttcgacgtgtgcgacgctgcgccagcagatggccgacaagcgcatcgcggcgcgtgagtacacccgcgcccacggcgacgacatccccgaggtcaaggactgggtctggccggcggcgcgggagtcgggattcggcactgcggccgccgacgccaccgcggccaccgggggtgacaacgaatag

SEQ ID NO: 226 - DNA, 2472 bp, Brachybacterium faecium DSM 4810
atgaccgcgaccgccagctggccgaactctccctcctccgccccgacccctgaggagctcgcccggctccacgcctggtggcgggccgcgaactacctctccgtgggccagatctacctcaaggacaacccgctgctgcgccagccgctgcagcgcgagcacgtcaagccgcgcctgctcgggcactggggcaccaccccggggctgacgttcctgtacgcgcacgcgaaccgggcgatccgccagcgcgggctgcgcgccatgtacatcaccgggcccggccacggcggtcccggcctggtcgcctcgacctacctcgagggcacctactccgaggtgtacccggcggtgagcgaggacgaggcggggatgaagcggctgttcacccagttctccttccccggcggcatcccctcgcacgtcgcccccgagaccccgggatcgatccatgagggcggcgagctcggctacgcgctctcccacgcctacggcgcgatgttcgacagccccgaccagatcgcgttcaccgtcgtcggcgacggcgaggcggagaccggaccgctggccacctcgtggcactcgaacaagttcgtcaacccgcagcaggacggcgtggtgctgccgatcctgcacctgaacggctacaagatcgcgaacccgaccgtgctggcgcggatcggggaggacgagctggaggcgctgctgcgcggctgcggccacaccccgctgttcttcaccggcggcttcgacgacgaggacccgctggagatccacgagcgcttcgccgcggtgctcgacgaggcgctggaccagatcgccgagatcaagcagcgggccttcgaggacgccgccgccgggcgggagaccgagcgcccggcctggccgatgatcgtgctgcgcaccccgaagggctggaccggcccgaaggagatcgacggccagcagaccgagggctcctggcgctcccaccaggtgccgctggccagcgcccgcgacaccgacgagcacctcgcggatctcgacgcctggctgcgctcctaccgtcccgaggagctgttcgacgaggacggcaggctcctcgaggacatcgccgcggccgccccgagcggtgcgctgcggatgtccgcgaatccctcgaccaacggcggctcggtgctgaccccgctgcgcctgccggacttccgcgactatgcggtggaggtcccctcccccggcggcaccgtcgccgaggcgaccaaggtgctcggcacctggctgcgggacgtgatccgcgacaatccccgcaccttccggctcttcgggcccgacgagaccgcctcgaaccgcctgcaggccgtctacgaggccaccgacaagcagtggaacgcacggctggaggagcacgaccgcaccgagcacctggcccgggccggccgggtcatggaggtgctctccgagcaccagtgccagggctggctcgagggctatctgctcaccgggcggcacggcatgttctcctcctacgaggcgttcatccacatcgtcgactcgatggtcaaccagcacgcgaagtggttgaaggtgacgaacgagctcgagtggcgccgcccgatcgcctcgctgaactacctgctgagctcgcacgtgtggcggcaggaccacaacggcttctcgcaccaggatccgggcttcatcgatcacatggtcaacaagaaggcggagatcgtgcgggtctacctcccgccggacgcgaacacgctgctgtccacctacgatcactgcctgcgctcgcggcagtacgtgaacgtggtggtggccgggaagcagccgggccccacctggctcgacatggacgaggcgatcgtgcactgcacccgcgggctggggatctgggactgggccggcaccgagcagcccggccgggaaccggacgtcgtgctcgccggcgccggggacatccccaccatcgaggtgctggcggccgcgaagatcctgcgcacggagatcccggagctcagggtccgggtggtcaacgtggtcgacctgatgcgcctccaggacgattcggagcacccgcacggcctctcccagcgggacttcgacggctatttcgggcaggacgtcccggtggtgttcgcctaccacggctatccgtggctgatccaccgcctggcctaccgccacgaccgcggctcacggatccacgtgcgcggctacaaggaggagggcaccaccaccacgcccttcgacatgctgatgctcaacgactccgaccgctaccacctggtgatggacgtgatcgaccgggtggaggggctcggcacccggtacgcggcgctgcgccagcggatggtggacacgcggctgcgagcccgcgccttcgcctacgagcacggcgaggacgtccccgagatcacccggtggcagtggggggacggcggcgatgcggcgcccgccggcgccccggcagataccggcggcgacaacgagtga

SEQ ID NO: 227 - DNA, 2463 bp, Kytococcus sedentarius DSM 20547
atgatcaccgtccccgcctggcccgatgaccccgccacgcccctggacgacgaggaggcccgccgcctgcacgcgtggtggcgcgcggcgaactacctctccgtggggcagatctacctgctggacaacccgctgctgcgggaggagctcgcgcccgagcacgtgaagccccgcctgctgggccactggggcaccaccccgggcctgaccttcctctacgcgcacttcaaccgcgccatccgccagcggggcctgaacgcgtgctacgtcaccgggcccggccacggcggaccgggtctggtggccgccacctacctcgagggcacctggaccgagacctaccccgacgtggggcaggacctcgacgggctgcagcgcctgtgcaagcagttctccttccccggcggcatcccctcccacgtggcgccggaggtcccggggtcgatccacgagggcggggagctggggtattcgctctcgcacgcctacggggcgatgctggacaaccccgaccagatcgccttcacggtcgtcggtgacggggaggccgagaccgggccgctggcgacctcctggcacgcgaacaagttctcggacccgcagcacgacggggtggtcctgccggtgctgcacctcaacgggtacaagatcgccaacccgacggtgctggcccgcatccccgaggaggagctcgtctccctgatgcggggctacggccacacgccgctgctgttcaccgccgggttcgacgacgaggacgagctctccgtccaccgccggttcgccgccgtgctggacgaggcgctcgacctcatcgcgcagatcaaggccgatgcggggccggactcgccgcgcccagcctggccgatgatcgtgttccgcacccccaaggggtggaccggccccgagcaggtggatggcaagcagaccgagggtcactggcgctcgcaccaggtgccgctggccaacgcccgtgacacccccgagcacctggaggtcctcgcgaactggctgcgctcgtaccggccggaggagctcttcgcccaggacggcgccctgttgcccgagatcgccgcgatggcgccgcagggcgagaagcgcatgtcggccaaccccatcaccaacggcggcagcgtgctgcgcgacctgatgctgccggacttccgcgaccacgccgtcgagctgacctcacccggccagcccttctcggaggcgacgagcgtgctggggggctacctgcgggaggtgatgcgcaggaaccccgagaccttccgcctgttcgggccggacgagacggcgtcgaaccgcctgcaggccgtgtacgaggtcaccgacaagcagtggaacgccgagtaccacccgagcgacgccgaggacccgatggcgcgcgccgggcgggtgctggagatgctctcggagcaccagtgccaggggtggctggagggttacctgctcaccgggcgccacgggatgctgaactcctacgaggccttcgtccacatcgtcgactcgatggtgaaccagcacgccaagtggtacaaggtcaccaaccagctcgagtggcggcgcccgctggcctcgttgaactacctgctctcctcgcacgtgtggcggcaggaccacaacggcttctcccaccaggaccccgggttcatcgaccacgtggtcaacaagaaggcggagatcgtgcgggtgtacctgccgccggacgcgaacaccctgctctcgacggtggaccactgcctgcgctcccggcagtacgtcaacgtggtggtggccggcaagcagccgaaccccacgtggttgacgatggaggaggcgatcgcccactgcgtgcgcggcatcggcatttggccgtgggccgggacggagtccgacggtgacgaccccgacgtggtgctgggctgcgcgggcgacatccccaccatcgaggtcctggcggccgcgaagatcctgcgcgaggaggtgccggggctgaccttccgggtcgtgaacgtggtggacctgatgcgcctgcaggacgagaaggcccacccgcacgggctgtccgagacgcagttccacacccttttccccgccggcacacccgtggtcttcgggtaccacggctacccgtggctgatccaccgcctggtctaccggcacgacaccgcatcacacttccacgtgcgcgggtacaccgaggagggcaccaccaccacgcccttcgacatggtgatgcgcaaccagctggaccgctaccagctggtggtcgacgtcatcgaccgcgtgccggccctgggttcgcgctacgcccggctccgccagcgcatggaggacaagcgactgcaggcccgtgcccacgcctacgagcacggggaggacctgcccgaggtcgcccagtggcagtggggtgacgcccaggacgaggccgatgcccagcagggcagcgtgcgtcaggacaccggcggcgacaacgtctga

SEQ ID NO: 228 - DNA, 2439 bp, Clavibacter michiganensis subsp. michiganensis NCPPB 382
atggcctccgaccccgcaccccgagaccccgccgcgcccctctacctcgacgtcgtggacggctggtggcgcgccgccaactacctctccgtcggccagatctacctgctcgacgacccgctgctcgaacggccgctcacgcgcgacgacatcaagccgcgcctcctcgggcactggggcacgaccccgctgctcaacttcgtctacgcgcacctcaaccgggcgatcatcgagcgcgacctcgacatgatctacatcgccggtcccggccacggcggcccgggcatggtcgcgaacgcgtacctcgacggcacgtactcggagctgttctcggcggcgacgccggatcgcgcgggcatgcgccacctgttccgccagttctcgttccccggcggggtgccgtcgcacgcggcgccggagacgcccggatccatcaacgagggcggcgagctcggctactcgctcgtgcacgccttcggcgccgcgctcgacaaccccgacctcgtggtcgcgtgcgtgatcggcgacggcgaggcggagaccgcgacgctcgcctccagctggcacctcgacaagttcctcgacccggagaccgacggcgccgtgctgccgatcctcaacctcaacggctggaagatcgcgaacccgacgatcctcgcgcgcatccccgaggaggagctgctcgcgctcttcaccggttacggctactccccgcggatcgtctcgggcggcttcgacggcgaggaccacgcggcggtgcacgagcggttcgcgctggcgctgggcgaggcgctcgacgacatcagccggatccagctcgcggcccgcacgggcggcagcgaggagcgaccggcctggccgatgctgatcctccgcacgcccaagggctggaccggccctaaggaggtcgacggcaagcaggtcgagggcacgtggcgtgcgcaccaggtgccgctgtccggcgtccgcgacgacccggaccacctccgccagctccaggagtggctggagagctaccgcccgcacgagctgttcgaccgcgacgggcgcctgacccccgcgctccagccgaaccgtcccgagggcgaccggcggatgagcgcgaacccgcacgcgaacggcggcctgctccgtcgcgacctccgcctgccgccgctcgaggtcaacgcgatcgacctcagcgacggccgcggcgtcatcgccgagccgacccgcgtgctcggcggctggctgcgcgacgtgatcgcccgcaatccgctcgacttccggatcttcggccccgacgagaccgccagcaaccggctcgacgacgtgtacgaggtcacggcgaaggcctggcagggcgaggtgctgccggtcgacgagcacctggcgcacgagggccgggtcatcgagatcctcaacgagaacatcacgcaggggctgctcgaggcctacctgctcaccggcaggcacgggctcttcacctcctacgaggcgttcatccacgtggtcgactcgatgttcaaccagtacgcgaagtggctcgagtcgagctcgaaggtggagtggcggcggccggtcgcgtcgttcacgtacctgctctcctcgcacgtctggcggcaggaccacaacggcttctcgcaccaggaccccggcttcctcgaccacgtcgtgaacaagcgggccgagatcgtgcgcgtgtacctgccgttcgacgcgaactcgctgctcgtgacgatggaccactgcctccgcggcaccgacctgatcaacgtggtcatcgccggcaagcagccgaccgcgagcctgctgtcgctcgaggaggccagagcccacggggcgcgcggcgtgggcgtgtgggagtgggcgggcaccgaggtgcccgggctcgagcccgacgtcgtggtcgcgtgcgcgggcgacatcccgacggtggaggcgatggcggcggtgcagatcctcaagcgggagatcccgcagctgcgcgtgcggttcgtcaacgtggtcgacctgatgcgtctgcaggactccacccagcacccgcacggcctcgacgacggatccttcgacgccctgttcacgcgcgacaagcccgtcgtcttcgcgttccacggctacccgtcgctcatccaccgcctcacgtacaagcggcacaaccacgagaacatgcacgtgcgcggcttcgtggagcagggcggcacgaccacgccgttcgacatgctgatgctcaacgacctcgaccggttccggctcgtgatggacgtgatccgccgcgtgccgcacctcgagacgacctacgcgggcctctcgcagcgcatggacgacgagcgcatcgcgcaccgcgtgttcacgcgcgagcacggcgaggacatggccgacgtgtcgggcgcggaggggctgccgttcgcggatccgacgcggcagacggcgatcgacaccggcgacgacaacgcctga

SEQ ID NO: 229 - DNA, 2403 bp, Salinispora tropica CNB-440
atgaacatcgcaaccgcccagcacaaccccctgaccgaagacgaactacgccgactggacgcgtactggcgggcggcgaactacctcactgtcgggcagatctacctccggagcaacccgctgctgcgcgagccgctgaccgtggagcacgtcaagccgcggctcctcgggcactggggcaccagtcccggtctgaacctgctgtacgcgcacctcaaccgggtcatcgtcgcccgcgacctgaacgccatctacatcaccggtcccggccacggcggtcccgcgatcgtggcgaacacctggctggagggcacctggagcgagcgctaccacggcacctgccaggacgaagccggcatggcccaactcttctgccagttctccttccccggtggcattcccagccacgtggccgcggaggtgccggggtccattcacgaggggggtgagctcgggtacgcgctcagccacgcctacggtgccgcgttcgacaacccggacctgctggtcgcgtgcgtgatcggcgacggcgaggcggagaccgggccgctggccggtagctggctgtcgaacgtgttcctgaacccggcccgcgacggtgcggtgttgcccatcctgcacctcaacggctacaagatcgccaacccgacggtgttgagccgaatccccgagtccgacctgctggacctgatgcgcgggtacggtcacgagccgtacctggtcgccggggacgatccggccacggtgcaccagacactcgccgcgaccatggaccgggcgctggacgagatcgccgccatccaacagcgggcccggtcgggtggcccggtcgagcgcccgcgctggccgatgatcgtgctccgtacgccgaagggctggaccggcccgcgcgaggtcgacgacaagcaggtggagggcacttttcgcgcccaccaggtgccgctgtcgcaggtgcggcagaacccgcagcacctggccgagttggagcgctggctgcgcagctaccgcccggaggagctcttcgacgcgaccggggcgccgatcgccgagctgttggagctgccgccgaagggcgaccgccggatgagcgccaacccggtcgccaacggcgggcaggtgttgcgtgatctggtgctgcccgacttccgcgactacgcggtcgacgtgccgcgccccggtacggcggtcaccagcgccaccggcacgctcggcaactggatccgcgatgtcatcgccgcgaacccagagaccttccggctcttcggcccggacgaggtcgcctccaatcggctcggtgccgccttcgaggtcaccgaccgggcctgggtggcggccaccacttccggtgacgagaacctctcccccgacgggcgggtcatggaggttctctccgaacacctctgccagggctggctggagggatacctgctgaccggccggcacggcctcttcaccagttacgaggcgttcatccacatcgtcgactcgatggtcaaccagcacgccaagtggctgaaggtgacccgggacattccctggcgacagccggtggcctcgctgaactacctgctctccagccacgtctggcggcaggaccacaacggcttctcacaccaggacccgggcttcatcgaccacgtcgtgaacaagaaggccgaggtggtccgggtctatctgccaccggacgggaacaccctgctctcgacgctgagccactgcctgcgcagccggcactacatcaacgtggtcgtcgcgggcaagcaacccacaccgagctggctgtcgatggacgaggcggtcctgcactgccggcgcgggatcggcatctggaactgggccagcagcgacgacggtgcggagccggacgtggtgctcgcctgcgccggtgacgtgccgacgctggaaaccatcgcggcggccgacctgctgcaccagcacctgcccgagctgaaggtacgggtggtcaacgtggttgacctgatgcgcctacaaccgtcgagcgagcacccgcacgggctgccagactcggagttcgacaccatcttcaccaccgacaagccggtcatcttcgcgtaccacggctacccgtggctcatccaccgcctgacctaccggcggaccaaccaccccaacctgcacgtccgcggctacaaggaggagggcaccaccaccactccgttcgacatggtgatgctcaacgacctggaccggttccatctggtcatcgacgtgatcgaccgggtacccgggctcgccgcacgggcggcgcacctgcggcaggagatggtggacgcccgccagtcgtgccgggaccacacccgcaagcacggcgccgacgatcctcgggtgacccagtggcggtggatccgcgagacggacgccggcctcagcgacgaccgatga

SEQ ID NO: 230 - DNA, 2403 bp, Salinispora arenicola CNS-205
atggacagcgcaaccgcccaggaccgccccctgaccgagaccgagctgcgccggctggacgcgtactggcgggcggcgaactacctcaccgtcgggcagatctacctccggagcaatccgctgctgcgcgaaccgctgacgccggagcatgtcaagccgcggctgctcgggcactggggcaccagccccggcctgaacctgctgtacgcgcacctcaaccgggtcatcgtcgcccgtgacctgaacgccatctacatcaccgggcctggccacggcggtcccgcgatcgtggcgaacacctggttggagggcacctggagcgagctctaccacggcaccggccgagacgaggccggcatggcgcagctgttctgccagttctccttccccggtggcattcccagccacgtggccgcggaggtgccggggtcgattcacgagggcggtgagctcgggtacgcgctcagccacgcctacggggccgcgttcgacaacccggacctgctggtcgcgtgcgtgatcggtgacggtgaggcggagaccgggccactggccggcagttggctgtccaacgtgttcctgaatccggcccgcgacggcgcggtgctgccgatcctgcacctcaacggctacaagatcgccaacccgacggtgctggaccggatccccgagtccgagttgctggatctgctgcgcggatacggccaccatccatacctggtcgccggggaagatcccgccaccgtgcaccaggcgctcgccgcgaccctggaccgggccctggacgagatcgccgccatccagcggcgggcccggtcgggtggcccggtcgagcgcccccgttggccgatgatcgtgctgcgcacgccgaagggctggaccggcccccgggaggtcgacaacacgccggtggagggcacataccgtgcacaccaggtgccgctgtcgcaggtacgcagcaacccgcagcacctggccgagttggagcgctggctgcgcagctaccacccggaggagctcttcgacgcgaccggggcgccggtcgccgagctgatcgcactgccgccgaagggtgaccgccggatgagcgccaacccggtcgccaacggcgggcaggtgttgcgtgatctggtcctgccggatttccgcgactacgcggtcgacgtgccacggcccggcgagccggtcaccagcgccaccggcgcgctcggcacctggatccgcgacgtcatcgccgcgaacccggagtcgttccggctcttcggcccagacgaggttgcctcgaaccggctcggtgccgccttcgaggtcaccgaccgggcctgggtggcggagaccgtacccggcgacgaccacctctccccggacgggcgggtcatggaggtactctccgagcacctgtgccagggctggctcgaggggtacctgttgaccggccgacacggcctgttcaccagctacgaagcattcatccacatcgtcgactcgatggtcaaccaacatgccaagtggctgaaggtcacccggggcattccctggcggcagccgctggcctcactgaactacctgctgtccagccacgtctggcggcaggaccacaacggcttctcccaccaggacccggggttcatcgaccacgtgatgaacaagaaggccgaggtggtccgggtctacctgccgccggacggcaacaccctgctctccacgttgaaccactgcctgcgtagccggcactacatcaacgtggtcgtcgccggcaagcaaccgacaccgaactggctgccgatggacgaggcgatcctgcactgccggcgcggcatcggcatctggggctgggccagcaacgacggcgattcggagccggacgtggtgctcgcctgcgccggtgacgtgcccacactggaaaccctcgcggcggccgacctgctgcaccaacacctgcccgacctgaaggtgcgggtggtcaacgtggtcgacctgatgcgcctccagccgtcgagcgagcacccgcacgggctgccggacacggagttcgacaccatcttcaccaccgacaagccgatcatcttcgcgtaccacggctacccgtggctcatccaccgcctgacctaccgacggaccaaccaccccaacctgcacgtgcgcggctacaaggaggagggcaccaccaccactccgttcgacatggtgatgctcaacgacctggaccggttccatctggtcatcgacgtgatcgaccgggtacccggcctcgccgcgcgggccgcgcacctgcggcaggcgatggtcgacgcacgccagtcgtgccgggactacacccgcgcgcacggcgccgacgacccacgggtggcgcagtggcggtggacccgcgggacggacgccgacgacagcgacgaccgatga

SEQ ID NO: 231 - DNA, 2190 bp, Micromonospora sp. ATCC 39149
atggacaccgttgtagacctgcacggccccctgaccgacgacgagctgcgccggctggacgcgtactggcgggccgccaactacctgaccgtcgggcagatctacctgctggacaacccgctgctgcgtgagccgctgcgacccgagcacgtcaagccccggctgctggggcactggggcaccggtccggggctcaacctggtctacgcgcacctcaaccgggtcatcgtcaaccggaagctgccgacgatcttcatcaccggccccggccacggcggccccgccctggtggccaacacctggctggagggcacctacagcgagctttaccactcggcgagccgcgacgagaccggcatgcagcagctgttccgccagttctcgttccccggcggcatcccgagccacgtcgcaccggaggtgccgggctcgatccacgagggcggcgagctggggtacgcgctgagtcacgcgtacggcgccgcgttcgacaaccccgacctgctggtcgcctgcgtcatcggcgacggcgaggccgagaccggcccgctcgccggaagctggctgtccaacgtcttcctcaacccggcccgcgacggcgcggtgctgcccatcctgcacctcaacggctacaagatcgccaacccgacggtgctggaccgcatccccgccgacgatttgctggacatgatgcgcgggttcggctaccagccgtacgtcgtcgcgggcgacgacccggccacggtgcaccagaccctggccgccaccctggaccgggccgtcgacgagatcgccgggatccagcgcagggcgcgctccggcgcacccgtcgagcgcccccgctggccgatgatcatcctccggacgccgaagggctggaccggcccaaccgtcgtcgacggcaagcaggtggaggggacgtaccgcgcccaccaggtgcccatagccgaggtgcgggacaacccggagcacctggcggagctggaacgctggctgcgcagctaccggccacaggagctgttcgatcccaccggcgcgccggtcgccgaactggccgcgctgccaccgaccggtgacctgcggatgagcgccaacccggtcgccaacggcgggcgggtgctgcgcgacctggacctgccggacttccgccggtacgccgtcgacgtcaagcagcccggcgcgccggcggtcggcgcgaccggcgtgctcggcgcatgggtccgcgacatcatcaccgccaatccgcatacgttccgcctcttcggccccgacgaggtcgcctccaaccggctcggcgcggccttcgaggtcaccgaccgggtgttcgtcgccgaccgggtcgacggcgacgaacacctctcccccgacggccgggtgatggaggtgctgtcggagcacctgtgccagggctggctggaggggtacctgctgaccggccggcacgggatcttcaccagctacgaggcgttcatccacatcgtcgactcgatggtcaaccagcacgcgaagtggctgaaggtgacccggggcatcccgtggcgggaaccggtggcgtcgctgaactacctgctctccagccacgtgtggcggcaggaccacaacggcttctcgcaccaggacccgggcttcatcgaccacgtggtcaacaagaaggccgaggtggtccgggtctacctgccgccggacggcaacaccctgctctccaccatggaccactgcctgcgcagccggcactacatcaacgtggtggtggccggcaagcaacccgccccgaactggctgaccatggacgaggcgatccagcactgccggcgcggcctgggcatctgggactgggccagcaccgacgaccgtcgggagccggacgtggtgctcggctgcgccggcgacgtgcccacgatggagaccctcgccgccgccgacctgctgcgccagcggctgcccgagctgaaggtgcgggtggtcaacgtggtcgacctgatgcggctccaaccgccgtcggagcacccgcacggcctgccggacaacgagttcgacaccatcttcacccgcgacaagccgatcatcttcgcgtaccacggctacccgtggctgatccaccggctcacctaccggcgcgccagccacgacaacctgcacgtgcgtgggtacaaggaggagggcaccaccaccacgccgttcgacatgtga

SEQ ID NO: 232 - DNA, 2373 bp, Mycobacterium smegmatis str. MC2 155
atgagcgacgcgaccacatccccggcgctgaccgattcggaactcgaactgctcgacgcgtactggcgcgcggccaactacctgtccgtcggccagatctatctgctcgacaaccccctgctcgccgaaccgctcgcggccgaacacgtcaaaccgcgtctgctcggccactggggaacgacacccggcctgaacctgatctacgcacatctcaaccggatcatccgcgagcgcgacgccaacgtcatctacatcaccggccctggccacggcggtcccggcctggtggccaacgcgtatctggagggcacctacagcgaggtctacacgggaatcgggcaggatgtcgacgggatgcggaaattgttccggcagttcagctttccgggcggcatccccagccacgtggcagccgagacgcccggctcgatccacgagggcggcgaactgggttatgcactggtgcacgcgtacggtgcggcgttcgacaaccccgacctcgtggtggcctgcgtcgtgggcgacggcgaggccgaaaccggtccgctcgcggcgagctggcactccaacaagttcctcaatcccgtcaccgacggcgcggtgctgccgatcctgcacctcaacggctacaagatagccaatcccactgtgctgtcccggattccgcaagaggagctcgaatccctgttcctcggctacggataccggccgatcacggtcgccggtgacgacccggcgaacgtgcaccagcaactggcgatcgcgatggacgaggcgttcgaccagatcgccgcgatccagcgcgcggcgcgcctcgacgacgaatccgggcgaccgctgtggccgatgatcatcatgcgcacacccaagggatggaccggtccggccacggtggacgggaaaaaggtggaaggcacctggcgctcgcaccaggtgccgctctcggagacccgcaccaatcccgaccacatggcccagctcgaagagtggctgcgcagttaccgcccgcacgaactgttcgacggcaccggggcactgcgaccggaactgcgcgcactggcgccggccggcgatcgccggatgagcgccaacccgcacgccaacggcggcctgctgctgcgcgatctggacctgcccgatttcaccgactacgcggtgcccgtcgacaggcccgcgaccaccagcgtccaggccacccaggtgctcggcgagttcctgcgcgacgtgatcgcccgcaacccggaccggttccgcgtcatggggcccgacgagaccgcgtcgaaccggctctcggcggtgttcgaggcgaccgacaagacctggctggccgagaccgggcccgacgacgaacacctcgcgcccgacggacgcgtcatggaggtgctgtccgagcacctgtgccagggctggctggagggttacctgctgaccggcaggcatggcctcttcagttgctacgaggcgttcgtgcacatcgtcgactcgatgctcaatcagcatgtcaagtggttgaccagcagcgcggcactcacgtggcgcaggcccatcgcgtcgctgaactacctgctgacctcacatgtgtggcgccaggaccacaacggcgcgtcacaccaggaccccggcttcatcgaccacgtcgccaacaagcgacccgaggcggttcgggtgtacctgccgcccgacgccaacacgctgctgtcggtcgccgaccactgcctgcgcagccgccactacgtcaacgtcgtcgtcgcgggcaagcagcccgcgctgagttacctcacgatggacgaggcgatcgcgcactgcacgcgcgggctcggcatctgggactgggcgagctctgacacctcgggtgaaccggatgtcgtgctggcctgcgcgggcgacatcccgacgctggagacgctggccgccgccgacatcctgcgccgcaggctgcccgatctgaaggtgcgtgtggtcaacgtcgtcgacatcatgcggctgcaaccggaatcagagcatccgcacggcttgtccgaacgcgacttcgactcggtcttcaccaccgaccggccgatcatcttcgcctaccacggctatccgtggctgatccaccgcctgacctaccggcacgccaaccacgcgcaactgcacgtgcgtggcttcaaggagcgcggcaccaccacgacacccttcgacatggtgatgctcaacgacctggaccgcttccatctcgtcatggacgtcatcgaccgcgtcgaggggctcgggacccgggcggccgcactgcgtcaggagatggccgacgcgcggctggcggcgcgccggtacacccgcgagcacggcgaggacgatccggccatctcggagtggacctggcaggccgattga

SEQ ID NO: 233 - DNA, 2421 bp, Mycobacterium sp. MCS
atgagtgagaccacgcttgcccccacgctgtccgacgaggagctgcggctcatcgacgcctactggcgggccgccaactacctgtccgtcgggcagatctacctgctcgacaacccgctgctgcgcgaggagctgcgggccgaacacgtcaaaccgaggttgctgggacactggggcaccacccccgggctcaacctcgtctacgcgcacctcaaccggatcatccgcgaacgcgacgccgacgtcatctacatcaccggcccgggacacggcggtcccggcctggtggccaacgcctacctggaggggacctacagcgaggtctattccaacatcggcgaggacgccgacggactgcgaaagctgttccgccagttctcttttcccggcggtatacccagccatgtggcgtcggagacgcccggctccatccacgagggcggcgagctgggctatgcactggtgcacgcctacggcgccgccttcgacaaccccgatctggtggtcgcctgcgtcgtcggcgacggggaggccgagaccggaccgttggccgccagctggcactcgaacaagttcctcgacccggtgaccgacggtgcggtgttgccgatcctgcatctcaacagctacaagatcgccaaccccacggtgctcgcgcgcatcccgcaggaggaactcgaatcgctgttctacggctacgggtaccggccgatcaccgtggcgggcgacgatccggacaacgtccaccagcagatggccgccgcgctcgacgagtgcttcgaccagatcgccgccatccaacgcgcggcgcgcctggactccgaacccggccgtccgctgtggccgatgatcatcctgcgcacgcccaagggctggaccggcccgcgcgaggtggacggtaagaaggtggagggcacgtggcgctcgcaccaggtgccgctgtcggagacccacaccaacgccgaccacatggcccagctcgaacagtggctgcgcagctaccgccccgaggaactcttcgatgacgacggccgtctgatccttgaggtcaaggccctcgcccccgagggaacccgtcggatgagcgacaacccgcacgccaacggcggtctgctgctgcgcgatctggacctccccgacttccgtgactacgcggtccccgtcgaggaaccggggtcgcagagcgccgaagccacccgcgtcctaggcacgttcctgcgcgacgtcatcgtccgcaaccaggaccggttccgcatcatgggacccgacgagacggcctccaaccggttgtcgccggtgttcgaggcgaccggcaaggcgtggatggcggagatcagccccgacgacgagaacctcgagccgtcgggccgggtcatggaggtgctgtccgaacacctgtgccagggctggctcgagggttacctgctgaccggcaggcacggcctgttcaactgctacgaggcgttcgtccacatcgtcgactcgatgctcaaccaacacgccaaatggctgtccagcagtgcgcacctgagttggcggcgccccatcgcctcgttgaactacctgctcacgtcccatgtctggcgccaggaccacaacggcgcctcacaccaggatccggggttcatcgaccatgtcgccaacaagcggcccgaggtggtgcgcgtctacctgccgccggacgccaacacgctgctctcggtcgccgaccactgcctgcgcagccgccagtacgtcaacgtcatcgtcgccggtaagcagcccgcgctgacgtacctcacgatggacgaagcggtcgcgcactgcacccgggggctgggcatctgggagtgggcgagcaccacgaccggcgaacccgacgtcgtcctggcgtgcgccggggacatccccaccctcgagaccgtggccgccgccgacatcctgcgccgccgactgcccgacctcaaggtgcgggtggtcaacgtcgtggacatcatgcggctgcaacccgaatccgagcacccgcacggtctgtccgaccgggagttcgactcgatcttcaccaccgacaagccggtcatcttcgcctaccacggatatccgtggctgatccaccggttggcctaccggcacgccaaccacgagcagttgcacgtacgcggcttcaaggagcgcggcaccacgacgacgccgttcgacatggtgatgctcaacgacctcgaccgtttccatctggtcatggacgtcatcgaccgcgtcgagagcctcggcaccaaggccgccgggctgcgccaggagatggccgacgctcgcttggccgcgcgggcctacacccgtgaacacggcgaggacgaccccgcgatctcggaatggagttgggacagcggttaccgcgccgacggcacccagtccatggcacaggacaccggcgacaacgagtga

SEQ ID NO: 234 - DNA, 2403 bp, Mycobacterium kansasii ATCC 12478
gtgagcccggtgagccctgaaaccccaacaaccgcgaccctttccgacgacgaactggcccgcatcgacgcgtattggcgtgccgccaactacctgtcggtcggccagatctacctgctggacaacccgctgctggccaagccgctgtcagccgagcacgtcaaaccccggctgctgggacattggggcaccacgccggggctcaacctcgtctacgcccacctgaaccgggtaatccgcaaccgcgacgccaacgtcatctacgtcaccggccccgggcacggcggtcccggcctggtcgccaacgcctacctcgaaggcacctacagcgaggtgtacaccggcatcggggaagacgccgaaggattgcggcggctgtttcggcagttctcctttcccggtggtatccccagccatgtcgcggcccagaccccggggtctattcacgagggcggcgagctggggtatgcgctggtgcatgctttcggcgcggctttcgacaaccccgacctggtggtcgcctgtgtcatcggcgacggcgaagccgaaaccggaccgttggccgccagctggcattccaacaagttcctcaatcccgcgatcgacggcgcggtgttgccgatcttgcacctcaacggatacaaaatcgccaatccgactgtgctggcgcgtattccgcatgacgagctggcatcgctgctgcgcggttacggctaccggccgatcgcggtttccggggacgatccgctcagggtgcaccggcagctggctggtgcgctcgatgacgcgttcgacgacattgcggcaattcagcatgccgcgcgctcgggcgagaattctgcgcggccggtctggccgatgatcgtgttgcgcacacccaagggctggaccgggccgaaggtggtcgacggcatgaaggtcgagggcacctggcgttcgcatcaggtcccgctcgccgacacccatgacagcgccgagcggcgccggcagcttgaagagtggctgcgcagctaccggcccgatgagctcttcgacgacaacggcacgttgcgggccgagctgcgggcgttggcacctaccggtgatcggcggatgagcgccaacccgcacgccaacggcgggctgctgctgcgcgacctcgatcttcccgacttccgcgactacgcggtgccggtggcacgtccggcctgcgaaacccacgaggccacccgggtgctcggtacgtatctgcgagacgtgatccggcgcaacccggatcggttccggctgatgggcccggacgaaaccgcgtcgaaccggctcagtgccgtattcgaagcgaccgggcggacctggctgtcggagaccagcgccgacgacgatcacctgtctgcggcaggccgggtgatggaggtgctgtccgaacatctgtgtcagggctggctggagggctatctgctgaccggccgccacggcatgttcgactgctacgaggccttcgtgcacatcgtcgactcgatgttcaaccagcacaccaaatggctgtcgaccagccgggaactgccatggcggcgaccgatcgcgtcgctgaactacctgctgagttcccatgtgtggcgccaggaccacaacggcgcatcgcatcaggatcccggattcatcgacctggtcgccaacaagcgacccgaggtggtacgcgtttacctgccgcccgacggcaacacgttgttgtcggtggccgaccattgcctgcgcagccgtgactatgtcaacgtcatcgtcgccggcaagcaacccgcgctgtcctatctcgccatggacgaggccgtcgcgcactgcactcgcgggctcggcatctggcaatgggcaagcacggcgaccggtgagcccgacgtggtgctggcctgcgcgggagacgtgccgacgctggagacgctggcagccgccgacattctgcggcgggaactgccagggctgggtgtgcgggtggtcaacgtcgtcgacatcatgcggctgcagccggagtccgagcacccacacggcttggccgacaaggaattcgatgcagtgttcactcgcgacaagccggtcatcttcgcctaccacgggtatccgtggttgatccatcggctcgcgtatcgccgcgccaatcacccccgtatccatgtgcgcgggttcaaggagcgcgggaccacgacgacaccgtttgacatggtgatgctcaacgatctggatcgctttcacctggtcatggacgtcatcgaccgcgttgacgggctggccagccgagccgccgtgctacgccaacggatggccgacgcccggctctcggcacgtctgtacacccgtgagcatggcgccgacgacccccggatcgcgggatgggcctgggagtcgagcgagcggaacgaacgcagtgggtga

SEQ ID NO: 235 - DNA, 2403 bp, Mycobacterium marinum M
atgagcccagaaaatcgtgccaccagcgaacccgctcccctgtccgacgacgacctggccctcattgacgcctattggcgcgccgccaactacctgtcggtcggccagatctatctgctgtccaatccactgttggccgaaccgctggtgcccacgcacgtcaaaccccggctgctgggtcactggggcaccacccccggcctcaatctgatctacgcgcacctgaaccggataattcgcgagcgcgacgccaacgtcatctacgtcaccgggcccggccacggggggcccggactggtggccaatgcgtacttggaaggcacctacagcgaggtgtacagcgccatcgcggagaacaccgacggaatgcggcggctgtttcgccagttttcctttccgggcgggattcccagccatgtcgcggcgcagacgcccgggtccattcatgagggcggcgagctcggctacgcgctggtgcatgcctacggcgcggccttcgacaaccccgacctggtggtcgcctgcgtggtcggtgacggtgaagccgagaccggtccactggcgacaagctggcattcgaacaagttcctcaaccccgccatcgacggggcggtgctgccgatcttgcatctcaacggctacaagatcgccaatccgaccgtgctggcccgcattccgcatgacgagctcgaatcgctgttgcgcggctacggctaccggcccatcacggtggccggcgatgatccgccccgtgtgcaccagcagctggccggcgcgctcgacgaggcgttcgacgagatcgccgcgattcagctcgccgcccgcaccggcggcgatatcaagcggccggtatggccaatgatcgtgctacgcacccccaagggctggacggggccaaaagtcgtcgacggcaagaaggtcgagggcacctggcgatcccatcaggttccgctagctgacacccacgacaacgcgcagcaccgtgaccagcttgaagaatggctgcgcagctaccggccccacgagctgttcgacgatcacggcaagctgcgagcgcagctgcgggcgatggctcccagcggcaatcgacggatgagcgccaacccgcacgccaacggcgggctcttgttgcgtgacctcgatctgcccgacttccgcgactacgcggtgcaggtcaacagcccgggcaccgaaatccacgaagccactcgggtactcgggacatttctgcgcgatgtgatcaggcgaaacccggatcgattccgtctgatgggtcccgatgagacggcgtcgaatcggctcagcgccgtattcgaggcaaccggccgaacctggctgtcggagaccacggccgatgacgaccacctctcggccgagggccgcgtgatggaggtgctgtcagaacatctgtgccagggctggctggaaggttatctactgaccggccgccacggcatgttcgattgctacgaggccttcgtgcacatcgtcgactcgatgttcaatcagcacacgaaatggctttccaccagccgggagctgccgtggcggcggccgatcgcatcgctgaactacctgctgagttcccacgtgtggcggcaggaccacaacggcgcttcccatcaggatcccgggttcatcgacctggtcgccaacaagcgtcccgaggtggtccgggtctacttgccgccggacgggaacaccttgctttcggttgccgaccactgcctgcgtagccgcaactacgtcaacgtcatcgtcgccggcaagcagcccgcgctggcttatctggatatggacgaggccatcgcgcactgcacccggggactgggcatctggcagtgggcgagtacggccagcggcgagcccgacgtggtgctggcctgtgcgggagacattccgacgctcgagacactggcggccgccgacatcctgcgccgcgaactgcccgacctgggtgtccgggtggtcaacatcgtcgacatcatgcgtttgcagccggagtccgagcacccccacggcttgccggaccgcgagttcgatgcgctgttcacccgcgacaagccggtcattttcgcctaccacggctatccatggctgatccaccgccttgcttaccgtcgtgccaaccatgcccgcatccatgtgcgcgggttcaaggagcgaggcaccacgactacgccgttcgacatggtgatgctcaatgacctggatcgcttccacctggtgatcgacgtcatcgaccgggtggtgggcctgtccagccgggctgcggtgctgcggcagcggatggccgatgcgcgcctggcagcgcgccagtacacgcgtgagcatggtgaggacgacccgcgaattgcggattgggcctgggagccgagcgagcagagcgagcttggcgagtga

SEQ ID NO: 236 - DNA, 2415 bp, Mycobacterium avium subsp. paratuberculosis K-10
gtgagcctagaaacctcaaccaccacgcccgccggatctccgctctccgaccgcgaactggacctcatcgacaagtattggcgcgccgccaactacctgtcggtggggcagatctacctgctggacaacccgctgctcaaagagccgctgagcgccgagcacgtcaagccgcggctgctggggcactggggcaccacgcccgggctgaacctcgtctatgcgcacctgaaccggatcatccgcaaccgcgacgccgacgtcatctacgtgaccggaccggggcacggcgggccgggcctggtcgccaacgcctatctggaaggcacctacagcgaggtgtacaccggcatcgaagaggacgccgagggattgcgaaaactgttccggcagttctcttttcccggcggcattcccagccacgtcgcggcccagacgccgggatcgatccacgagggcggcgagctgggctacgcgctggtgcacgcctacggcgccgccttcgacaacccgtacctggtggtggcctgcgtcatcggcgacggcgaggcggagaccgggccgctggccgccggctggcactccaacaaattcctcaacccggtgaccgacggcgccgtgctgcccatcctggcgctcaacggctacaagatcgccaacccgaccgtgctggcccgcatcccgcacaccgagctggaagcgctgttgcgcggctacggctaccggccgatcaccgtcgccggtgacgatccgaccgacgtgcaccgtcagctggccgccgccctcgacgaggcgttcgacggcatcgccgccatccagggcgcggcgcgcggcggcggtgaggtgcagcggccggtgtggccgatgatcgtgctgcgcacccccaagggctggaccgggccgaaggtggtggacggcaagagggttgagggcacctggcggtcgcaccaagtgccgctcgccgagacgcacgacaaccccgaacaccgcgcccagctcgaggagtggctgcgcagctacggtccggagcagctgttcgacgacgacgggcggctgcgggccgagctgcgggcgctggcgcccaccggtgatcgccggatgagcgccaacccgcacgccaacggcgggctgctgctgcacgacctcgacctgcccgacttccgcgactatgcggtgccggtgtcccggccggggtcggtcacccacgaggccacccgggtgctgggcaccttcctgcgcgacgtgatcgcccgcaacaaagaccggttccggatgatggggcccgacgagacggcctccaaccggctcgacgccgtctacggcgccaccgagaaggtgtggttgtcggcgaccgagcccgacgacgagcacctggcgcccgacggccgggtgatggaggtgctgtccgagcacctgtgccagggctggctggagggctacctgctgaccgggcggcacggcctgttcaactgctacgaggcgttcgtgcacatcgtcgactcgatgctgaaccagcacgcgaaatggcttgcgaccagccgggaattgccgtggcggcggcccatcgcgtcgctgaactacctgctgacgtcgcacgtgtggcgccaggaccacaacggcgcctcgcatcaggaccccgggttcatcgacctggtcgccaacaagcgcgccgagctgacccgggtgtacctgccgccggacggcaacacgctgctgtcggtggccgatcactgcctgcgcagccgcgactacatcaacgtgatcgtcgcaggcaagcagcccgcgctggcctacctggacatggacgccgcgatcgcgcactgcacccgcgggctgggcatctgggactgggccagcaccgcccgatcgattggcgccgaacccgatgtggtgctggcctgcgcgggcgacatcccgacgctggagacgctggccgccgccgacatcctgcgccgggagctgcccgacctggcggtgcgggtggtcaacgtcgtcgacctgatgcggttgcagcccgactccgagcatccgcacgggctaccggaccgcgaattcgacgcgctgttcaccagggaccggccggtcatcttcgcctaccacggctacccctggctgatccaccggctcacctatcgccgcgccaatcacgcgcagctgcacgtgcgcggcttcaaggaacgcggcaccaccacaacgcctttcgacatggtgatgctcaacgacctggaccgcttccacctcgtcatcgacgtgctcgaccgggtggaggggctggccagtcgcgccgcgatgctgcgccagcgcatggtcgacgcccggctcgccgcgcggatgtacacccgcgagcacggcgaggacgacccggcaatcgccaattggacctgggaaccgagcgagcggaactcacgtagtgagtga

SEQ ID NO: 237 - DNA, 2364 bp, Mycobacterium intracellulare ATCC 13950
atgacccacgcaaccgcgctctccgacgacgaactcgccctgatcgacaagtactggcgtgccgccaattatctgtcggtcgggcagatctacctactggacaacccgctgctcaccgagccgctgaccatcgatcacgtcaaaccgcggttgctgggtcactggggcaccacccccgggctcaacctcgtctacgcgcacctgaaccgggtcatccgccaccgcgacgccgacgtcatctacgtgaccgggccggggcacggcggaccggggctggtcgccaacgcctacctggaaggcacctacagcgaggtctacacgggcatcgaggaggacaccgagggcctgcgcaagctgttccggcagttctccttccccggcggcatccccagccacgtcgcggcccagacgccgggatccatccacgagggcggcgagctcggctacgcgctggtgcacgcctacggcgccgcgctggacaacccgtatctggtggtggcctgcgtcgtcggtgacggcgaggccgaaaccgggccgctggccgccagctggcactccaacaagttcctcaaccccgtcaccgacggcgccgtgctgccgatcctggcgctcaacggctacaagatcgccaacccgacggtgctggcccgcatcccgcacgccgaactggaatcgctgctgcgcggctacgggtaccgcccgatcacggtcgccggtgacgacccggccgatgtgcatcggcaacttgccgccgccctcgacgacgccttcgacgacatcgccgccatccagagtgcggcccgcggcggcaacggggtcgagcggcccgtgtggccgatgatcgtgctgcgtacccccaagggctggaccgggccaaagatggtggacggcaagaaggttgagggcacctggcgctcgcaccaggtgccgctggccgcgacgcgcgacaaccccgaacaccgtgcccagctcgaagagtggctgcgcagctatgggcccggggagcttttcgacgaaaacggccggctgcggccggagctgcgggcgctggcgcccagcggggatcgccggatgagcgccaacccccacgccaacggcgggctgttgctgcacgacctcgacctgcccgacttccgcgactacgccgtcgccgtcgagcgaccggcggccgtcacgcacgaggcgacccgggtgctgggcgggttcctgcgcgacgtgatcgcccgcaacaaggaccgattccggctcatggggcccgacgagacggcctccaaccggctcgacgccgtctacggatcgaccgacaaggtgtggctgtccgagatcgagcccgacgacgagcacctggcgcccgatggtcgcgtcatggaggtgctgtccgagcacctgtgccagggctggctggagggctacctgctgacggggcggcacggcctgttcaactgctacgaggcgttcgtgcacatcgtcgactcgatgctgaaccagcacgcgaaatggcttgccaccagccgggaattgccgtggcggcggccgatcgcgtcgctgaactacctgctgagctcgcacgtgtggcggcaggaccacaacggggcgtcccaccaggacccggggttcatcgacctggtcgccaacaagcggcccgagctgacccgggtgtacctgccgccggacggtaacacgctgctgtcggtggccgatcactgcctgcgcagccgcgactacatcaacgtcatcgtcgccggcaagcagcccgcgctggcctatctcgacatggatgaggccgtcgcgcactgcacccgcgggctgggcatctgggagtgggcgagcaccgcgaccgacgaccccgacgtggtgctggcgtgcgccggggacatcccgacactcgagacgctggccgccgccgacatcctgcgctccgagctgccggagctggccgtccgcgtggtcaacgttgtcgacctgatgcggctgcagcccgacaccgagcacccgcatggcctgccggaccgcgaattcgacgcgttgttcaccccggacaggccggtgatcttcgcctaccacggctatccgtggttgatccaccggctgacctacagccgcaccaaccacgcgcatatgcacgtgcgcggcttcaaggaacgcggcaccacgacgacgcccttcgacatggtgatgctcaacgatttggaccgcttccatctggtcatggatgtcatcgaccgggtcgacggattggccagccgcgccgccatgctgcggcagcgcatggtcgacgcccgcctggccgcgcggatgtacacccgcgagcacggggaggacgacccgaagatttcggggtggacctggggcccgagcgactga

SEQ ID NO: 238 - DNA, 2421 bp, Mycobacterium abscessus
atgaataccgcactgtcagtgactgattcacagattccgacatacccgcgcccgctctccgcggaggaagtcagacagatcgacgcctactggcgcgccgcgaactacctgtcggtgggccagatctacctgttggacaatcccctgttgcgcgatccgctcaccgcaagccacatcaagccccgcttgttgggacactggggcacgacgcccggcctcaacatcatctatgcacatctcaatcgcattatccgccaacgtgataccaatgtcatgctggtcacgggccccggacacggcggccccggggtggtggccaacacctacctggaaggcagctacagccgcttctacgcacacatcggccaagacctggacggcttgcgaaaactgttcaggcaattctccttccctggcggcattcccagccatacggctccggagacacccggctcgatccacgaaggcggcgagctcgggtacgcgctggcgcacgcatatggcgccgccttggataatccagacctggtggtcgcgtgcgttatcggcgacggggaggccgagaccgggcccctcgccgcgagctggcactccaacaaattcgtcaatcctgccaccgacggcgcggtgctacccatcctgcatctcaacggctacaagattgccaacccgacggtattggctcgcatccccgaagacgatctcacggcgcttctgaccggatacggtcatgatccgcgaatagtcgtcggcgacgatccggccgaggtgcaccagcaattggccgcggcatgtgattgggccttcgaccggatctcgcatatccagcaagaagcccgacaggaacgagcggcgcatcttccccgctggccactcattgtgctacgcactcccaagggatggaccggaccgaaaatggtcgaaggtgtgcccgtggagggaacctggcgttctcatcaggtaccactggccgaatgccgcaccaacccatcacaattgatgcagctggccaactggatgcacagctaccgacccgaggagcttttcgacgaccgtggggtgctgcggcctgaggtggccgggctggctccccgtacggaaaaggcgataggtagcaacccacacgccaacggcggcctgttgattcgggagcttgacctgccggaggtcgatcaatacgcggtccccgtgggatctccgggcgcgatgaccgcagaagcaaccaaagtgctcggcgcctatcttcgcgatgtgatcgatctcaacccgaacaacttccggctaatgggccccgatgagacggcatccaatcgcttgtcgacggtctacgaacgcaccgacaaggtatggctggaacgtagcgaaaccaccgatgaacatttgggccccgagggccgggtgatggaagtactctccgaacacctgtgtcaggggtggcttgagggatatctcctcaccggacggcacggcctcttcaactgttacgaggccttcgcccatattgtcgactcgatgctcaaccagcatgccaaatggctttccagcagctcagaagttccgtggcgacagccgattccttctttgaactatctactgacatcccatgtttggcgccaagaccacaatggcgcgtctcaccaagacccggggtttatcgatcacgtcgccaacaagcgcccggaggtagtgcgggtgtatctaccgcccgacgccaacacgctcttggcagtcaccgaccattgtctgcgtagcaggcactgcgtcaatgttgtggtggcgggtaaacaacctgccctgacctatttgagcatggaggcggcacgcgcacactgcgccagagggctgggcatctgggattgggcgagtaatgcgccgaacgagccggatgtcgtgctggcctgcgccggagatgtaccaacgctggaaaccttggcagccgcggacatcttgcgccggaggttgcccgagctcgcggtccgggtaatcaatatcgtggacatcatgcgcttgcaaccagcatctgagcatccacatggactgccccacactgattttgacgcacttttcacccctgataaaccgatcatcttcgcctaccacggctatccctggttgatccaccgccttgcctaccgccataccaatcacgatcggatgcacgtacgcgggttcaaggatcggggcaccaccacaacaccttttgacatggtgatgctcaatgatctggaccgtttccaccttgtcatggatgttatcgacagggtcgagggtctgggcagccgagccgcaaacctacggcaggaaatggtcgacgaccgaatcgctgcctgccggtacacccgagagcatggccgggatgatcccgtgatcgccgactgggtatgggaacacgaactcggttccctgagtggcagtcgctga

SEQ ID NO: 239 - DNA, 2394 bp, Janibacter sp. HTCC2649
gtgaacgttggtggcatgacgactctcgcacctgcccccgccgcagcactgactgacctcgagggggtcgattcctggtggcgagccgcgaactacctctccgtcggccagatctatctgcgcgacaaccccctgctccgagaacccctcgcggccgagcacatcaagccgcgccttctgggccactggggcacctcacccgggttgaacctcctgtgggcccacctcaaccgcgccatccgtcgtcatgccgcgccgacggtcttcatcgccgggccggggcacggagggccggccgtcgtcgcgaatgcctacctcgacggcacctactcggacctcttccccagcatcaccggtgacacggcgggactcacccggctgtttcgccagttctcctcgcccggcggcatccccagccacgcgtctccgcacaccccgggctcgctccatgagggcggcgagctgggctactccttggcccacgcctacggcgtggccttcgacaaccccgacctcaccgtcgcgtgcgtcatcggtgacggcgaggccgagaccggagccctgtccgcgagctggcagtcgacggccttcatcaacccggcccgtgacggtgcggtcctgccgatcctccacctcaacggctacaagatcgccaaccccacggtcctcgcgcgccagcccgagagcgtgctcaggtcgctcctgatcggccatggccacgacccgctcttcgtcgagggcgatgaccccgtggcagtgcacgaggcgctagcggatgccctcgacacggcataccttcgcctcgccgagctccgcggaacgggcgccggccatcccctccaatggccgatgatcgttcttcgcaccccgaagggctggaccggaccggccacggttgacggccacacagtcgaaggttcgttccgctcgcaccaggtgcccatcgccgccccccggacgaacccagagcatctccgactcctcgaggactggctgcggtcctaccgtccggaggaactcttcgacgaggtgggagccgtccgcgccgagatccgtgcgctggcgcctgcccccgaactgcggatgagcgcgtccgtccacgcaaacggcggagtcgtcctgcgtgacctcgtgctgccggcgcaccgcgactaccaggtgcccgtcggcgagccggctcgcgaactgcgctctgcgacaggggcgctcggcccgtggctgcgcgatgtggtgcgcgacaaccctcacaacttccgtgtcatgggccctgacgaaaccgcgtccaatcggctgcaggccatcttcgagcaatcagggcgcgcgtgggccctcccgatccgcgccggagacgaccacctcgacgtcgacgggcgcgtgatggaggtgttgtcggaacacctctgccagggctggctcgagggctacctgctcagcggccgacacggactcttcaactgctacgaggccttcatccccatcgtcgactccatgctcaaccagcacgcgaagtggttgaaggtctccgccgaagtgccgtggcgtcggcccatcgcctcactgaactacctcctgacctcgcacgtctggcggcaggaccacaacgggttctctcaccaggaccccggcttcctcgaccacgtcgtgaacaagaaggcacagaccgtccgcgtctacctgccgccggacgccaacaccctgctcagcgtcgccgagcactgcctccggtcgcgctccctcatcaacgtcatcgtggccggcaaacagcccgcgctgaccttccttgatccggtgcaggccgatgcccactgcgcccgtgggctcggcctgtgggagtgggcgagcacggatggaggagcgaatccggatgtcgtcctggcctgcgccggcgacgtcccgacgctcgagatccttgcggccgccgacatccttcggcaccgactgcccgacctgcgcgtgcgcgtggtcaacgtcgtcgacctcatgcgtctggaaccggacagcgagcacccgcacggcttgtccgaccgtgacttcgacgctctctttccgccggactgccccgtgatcttcgccttccacggatatcccggcctcatccaccgcctcacctaccgacgccacgcgcacccccagatccatgtccgcggctacaaggaggagggcacgacgacgaccccctttgacatggtgatgctcaacgacctcgaccgcttccatctcgtcatggacgtcatcgaccgggtgccccagctgagcgaggtgtcagcgggtctgcgccaggagatggccgacgcgcgattggccgcccgcgactacacgagggtccacggtgaggaccacccggccatcgcgaactggtcgtggcctgccaccagcacctccgtgcaggaatga

SEQ ID NO: 240 - DNA, 2379 bp, Thermobifida fusca YX
atgacatcgaccgaatcagttccccgccaggctctcaccgtcaccgaactccaggagatcgaccgctactggcgggccgccaactatctgtctgtcggccagatctatctccaggacaatccgctgctccgcgaaccgctcgtccccgagcacatcaaaccgcggctgctcggccactggggcaccacgcccggcctcaacttcatctacgcccacctcaaccaccagatccgcagccgcggcacggagatgatgtggatcgtcggcccggggcacggcgggccttcccccgtcgccacagcatggttggacggcgtctattcgcagatctatccggacgtcggccgaaacgcggaaggcatgcgccggctgttccgccagttctccttccccggcggagtgcccagccacgctgccccggagacccccggctccatccacgaaggcggcgagctcggctacgcgctcgcccacgctttcggtgcagccttcgacaaccccgacctggttgtcgccgcggtcgtcggggacggtgaagccgaaaccggcgccctgtccggaagctggcagtcgatccgtttcctcaacccggcgcgcgacggcgcagtcctgccgatcctgcacctcaacggctacaagatcgccgggccgaccgtgctggcccgcatccccgaggaagacctgctggcccagatgcgcgggcacggctacgaaccgcatgtggttgcgggcgacgacccggacacggtccaccagttgatggccgggactctcgcgagctgcctggaacgcatcgacacgatccggttccgtgcccggcaggaggacggggacatcgcgaacgtgcgctggcccatgatcatcctgcgcacccctaaaggctggactggtccccgcgccgtggacggaaaacccgtggaagacacgtggcgttcccaccaggtgccgcttgctgccacgcgggagaacccggagcacttgcgcctgttggaggagtggctgcgcagctaccgtccggaggagctgttcgacgagcacggcgcgccccgcccggagaccacgacggtggtgcccccgccggactgccggatcagcagcagcccgcacgccaacgggggcctgctgctgcgtgacctcctcctgccggacttccgggactacgccgtcgaggtagaacgccccggtgtggacatggtggaagccacccgggtactgggcgggttcctccgcgatgtggtcgccgcgaacccgcacaacttccggatcatgggccctgatgagacccagtccaaccggctcggcgcggtcttcgagtccactgaccgggcgtggaccacggaacgcctccctgtcgaccagcagctctcccccgatgggcgggtgatggaggtcctcaacgagcagctctgccaaggctggctggagggctacctgctgaccgggcggcacggcctgttcaactcctatgaggcgttcatccacatcgtggactcgatggtcaaccagcacgccaaatggttgaaggtgagccgcgagctgccgtggcggcgtcccatctcttcgctgaattacctgctcagctcgcacgtgtggcgccaggaccacaacgggttcagccaccaggaccccggcttcatcgaccacgtcgtcaacaagaaacccgagatcatccgggtctatctcccgccggactgcaacacgctcctgtgcaccatggaccactgtctgcggtcgcggaacttcatcaatgtggtcatcgccggcaagcagccgcagctcacctacctgccgatggaagcggcgatcgcgcactgtacgcggggcgcggggatctgggagtgggcgagctcggacgagggtgcagagcctgacgtggtgctggcctgtgcgggggacgtgcccaccctggagacgctggccgcagcggacctgctccgccgccacctgcctgagctgcgggtgcgtgtggtcaacgtggtggacctgatgcggctcagcaacgaaggcgagcatccgcacgctatgaccgaccgcgaatacgacaccttgttcacccgggacaagccggtgatcttcgcgttccacggctacccgtggctgatccaccggctgacctaccgccgcgccgggcatcccaacctgcatgtgcgcggctacaaggaggaaggcacgacgaccaccccgttcgacatggtgatgctcaatgacttggaccgcttccacctggtgatggacgtgatcgaccgggtgcccgggctgggggtgcgcgcagccgggctccgccagcacatgcaggacgagcggctgcgctgccgcgcctacacccgccagtacggggaggacgccccggacatccgcaactgggtgtgggagccctga

SEQ ID NO: 241 - DNA, 2379 bp, Thermomonospora curvata DSM 43183
atgactgacaccgccgtacccgttcatcccaccgcgccgaccgatgcggaggtgcgcctgctggacgctcactggcgggccgccaactacctgtcggccgggcagatctacctgctggacaacccgctgctgcgggagccgctgcagcccggccacatcaagccgcgcctgctgggccactggggcaccacgcccggcctgaacttctgctacacccacctcaaccgggtcatcaggacccgcgaccagaacatgatctacatcatggggccgggccacggcgggccggcggcggtggccaacgcctggctggagggcacctacagcgaggtctacccggaggtctcctgggacgagaccggcatggcccggctgtttcggcagttctccttccccggcggcgtgcccagccacgtggcccccgagacgcccggctccatccacgagggcggcgagctgggctatgcgctggtgcacgccttcggcgccgccttcgacaaccccgacctggtggtggcctgcatcgtgggcgacggcgaggccgagaccgggccgctggcggccgcctggcactccaacaagttcctcgacccggtgcgcgacggcgcggtgctgccgatcctgcacctgaacggctacaagatcgccaaccccacggtgccggcccgcatccccgaacgggaactgctggcactgttcgaaggctacggctaccgcccctacgtggtcgccggagacgacccggccgtcatgcaccggaagatggccgagaccctcgaccgggtcatggatgagatcaccgccatccagcgcaacgcccgcgagggcgggaacaaaggccgcccccgctggccgatgatcatcctgcgcacccccaagggctggaccggccccaaggaggtcgacggcgtgccggtggagggcacctggcgctcccaccaggtgccgctgccgggggtgcgcgagaaccccgagcatctggccctgctggagcggtggctgcgctcttaccggccctgggagctgttcgacggcaccggccgcccggtgccgcaggtgctggcacagaccccgcggggggagcggcggatgagcgccaacccgcacgccaacggcgggctgctgctgcgcccgctgcgcctgcccgacttccgcgactacgccgtcccggtggaccggccggccaccaccttcgccgagccgacccgggtgctgggcgcgctgctgcgggacgtgatcgccgccaaccccgacaacttccgcatcatgggcccggacgagaccgcctccaaccggctgaacgcggtcttcgaggtcaccgaccggacctggcaggccgagcggctgcccaccgacgaccacctggccccctccggccgggtgatggaagtgctcagcgagcacctgtgccagggctggctggagggctacctgctgaccggccggcacggcctgttcaactgctatgaggcgttcatccacatcgtcgactcgatgttcaaccagcacgccaagtggctgaaggtcacccgcgccctgccgtggcggcggcccatcgcctcgctgaactacctgctgtcctcgcacgtgtggcggcaggaccacaacggcttcacccaccaggaccccggcttcctggacgtggtgatgaacaagaaacccgagatcatccgggtctacctgccgccggacgccaacaccctgctggcggtgaccgacggctgcctgcgctcccgcgactgcatcaacgtgatcgtggcgggcaagcagccggtgctgaacctgctgccgatggacgacgccgtcgtccactgcgcccgcggcatcggcatctgggagtgggccggcaccgacgccggcgccgaacccgacgtggtgctggcctgcgccggggacgtgccgaccctggagacgctggccgccgccgacctgctgcggcgccatctgccacagctgcgggtgcgggtggtcaacgtggtggacctgatgcggctgcagccgcccaccgagcacccccacggcctgaccgacccggagttcgacgcgctgttcaccaccgacaagccgatcatcttcgccttccacggctacccgtacctgatccaccggctcacctaccgccggcacgggcacggcaacctgcatgtgcgcggctacaaggaggaaggcaccaccaccacgcccttcgacatggtcatgatgaacgacctggaccgcttccacctggtcatggacgtcatcgaccgggtgccggggctgggcgtgcgggccgggcacgtccgccagctcatggcggacgagcggatccgccaccgcgcctacacccgcgagcacggcgaggaccccgccgacatcaccgaatgggtctggccgcactga

SEQ ID NO: 242 - DNA, 2316 bp, Streptosporangium roseum DSM 43021
atggatgcactcgcacacgtcgacgcctactggcgggcggccaactacctgtcggtcggccagatctacctgctggacaatccgctgctggccgagccgctggcccccgagcacatcaagccacgcctcctcgggcactggggcaccactccggggctgaacttctgcttcgcccacctcaaccggatcatcaccgagcgcgaccaggacatgatctacatcgtcgggcccggccacggtggtccggcggcggtcgcccacgcctggctggagggctcctatacagagaaatatccggatattgggcaggacgccgtcggcatgcagcggctgttccggcagttctccttccccggcggcatccccagccacgtcgcccccgaggtcccgggctccatccacgagggcggtgagctcggctactcgctggcccacgcctacggcgccgccttcgacaacccgcacctggtggtggcctgcgtcatcggcgacggcgaggccgagaccgggccgctggcggccggctggcactccggcaagttcctcaaccgcgagcacgacggggtcgtgctgccgatcctgcacctgaacggctacaagatcgccaacccgaccgtcctcgcccgcatccccgaagaggagctggtcaagctcatcgaggggtacggctaccgcccgcacatcgtctccggcgacgacccggcggtcatgcacggactgatggccgagaccctcgaggtggtcttcgacgagatcgccgagttcaaggacggccgcgccgagcgcccgccgatgatcgtgctgcgcacgcccaaggggtggaccggcccgcgcgaggtggacggcctgccggtcgagggcacctggcgggctcatcaggtgccgctgtcggcggtccgccagaacgccgagcaccgggcgatgctggaggagtggatgcgctcctaccggcccgccgagctcttcgacgaccgggggcggcccgtcgcggagatcctgcggacggtgccgcaaggcccgcgccggatgagcgccaacccgcacgccaacggcggcgagctgctcaagccgctggcgctgcccgacttccgcgaccacgccgtcgaggtcaaggctcccgccgcgcagtcgagcgagccgaccaaggtcctcgggcagttcctgcgcgacgtcatcgccgccaacccggacaacttccggctgatggggccggacgagaccgcctccaaccggctgtcggccgtgttcgaggtcaccgaccgcgtgtgggacgccgagacgctgcccacggacgagaatctcggcccggacggccgggtcatggaggtgctcagcgagcacctgtgccagggctggctggagggctacctgctgaccggccgccacggcctgttcaactgctacgaggcgttcatccacatcgtcgactcgatgttcaaccagcacgccaagtggctggagtcgtcccacaagatcacctggcggcgtccggtcgcctcgctgaactacctgctgtcgtcgcacgtgtggcggcaggaccacaacggcttcagccaccaggatcccggcttcatcgacgtggtgatgaacaagaaggcctcggtggtgcggatctacctgccgccggacgccaacaccctgctgtcggtcggcgaccactgcctgcgctcgcgtgactacgtcaacctcgtcgtggccggcaagcagccggtgctggatctgttcacgatggaggaggcgatcgcgcactgcacccgtggcctgggcatcctggagtgggcctccaccgacgcgggagccgagcccgacgtggtgctggcctgcgccggagacgtgccgacgctggagaccctcgccgccgccgcgctgctgcgcgagcacctgcccgagctgaaggtccgcgtggtcaacgtggtggacctgatgcggctgcagccgccgtcggaacacccgcacggcatgtcggacgccgagttcgacaccctcttcaccgccgacaagccgatcatcttcaatttccacggctatccctggtcgatccaccggctgacctaccggcggcgcggccaccacaacatccacgtgcgcggctacaaggaggagggcaccaccaccacgccgttcgacatggtgatgctcaacgacatcgaccgcttccacctggtgatggacgtcgtcgaccgggtgccgggtctgggcgccaaggccgcgcacctgcgccagcagatggtcgacgagcggctgcgcgcccgcgcccacacccgcgagtacggcgaggacccggccgagatccgcgactggacctggccctactga

SEQ ID NO: 243 - DNA, 2349 bp, Nocardiopsis dassonvillei subsp. dassonvillei DSM 43111
atggccctgcaagaggacgaactacgaggcgtggacgcctactggcgggccgcgaactacctgtcggtcgggcagatctacctgctggacaacccgttgctgcgtgaggaactgcggcccgagcacatcaagccgcgcctgctggggcactggggcaccaccccggggctgaacttctgctacgcgcacctgaaccgggcgatccgtgatcgggacctggagatgatgtacgtgatggggccggggcacggcggtccggccgcggtggccaacgcctggctggagggcacctacagcgaggtgtaccggcacgtgaaccaggacgtggaggggatgcggcggctgttccggcagttctccttccccggcggggtgcccagccacgtggcgcccgagacgccggggtcgatccacgagggcggggagctggggtactcgctggcgcacgcccagggcgcggccttcgacaaccccgacctggtggtggcgtgcgtggtgggcgacggggaggccgagacgggccccctggcgggcagttggcgcggcaacgcgttcctggacccggtgcacgacggcgcggtgctgccgatcctgcacctgaacgggtacaagatcgccaatcccacggtgctggcgcggatccccgagcgggaactgctgtcctacttcgaggggctggggtaccggccgctgctggtcagcggtgaggatccggagtacatgcacaggcggatggccgaggcggtggacgaggctctggaggagatcgcgcggatccagcaccgggcgcgggtgtcgggtgtgcgcgggcgcgcggtgtggccggtggtgatcctgcgttcgcccaaggggtggacggggccggcggaggtggacggtgtgccggtggaggggacgtggcgttcccaccaggtgccgttgggccaggtgcgttcggacgaggggcacctgaggcagttggaggagtggatgcgctcctaccggcccgaggagttgttcgaggagtcgggtgccccggtggccgaggtgcgcgcgcaggccccggagggcgaacggcggatgagtgcgagtccgcacgccaacggcggggtgctgcgtcgggagctggtgctgccggactttcgcgggtacgcggtggacgtgggccggaacgggacgcagaccggtgaggcgactcgggtgctgggccgtttcctgcgggacgtgatccggtccaatccgcgcacgttccggttgatggggcctgacgagacggcctccaaccggttggacgcggtgttcgaggcctcggacaaggagtggcaggccgagcggctggcgaccgatgagcacctggggcccggcggccgggtgatggaggtgctcagcgagcacctgtgccaggggtggttggaagggtacctgttgaccgggcggcacgggctgttcggctgttacgaggcgttcgtgcacatcgtggactcgatgttcaaccagcacgcgaagtggttgaaggtgtcccgggatctgccgtggcggcggccgatctcgtcgttgaactacctgttgacctcgcacgtgtggcgtcaggaccacaacgggttcacccaccaggatccggggttcctggacgtggtgctcaacaagcccgcggaggtggtgcgcgtgtacctgccgccggacgccaacacgctgttgtcggtggccgaccactgcctgcgctccagcgactacgtgaacgtggtggtggcgggcaagcaaccggggctggggtacctgtcgatggaggaggcggtggcgcactgcgcgcgcgggatcgggatctgggagtgggccagtaccgacggtggggcggatccggacgtggttctggcctgtgcgggtgacgtgcccacgttggaggttttggcggccgcggacctggtgcgccgctggttgccgggggtgcgggtacgggtggtcaacgtggtggacctgatgcggttgctgcccgacagcgatcacccgcacgggttgcccgacgccgagtacgacgccctgttcaccacggacaagccggtggttttcgccttccacgggtatccgtggctggtgcaccggttgacctaccgcagggcgggccacgcgaacctgcacgtgcgcggataccgggagcggggcacgacgaccacaccgttcgacatggtgatgctcaacgacctggaccggttccatctggtcatggacgtgatcgaccgggttccgggactgggccagcggtcggcccaggtgcgtcagcggatggtggacgagcggttgcggcaccgcgcccacacccgggagttcggtgaggatccggcggagatccgtgagtgggtgtggcggtactga

SEQ ID NO: 244 - DNA, 2397 bp, Stackebrandtia nassauensis DSM 44728
atgtcgaaactggagcaactggaacaacccgcgctgaccgacgacgaactggccgccgtcgacgcgtactggcgggcggccaattacctgtcggtcgggcagatctatctgctggacaacccgttgctgaccgagccgctgcggccggagcacatcaagccgcggttgctggggcattgggggaccacaccggggctgaacttctgttacgcgcacctgaaccgggcgatcaaggccctcgacctcgacatgatgttcgtgaccgggccgggccacggtggcccggcgctgctggccaacagctggctggagggcagctacagccaggcgtatccggcggtggcccgggacggcaaggggatgcggacgttgtttcggcagttctcgtttcccggcggcgtccccagccatgtggcccccgaggtcccggggtccattcacgaaggcggggagctgggttactcgctggcgcacgcctacggtgccgcgttcgacaatcccgatctgatcgtggcgtgtgtggtgggtgacggcgaggccgagaccggcccgctggcgacgagctggcacgccaacaagttctgcgacccggtcggtgacggggcggtgttgccgattctgcacctcaatggctacaagatcgccaacccgacggtgctggcccggatcccccgcgacgaactggacgcgctgctgcgcggatacggccacaaaccatactatgtggagggtcacgatccggaggcgatgcatcaggccatggccgaggtcgtcgacgccgcgatcgccgatatccgggccatccaacgccaggcccgcgacggcgggccgagccgacggccgcggtggccgatggtggtgttgcgaacccccaagggctggaccggtcccggcagcgtcgacggggtgccggtggaggggacctggcggtcgcatcaggtgccgctgtccggggtgcgcgacaacccggatcacctgcggcagctggaggagtggctgcggtcgtaccggccgggcgagttgttcgacggcgacggtgccccggtcgcgcggctgggggagctggtccccgacgggcagcgacgcatgggcgccaatccgcacgccaacggcgggctgctgctgcgcgacctggagcttcccgacttccgcgactacgcggtcgcggtggaccagcccggcgtcacctcgtccgaacccacccgggtgttgggccgtttcctgcgggatgtgctgcgcgacaacgccgatacggcgaacttccggctgttcgggcccgacgagaccgcttcgaaccggctggacgcggtgtacgaggtgacgggcaaggcctggcagtctccgatcgtggacaccgacgagaacctgtccgcgcacgggcgggtggtggaggtgttgtcggagcacgtgtgtcagggctggctggagggctatctgctgacggggcggcacggtctgctgtcgtgttatgaggctttcgtccacatcgtggattcgatgttcaaccagcacgcgaagtggctgaaggtgtcgcggggcctgccgtggcggcggccggtggcgtcgttgaactatctgctgacctcgcacgtgtggcgtcaggaccacaatggtttctcgcatcaggatccgggtttcatcgaccatgtggtcaacaagaaagccgacatcatccgggtgtatctgccgccggacaccaacacgctgctgtcggtcggggatcacgtgttgcgcagcaagaactatgtcaacgtgatcgtggcgggtaagaacgacagccccaactggctcagcgtcgacgaggcggtgctgcactgtgcccggggtgctgggatctgggactgggccggtaccgaggccgagggtgaggaacccgacgtcgtgttgggttgcgccggtgacgcgcccacactggaggtgctggccgcggcgtccctgctgcggcgacatcttccgtctctgcgggtgcgggtcgtcaacgtcgtggacttgatgcggttgcagtcggcgacggagcacccgcacggcatgaccgatcgggagtacgacacgttgttcaccgctgatcggccggtgatcttcgcgtatcacgggtacccgtggctgatccaccgtttgacgtaccgccgcaacggccacgacaacctccacgtgcgcgggtacaaggaggaggggacgaccacgacgccgttcgacatgctggtgctcaacgacatggaccggttccagctggtcaccgacgtcatcgaccgggtgccggggttgggtcgtcgtgccgccggggtgcggcagtcgatgcaggacaaccggacccggcaccgctactgggtgcggcagcacggtgaggatctgccggaggtgcgtgactgggaatggtctgatgggcggacggggtga

SEQ ID NO: 245 - DNA, 2370 bp, Actinosynnema mirum DSM 43827
atgtcagcgcagaccggtacgaccggtgcagacctcaagctgatcgatgcttactggagggcggcgaactacctgtcagcggggcagatctacctgctggacaaccccctgctcggcacgccgctggaagcggcgaacatcaaaccgagactgctcgggcactggggcacgacccccggcctgaacttcgtctacgcgcacctcaaccgcgtcatcaagcagcgggaggccgaggtcctgttcatcaccggccccggtcacggcggtcccgcgctgctggccaacacctggctggagggcacctacagcgagacctacgccgaggtgccgcaggacgcgcggggcatggcgaagctgttccggcagttctcgttccccggcggggtcccgagccacgtcgcgccggaggtccccggctccatccacgagggcggggagctgggctactcgctggcgcacgcgttcggcgcggccttcgacaaccccgacctggtcgtcgcctgcgtcatcggcgacggcgaggccgagaccggcccgctggccgccagctggcacgccaacaagttcctgaacccggcgcaggacggcgcggtgctccccatcctgcacctcaacggctacaagatcgccaacccggcgctgctcgcccgcatcccgcacgaggagctggacagcctcctgcgcggctacggctacgccccggtctacgtggagggccacgagccggaggtcatgcacgccgcgatggccgaggcgctcgacggggtcttcgacgccatcgagcggatccaggcgcgcgcccgctccggcgaggacaccacccgcccggcgtggccgatgatcgtgctgcgcagccccaagggctggaccgggccgtccgaagtggacggactccagatcgagggcacctggcgcgcgcaccaggtgccgctctcgggcgtgcgcgacaaccccgagcacctgcggatgctggagcagtggctgcgctcctaccggcccgaggagctcttcgacgcgaacggcgccccggtgccggagctcggcgagctggtcccgcccggccacctgcgcatgggcgccaccccgcacgccaacggcggaaccctgctgcgcgacctgcggatgcccgcgctgagcgagcacgccgtggccgtgcccgagcacggcggcagcacctccgagcccaccagggtcctcggacggctgctgcgcgacgtggtcgagctcaacgacgcccagcgcaacttccgcctgttcggcccggacgagaccgcctccaaccggctcgacgccgtctacgaggtcaccggcaagcagtggcagggcgagaccctgcccgtggacgaccacctggtgcgcgcgggccgcgtcgtggaggtgctgtccgagcacctgtgccagggcttcctggagggctacctgctcaccgggcggcacggcctgttcaactgctacgaggcgttcacgcacatcgtcgactcgatgttcaaccagcacgccaagtggctgggcacgcaccgcaagctcggctggcgccgcccgatcgcgtcgctgaactacctgctcagctcgcacgtgtggcgccaggaccacaacgggttctcccaccaggaccccggtttcatcgaccacgtcatgaacaagaaggccgaggtcgtccgcgtctacctgccgccggacaccaacaccctcctgtcggtcgcggaccactgcctgcgcagccgcgaccacgtgaacgtggtggtggcgggcaagaaccagaccccggactggctcggcccgcaggaggcggcgctgcactgcgccaggggcctgggcatctgggagtgggcaggcaacgacgacggtgtggaggagccggacgtggtcatggcctgcgccggcgacgcccccacggtcgaggtgatggccgcggtgtccctgctgcgcgagcacctgccgtcgctgcgggtccgcgtggtcaacgtggtcgacctgatgcggttgcagccggagagcgagcacccgcacggcctgtcggaccacgagttcgacgcgatcttcaccaccgaccggccggtgctgttcgcctaccacggctacccgtggctgatccaccgcctgacctaccggcgcaccaaccacaacaacatccacgtgcgcgggtacaaggaggagggcaccaccaccacgccgttcgacatgctggtgctcaacgacatggaccgctaccggctggtcatggacgtgatcgaccgggtgccgggcctcgggccgcgcaccgcccggctgcgccagctgatgaccgaccagcgcaccaggcacaacgcgtggatccgggagcacggcgaggacctgcccgaggtgcgggactggagctggcggtcctga

SEQ ID NO: 246 - DNA, 2454 bp, Streptomyces coelicolor A3(2)
atgtgcacgggcaccccgtgcccgcgcgccccgaccggctgtcccgacacggaaggaccaccgatgtccgtcgacacgcagcaggcgccccccgagcccacggacgaggagctcgccgggctggacgcccactggcgcgccgcgaactacctcgccgtcggccagatctacctgatggccaaccccctgctgaccgaccccctgcgtcccgagcacgtcaagccccgtctgctcggccactggggcacctcacccggcctcaacctggtccacacccatctcaaccgggtgatcaaggcccgcgacctcgacgccctgtgcgtctggggccccggccacggcgggcccgccgtgctggccaacgcgtggctggagggctcctacaccgagacctacccggacatcacccgggacgcggccggcatggcccggctgttcaagcagttctccttccccggcggcgtaccgagccacgtcgcgcccgagacgccgggctccatccacgagggcggcgagctgggctacgcgctctcgcacgcctacggcgccgccttcgaccacccggacctggtggtcgcctgcgtgatcggcgacggcgaggcggagaccggcccgctggcgacgtcctggcactccaacaagttcctcgacccggtgcacgacggcgccgtcctgccgatcctgcacctcaacggctacaagatcgccaacccgacggtgctcgcccgcctccccgagaccgagctggacgaactcctgcggggctacggacacgacccggtccacgtcaccggcgacgacccggccgccgtccaccgcgcgacggcccgcgccatggacaccgccctcgaccgcatcgccgcgatccagcgggccgcccgcgaggagggggccaccgggcgcccccgctggccgatgatcgtcctgcgcacccccaagggctggaccggcccggccgaggtcgacggactgcccgtggagaacacctggcgcgcccaccaggtgcccctgtccgccgtacgcaccaaccccgagcacctcgcgcagctggagcggtggctgcgctcctaccgtcccgaggagctgttcgacgacgccggtgcgccgcggcccgccgtcctcgcagcaatccccgaggggccccgccgcctgggcgccaccccgtacgccaacggcggcctcctgctgcgcgaactgcccgtgcccccgctggagaagtacgccgtccccgtcggagaacccggcgcgagcacgcacgaacccacccgggtcctcggcgacctgctccgggacgtcatggcggccaccacggaccggcgcgacttccgtctcgtcggccccgacgagaccgcctccaaccgcctccaggccgtctacgccgccaccggcaaggcatggcaggagcggacactgcccgtcgacgaggatctggaccggcacggccgcgtgatggagatcctgtccgaacacacctgccagggctggctggagggctacctcctcaccggcaggcacggactgttctcctgctacgaggcgttcgtccacatcgtcgactcgatggtcaaccagcacgtcaaatggctgcgcgtcacccgccgcctgccctggcgggcgcccatcgcctccctcaactacctgctcacctcccacgtgtggcgccaggaccacaacggcttctcccaccaggaacccggcttcgtcgaccacatcctcaacaagagccccgaagccgtacgggtctacctgccgccggacgccaacaccctgctctccgtggccgaccacgcgctgcgcagccgcgactacgtcaacgtgatcgtggccggcaagcagccctgcttcgactggctgaccatggaccaggccaaggcgcactgcgcgcgcggcgccggcatctgggactgggccggcaccgaggacggcagccgcgaacccgacgtggtcctcgcctgcgcgggcgacgtaccgaccctggagatcctggccgccgcccagctgatccgccaccacctgccggaactcgccgtgcgcgtggtcaacgtcgtcgacatcgcccgcctgctgcccagcggggaacacccgcacggcatgagcgacttcgagtacgacggcctgttcaccgccgacaagccggtgatcttcgcctaccacggctacccctggctgatccaccggctcgcctaccggcgcaccggccacgcccatctgcacgtgcgcggctacaaggagatcgggaccaccaccacgccgttcgacatggtggtcggcaacgacctggaccgctaccgcctcgtcatggacgtcatcgaccgcgtgcccgggctcgccgtgcgcgcggcggccgtacggcagcggatggaggacgcccggcagcggcaccacgactggatccgcgaacacggtgtggacctgcccgaggtcgccgactggacctgggaggcgccgcggtga

SEQ ID NO: 247 - DNA, 2505 bp, Streptomyces ambofaciens ATCC 23877
gtgacccgaacggccctgtcgggtacccgagcgcttcgctcggggttgggatgggcacggggcaccccggtccatgccggcccgaccgctgtcccgaaaaggaaaggaccccggatgtccgtcgacacccagcaggcgcccgccgagctcacggacgaggagctcgccggtctggacgcccactggcgcgccgcgaactacctctccgtcggccagatctacctgatggccaaccccttgctgaccgagcccctgcgccccgagcacgtcaagccccgcctgctgggccactggggcacctcacccggcctcaacctggtccacacccatctcaaccgggtgatcaaggcccgcgaactcgacgccctgtgcgtctggggtccgggccacggtggccccgcggtcctggccaacgcgtggctggaggggtcgtacaccgagacctacccggacgtcacccgggacgcggccggcatggcccggctgttcaagcagttctccttccccggcggcgtcccgagccatgtcgcgcccgagacgccgggctcgatccacgagggcggtgagctcgggtacgcgctctcgcacgcctacggtgccgccttcgaccaccccggcctggtggtcgcctgcgtgatcggtgacggcgaggcggagacgggccccctggccacgtcctggcactccaacaagttcctcgacccggtcgaggacggcgccgtcctgccgatcctgcacctcaacggatacaagatcgccaacccgacggtgctcgcccgcctccccgagtccgaactcgacgaactgctgcgcggttacggccacgaccccctgtacgtcaccggtgacgagccggccgccgtccaccgcgccatggcccgcgccatggacaccgccctggaccgcatcgccgccctccagcgggcggcccgcgagcagggcgccggcgaacgcccccgctggccgatgatcgtgctgcgcacgcccaagggctggaccggccccgccgaagtcgacggcctgccggtggagaacacctggcgcgcccaccaggtccccctgtccgccgtgcggaccgacccggaccacctgaggcagctggagcagtggctgcgctcctaccggcccgaggaactgttcgacgacgccggaggcccccggccctccgtcctggcctgcgtacccgcgggcgcccgccggctgggcgccacccccttcgccaacggcgggctgctcctgcgtgaactgccactgccacccctggagaagtacgccgtcccggtcgaacggcccggcgcgagcgcgcacgaacccacccgcgtcctcggcgacctgctgagggacgtcatggacgccaccgccgaccgccgggacttccgcctcgtcggccccgacgagaccgcctccaaccgcctccaggccgtctacgccgccagcggcaaggcctggcaggagcggacgcttcccgtcgacgaggacctcgaccggcacggacgggtgatggagatcctctccgagcacacctgccagggctggctggagggctacctcctcaccggccggcacggactgttctcctgctacgaggccttcgtccacatcgtcgactcgatggtcaaccagcacatcaaatggctcagggtgacccggcgcctgccctggcgcgcccccatcgcgtccctcaactacctgctcacctcccacgtctggcgccaggaccacaacggcttctcccaccaggaccccggcttcgtcgaccacatcctcaacaagagtcccgaagccgtccgggtctatctgccgccggacgccaacaccctgctctccgtcgccgaccacgccctgcgcagccgcgactacgtcaacgtgatcgtcgcgggcaagcagccctgcttcgactggctgtccatggaggaggcccgggtgcactgcgcgcgcggcgccggcatctgggaatgggccggcaccgaggacggcagccgcgaacccgacgtcgtactcgcctgcgccggcgacgtgccgacccaggaggtactggccgcggcccagctcatccgccgccacctgccggacctcgccgtgcgcgtggtgaacgtcgtcgacatcgcccggctgctgcccagcggggaacacccgcacggcatgagcgacttcgagtacgacggcctgttcaccgccgacaagccggtcgtcttcgcctaccacgggtatccctggctgatccaccggctcgcgtaccggcgcaccggtcacgcccatctgcacgtgcgcggttacaaggagatcgggaccaccaccacgcccttcgacatggtgctcggcaacgacatggaccgctaccgcctcgtcatggacgtcatcgaccgcgtgcccggcctcgccgtgcgcgcggcggcggtacggcagcggatggaggacacccggctgcgccaccacgactggatccgcgaacacggcgtcgacctgcccgaggtcgccgactggtcctgggacggctctccgtga

SEQ ID NO: 248 - DNA, 2385 bp, Streptomyces griseoflavus Tu4000
atgtccgtcgacacgcaccaggcgtccgccccgccgaccgacgaggagctgaggacgctcgacgcccactggcgggcggcgaactacctctccgtcggccagatctacctcatggcgaaccccctgctgaccgagccgctgcgccccgagcacatcaagccgcggctgctcggacactggggcacctctcccgggctgaacctggtgcacacccacctcaaccgggtcgtccgctcccgtggcctggacgccctgtgcgtctggggtcccggccacggaggcccggcggtggtcgccaactcctggctggagggctcgtacaccgagacctaccccgacgtcacacgggacgaggcgggcatggcgcggctgttcaagcagttctcgttccccggcggcgtgcccagccacgtcgccccggagacaccgggctccatccacgagggcggcgaactcggctactccctgtcccacgcctacggggcggccttcgacaaccccggcctgctggtgacctgcgtcatcggcgacggcgaggcggagaccggaccgctcgccgcttcctggcactcgaacaagttcctcgaccccgtccacgacggcgcggtcctgccggttctccacctcaacggctacaagatcgccaacccgaccgtgctcgcccggctccccgagcaggaactccgggcgctgctcgagggctacggccacgaacccctgtacgtcaccggcgacgaccccgccgccgtccaccggaccatggccgcggcgatggacaccgccctggaccgcatcgcggcgatccagcgggccgcccgcgaggagggtgccaccgaacggccccggtggccggtgatcgtgctgcgcaccccgaagggctggaccggccccgccgaggtcgacggcctgcccgtggaaggcacctggcgctcccaccaggtaccgctgtccgcggtccgggacgaccccgagcacctgaggcaactcgaacagtggctgcggtcctaccggcccggggaactgttcgacgaagcgggcgcgccccggccggacgtcctcgcgtgcgtccccgacggcccccgcaggctcggagccaccccgtacgccaacggggggcggctgctgcggcagctgcctctgcccccgctggagcagtacgccgtgcccgtcgaccagcccggcacgaccctgcacgaacccacccgggtgctgggcggactcctggagaacgtgatgcggggcaccgcgggccgacgggacttccgcctggtcggccccgacgagaccgcctccaaccggctccaggccgtctacgcggcgagcggcaaggcctggcaggccgggatcctcgacgtggacgaggacctcgaccggcacggccgggtgatggagatcctctccgagcacacctgccagggctggctcgagggctacctcctcaccggccgccacggcctgttctcctgctacgaggcattcgtccacatcgtggactccatggtcaaccagcacatcaagtggctgcgggtcagccgccgcctgccctggcgcgcccccatcgcctccctcaactacctgctcacctcacatgtgtggcggcaggaccacaacggtttctcccatcaggaccccggcttcgtcgaccacatcctcaacaagagtcccgaggccgtacgggtctatctgccgccggacgccaacaccctgctctccgtcgccgaccacgcgctgcgcagccgggactacgtcaacgtgatcgtggccggcaagcagccctgcttcgactggctgacgatggagcaggccgaggcgcactgcgcccgcggcgccggtgtctggcagtgggccggcacggagaccggcgaccgggagccggacgtcgtgctcgccgccgccggtgacgtccccacccaggaggtgctggccgccgcccagctgctgcgcggccgtctgccggacctggcggtccgggtcgtcaacgtcgtcgacatcgcccggctgctgcccagcgaggaacacccgcacggcatgaccgacttcgagtacgacggcctcttcacccgggacaagcccgtgatcttcgcctatcacggctatccctggcttatccaccgcctggcctaccgccgcaccggccaccggaacctgcacgtgcgcggctacaaggaggtggggacgaccaccacgcccttcgacatggtggtccgcaacgacctggaccgctaccgactggtcatggacgtcgtcgaccgcgtgccgggcctcgcggtacgcggcgcgaacctgcgccaggagatggcggacacccggctgcgccaccacgactggatccgtgcgcacggaaccgacctgccggaggtcgccgaatggtcctggcacggctga

SEQ ID NO: 249 - DNA, 2439 bp, Streptomyces sviceus ATCC 29083
ctgatcaacctgctgcgagaagggttcgtcatgccgctcggccccaataccgagacctccctcgacactccggacacccccgaccccctcgacgaggaggagctgagtgctctggacgcccactggcgggcggcgaactacctggccgtcgggcagatctacctcatggccaacccgctgctgaccgagccgttggcgcctgagcacgtcaagccgcgactgctcgggcactggggcacctcaccaggtctgaacctggtccacacccacctcaacagggtcgtcaaggcgaggaacctggacgcgatctgcgtctgggggcccggtcacggcgggcccgccgtggtggcgaactcctggctggagggcagctacaccgagacctacccggacatcacacgggacacggccgggatggcccgcctcttccggcagttctccttcccgggcggcatccccagccacgtcgcacccgagactcccggatcgatccacgagggcggcgagctgggctactccctctcgcatgcctacggggccgcgttcgacaatccgggacttctggtggcctgcgtgatcggcgacggtgaggccgagacgggcccgctggcagcgtcctggcactccaacaagttcctcgacccggtacgggacggtgccgtcctgccgatcctgcacctcaacggctacaagatcgccaacccgacggtcctggcccggataccggagcccgaactcgactccctgctcaggggatacggccacgagcccctccacgtcaccggggacgatcctcacaccgtccaccagacgatggctcgtgccatggacgaggctctggaccgcatcgccgccttccagcacgcggcccgcacggagggcgctgccgaacgcccacggtggccggtgatcgtcctgcgcacgcccaagggctggaccgggcccgccgaggtcgacgggctcccggtggagggcacctggcgagcacaccaggtgccgctgccggccgtacgcgagaacccggaccatctgcggcagttggagcggtggctgcgctcctaccgtcccgaggaactcttcgacgagcacgggagcccccgggaacaggtcctggcgtgtgtccccgacggcgcacaccggctgggcgccaacccgcacaccaacggcggcctgctgctgcgcgacctgcccgtgccgtccctggagcggttcgccgtccccgtcgacaagcccggcgcgacagcgcacgagccgacccgcgtcctcggcgacctgctcgcacaggtgatggccgacacgggcgagcggcgcgacttccggctggtcggcccggacgagacggcctccaaccgcctccaggccgtctacgaggcgagcggcaaggcgtgggaagcccaggtactgtccacggacgaacacctggagcgcggcggccgggtgatggagatcctctccgaacacacctgccagggctggctggagggctacctcctcaccggtcggcatggcctgttctcctgctacgaggcattcgtccacattgtcgactccatggcgaaccagcacatcaagtggcttcgcgtcgcccgccgactcccctggcgccgcccgatcgcctccctcaactacctgctcacctcgcacgtgtggcgccaggacaacaacggtttctcgcatcaggaccccggcttcgtcgaccacgtgctcaacaagtcgccggaggtagtaagggtctactatccgccggacgccaacaccctgctgtgcgtgtcggatcacgtgctgcgcagccgcgactacgtcaatgtcgtcgtcgcgggcaagcagccgtgcttcgactggctcgacctcgacgccgcccgcgcgcactgcgcccgcggcgccggcatctgggactgggccggcaccgagaccgacctcggcgagcccgacgtggtgctcgcctgcgcgggtgacgtccccaccctcgaagtgctggccgcggcctcgctgctccgcagccatctgcccgacctcgcggtacgggtggtcaacgtcgtggacatcgcccggctgctgcccatggaggaacacccgcacggcatgcccgacagcgagtacgacgcgctgttcacccccgacaagcccgtcgtcttcgcgtaccacggctatccgtggctgatccaccggctcgcctaccgccgtgccaaccacccgcacctgcacgtgcgcggttacaaggaggagggcaccaccacgaccccgttcgacatggtcgtacgcaacgacctcgaccggtaccggctggtcatggacgtcatcgaccgggtgccgggcctcgcggtccgcgcggctgcgttgcggcagcggatggtcgacgtccgctaccgccatcacgactggatccgcgcccatggggcggacctgcccgaggtcgccgaatggacctggagccagtga

SEQ ID NO: 250 - DNA, 2379 bp, Streptomyces scabiei 87.22
atgacccaggtcgaacaccagaacgtcaccgtactttccgacgacgagctgcgcaccctggacgcccactggcgggccgccaactacctcgcggccggacagatctacctccgggcgaacccgctgctgaccgaaccgctgctccctgaacacatcaagccgcggctgctcggtcactggggcacctcgccgggcctgaacctggtctacacccacctcaaccgggtgatctcagcacgcgacctggacgccctgtgcgtctgggggcccggtcacggcgggccgtccgtcctggccggctcctggctggacggcagctacagcgagacctacccggacgtcacacgcgacgcgcccggcatggcacggctcttccggcagttctccttccccggcggggtaccgagccatgtggcccccgaggtgccgggctcgatccacgagggcggtgaactcggctactccctcgcccatgcctacggcgccgccttcgacaaccccggcctgctggtgacctgcgtcatcggcgacggcgaggcggagaccgggcccctggccgcctcctggcactccaacaagttcctcgacccggtccacgacggtgccgtcctgccgatcctccacctcaacggctacaagatcgccaacccgacggtcctgtcccgcctgccccaggccgaactcgacgccctgctgcgcggctacggccacacccccctccacgtcaccggcgacgacccggccaccgtccaccgcgccctggcccacgccttcgacgaggcactggaccgcatcgcccgcctgcagcgcaccgcacgcgaggacggcgtcgccgaacgcgcccactggccgatgatcgtgctgcgcacccccaagggctggaccggccccgccgaggtcgacggcctgcccgtcgaagggacctggcgcgcccaccaggtcccgctcgccggggtacgcgagaacccggaacacctccggcagttggagacctggctgcgctcgtaccggccccaggagctgttcggcccggacggccggcccgtcgccgacgtcctcgcccacatcccctccggcaccaggcgactgggcgccaccccgcacgccaacggcggcctcctcctccgcgacctccccatccgccccctggacgacttcgccgtaccggtggacaagccgggcacgacgctccacgaaccgacccgggtcctcggtgacctcctggcccggatcatgcgggacacccgctcgcgccgggacttccgggtcgtcggaccggacgagaccgcctccaaccggctgcaggccgtcttcgacgccagcggcaaggcctggcaggccgaacacctcccggtcgacgaacacctcgaccggcacggccgggtactggagatcctctccgaacacctctgccagggctggctggagggctacctgctcaccggccgacacggtctgttctcctgctacgaggcgttcgtgcacatcgtcgactccatggtcaaccagcacatcaagtggctgcggacctcccgggagctgtcctggcgggcgcccgtcgcctccctcacctacctgctcacgtcccacgtctggcgccaggaccacaacggcttctcccaccaggaccccggcttcgtcgaccacgtcctcaacaagagccccgaggtcgtccgcgtctacctgcccccggacgccaacaccctcctgtccgtcgccgaccacgccctgcgcagccgcgacctcgtcaacgtgatcgtggccggcaaacagccctgcttcgactggctgtccatggaccaggcccgcgcccactgcgcgcgcggagccgggatctgggagtgggcgggcagcgagaacggcggcgaaccggacgtcgtcctcgcctgtgccggcgacgtgcccacccaggagatcctggccgcggcgcagctgctgcgccgccatctgccgcagctcgccgtccgggtggtcaacgtcgtcgacatgacccggctgctgccgcgcgaggaacacccgcacgggatgagcgacttcgagtacgacggcctgttcaccaccgacaagccggtgatcttcgcctaccacggctatccgtggctcgtgcaccgcctcgcctaccgccgcacgggccaccggaacctgcacgtacgcggctacaaggagtcgggcacgacgaccacgcccttcgacatggtcgtccgcaacgacctcgaccgctaccggctggtcatggacgtcatcgaccgcgtgcccggcctcgccgtccgggccgccgccgtacgccagcagatggccgacacccgtacccgccaccatgcctggatccgcgagcacggcaccgatctgccggaggtcgccgactggcactgggcctga

SEQ ID NO: 251 - DNA, 2382 bp, Streptomyces avermitilis MA-4680
atgccccaggtcgaacatcagaacagcaccgtactgaccgacgacgaactgcgcacgttggacgcccactggcgggcggccaactatctcgccgccggccagatctatctgctggccaacgcgctgctgaccgaacccctcagccccgcgcacatcaagccgaggctgctcggccactgggggacctcgcccggcctcaacctcgtccacacccatctcaaccgcgtcatcaaggcccgcgatctggacgcgctgtgcgtgtggggcccggggcacggcgggccggccgtgctggccaactcctggctcgagggcagctacagcgagacctacccggacatctcccgtgacgccgcgggcatggggaagctgttcaggcagttctcgttccccggcggagtgccgagtcatgtcgcgccggagacgcccggctcgatccacgagggcggtgagctcggctactcgctcgctcacgcgtacggcgcggccttcgacaatccggacctgctcgtcgcctgtgtgatcggcgacggcgaggcggagaccggcccgctcgccgcctcctggcactcgaacaagttcctcgacccggtccacgacggtgccgtgctccccatcctccacctcaacggctacaagatcgccaacccgacggtgctgtcccgcatcccggagcccgaactcgacgagctgctgcgcggatacggccatgaaccactccacgtcaccggcgacgacccgcaccaggtccaccgtgccctggccgaggccttcgaccgggccctggaccgcgtcgccctgatgcagcgcacggcccgcgaggagggcgcgaccgagcggatccgctggccgatgatcgtgctgcgcacaccgaagggctggaccggacccgcggaggtcgacggccggcccgtcgagggcacctggcgcgcccaccaggtccccctgcccgaagtgcgtgagaaccccgagcacctgcgccagctggagggctggctgcgctcgtaccggcccgaggaactcttcgacgccgacggccgccccacggccgacgtgctggcctgcgtgccgcacggtgccaggcgactgggcgccaccccgcacgccaacggcggcctcctcctacggccgctgccgatcccgcccctcgaccggttcgccgtggccgtcgacaagcccggcgcgaccctgcacgagcccacgcgggttctgggcgacctcctcgaacaggtcatgaaggacacctccgcccgtcgcgacttccggctcgtgggccccgacgagaccgcctccaaccggctggacgccgtcttcgacgcgagcggcaaggcctggcaggcccagacccttccggtcgacgaacacctcgaccggcacggccgggtgatggagatcctctccgaacacacctgccagggctggctggagggctatctcctgaccggccgccacggactgttctcctgctacgaggcgttcgtgcacatcgtcgactcgatggtcaaccagcacatcaagtggctgaagacgtcacgggagttggcgtggcgcgcgccgatcgcctccctcaactatctgctcacctcacacgtctggcgtcaggaccacaacggtttctcgcaccaggacccgggcttcgtcgaccacgtcctcaacaagagccccgaggccgtacgggtgtatctgccgccggacgccaacaccctgctgtcggtggcggaccacgtcctgcgcagccgtgactacgtgaacgtggtcgtggcgggcaagcagccgtgcttcgactggctgtcgatggaacaggcccgggcccactgcgcgcgcggggcggggatctgggagtgggcggggacgcagaacgacggcgaaccggacgtggtgctggcctgcgcgggcgatgtgccgacccaggaggtcctggccgcctcggcactgctgcgccggcatctgcccgccctcgccgtccgggtggtgaacgtggtcgacatgacgcggctgctgccgcgcgaggcacacccgcacgggatgagcgacttcgagtacgacgggcttttcaccaccgacaagccggtcatcttcgcgtaccacggctatccctggctgatccaccgcctcgcctattcccgcaccggtcacgggaacctccatgtgcggggctacaaggagatgggcaccaccacgaccccgttcgacatggtcgtccgcaacgacctcgaccgctaccggctggtcatggacgtcgtcgaccgtgtccccggcctcggcgtacgcgccgccgccgtccgccagacgatggccgacgcacgtacccggcaccacgcctggatccgcgagcacggcaccgacctgcccgaggtcgcgaactggacgtgggaggcgtga

SEQ ID NO: 252 - DNA, 2379 bp, Streptomyces ghanaensis ATCC 14672
atgcccgaggccccggacacccggaccgtactgagcgacgaggaactgcgcacgctggacgcccactggcgggccgccaactacctggcggcgggccagatctacctgctggcgaacccgctgctgaccgagcccctcaggcccgagcacatcaagccgcggctgctcgggcactggggtacctcacccgggctgaacctggtgtacacccacctcaaccgggtgatcgcggggcgcggactggacgcgctgtgcatctggggaccgggccacggcggcccctccgtcctggccaactcctggctggagggcagctacggcgagacgtacccggacgtcggccgggacgcggcgggcatggagcggctcttccggcagttctccttccccggcggcgtgcccagtcacgtggcccccgaggtgcccggctccgtccacgagggcggcgaactcggctactccctcgcccacgcctacggcgcggccctcgaccaccccggcctgctggtcgcctgcgtgatcggggacggcgaggcggagaccgggccgctggccgcgtcctggcactccaacaagttcctcgacccggtccacgacggcgccgtcctgccgatcctgcacctcaacggctacaagatcgccaacccgacggtcctggcccgcctgcccgaggacgaactcgactccctgctgcgcggctacggccacgagccgatccacgtgagcggcgacgacccggccgccgtccaccgggcgatggcgcacgccatggacaccgcgctggaccgcatcgccgaggtgcagcgcgccgcccgtgaggacggcgtgaccgaacgggcgcgcacgccggtgatcgtgctgcgcaccccgaagggctggaccggccccgccgaggtggacgggaaacccgtcgagggcacctggcgcgcccaccaggtgccgctcgccggcgtccgcgacaaccccgagcacctgcggcagctggaggcctggctgaggtcgtaccggcccgaggaactgttcgacgacgcgggccggcccgtcgcggacgtcctcgcctgcctcccggagggcgaccggcgcctcgggtccaccccgtacgccaacggcggactgctggtgcgcgagctgccgatgcccgccctcgacgacttcgccgtcccggtcgacaagcccggcaccacgctgcacgagcccacccggatcctcggcggcctcctcgaacggatcatgagggacaccgcggaccggcgggacttccggctcgtgggtccggacgagaccgcctccaaccggctggaggcggtctacgacgccagcggcaaggcctggcaggccggcaccctcgacgtcgacgagcacctcgaccggcacggccgggtgatggaggtcctctccgaacacctctgccagggctggctggagggctacctcctcaccggccggcacggactgttctcctgctacgaggcgttcgtgcacatcgtcgactccatggtcaaccagcacatcaagtggctgaagacctcgcgggagctgccctggcgcgcacccatcgcctcgctcaactacctgctcacctcgcacgtgtggcgccaggaccacaacggcttctcccaccaggaccccggcttcgtcgaccacgtgctcaacaagagccccgaggtcgtacgggtctacctgccgccggacgccaacaccctgctgtccgtcgcggaccacgcgctgcgcagccgcgactacgtcaacgtggtcgtggccggcaagcagccctgcttcgactggctgtcgatcgacgaggcgcgcgtccactgcgcgcggggcgccgggatctgggagtgggccggcaccgagaacggcggcgcgcccgacgtggtgctggcctgcgccggtgacgtgcccacccaggaggtcctggccgccgcccagttgctccgccgccacctgccggagctcgccgtccgcgtggtcaacgtcgtcgacatcgcccggctcatgccccgcgaggagcacccgcacggcatgaccgacttcgagtacgacggcctgttcaccgccgacaaaccggtgatcttcgcctaccacggctacccgtggctgatccaccgcctcgcctaccgccgcaacggccatccgaacctgcacgtgcgcgggtacaaggagtccggcaccacgaccacgcccttcgacatggtcgtccgcaacgacctcgaccgctaccggctggtcatggacgtgatcgaccgggtccccggcctcgcggtgcgcgccgccgccgtgcgccagcggatggccgacgcgcgcacgcggcaccacgcgtggatccgcgagcacggcaccgacctgccggaggtcgccgagtggagctggaacgcgtga

SEQ ID NO: 253 - DNA, 2388 bp, Streptomyces viridochromogenes DSM 40736
atgcccgaggcccagcgccagcacagcagcaccgcaccgaccgacgaggaactgcgcaccctggacgcccactggcgggccgccaactacctggcggccggtcagatctacctgctggcgaaccccctgctcaccgagccgctgcgacccgagcacatcaagccgcggctgctggggcactggggcacctcgcccggcctcaacctcgtgcacacccacctcaaccgggtgatcaaggcccgcgacctggacgccctgtgcatctggggcccgggccacggcggaccgtcggtactggccaactcctggctggagggcagctacggcgagaagtacccggacgtgacacgggacgcgcagggcatggagctgctgctgcggcagttctcgttccccggcggcgtgcccagccacatcgccccggaggtgcccggctccatccacgagggcggcgaactcggctactccctcgcccacgcctacggcgccgccctcgaccatcccggcctgctggtagcctgcgtgatcggcgacggcgaggccgagaccggcccgctggccggctcctggcacgccaacaagttcctcgaccccgtccacgacggtgccgtcctgccgatcctccacctcaacggctacaagatcgccaacccgaccgtgctgtcccggctgcccgaggcggagctggacgcgctcctgcgcggctacggccacgagccgatccacgtcggcggcgacgacccggccaccgtccaccgcgcgatggcccaggcgatggacaccgccctcgaccgcatcgccgaggcgcagcacgccgcccgcgaggagggcgtgaccgagcgtccgcactggccggtgatcgtgctgcgcaccccgaagggctggaccggccccgccgaggtggacggcgagccggtcgaagggacttggcgctcccaccaggtgccgctggccgaggtccgcgacaaccccgaacacctgcggcagttggaagcctggctgcgctcctatcggcccgaggaactgttcgacgccgagggccgcccggtcgccgacgtcctcgcgtgcgtgcccgagggcaccaagcggctcggcgccaccccctacgccaacggcggactgctcgtccgcgacctgcccgtcccgtccctggacgacttcgccgtcccggtcgacaagccgggcaccacgacgcacgagcccacccgggtcctcggcgacctcctcgcccgggtcatgcgggacaccgcgacccgccgcgacttccgcctggtcggcccggacgagacggcctccaaccggctccaggccgtctacgacgccagcggcaaggcctggcaggccggcacgttgcccgaggacgagcacctggaccggcacggccgggtgatggaggtcctctccgaacacctctgccagggctggctggagggctatctgctcaccggccggcacgggctgttctcctgctacgaggcgttcgtgcacatcgtcgactcgatggtcaaccagcacatcaagtggctgcgcacctcccgccggctgccgtggcgcgcccccatcgcctccctcaactacctgctgacctcccacgtgtggcggcaggaccacaacggcttctcccaccaggaccccggcttcgtcgaccacgtcctcaacaagagccccgaggtcgtccgcgtctacctcccgccggacgccaacaccctgctgtccgtcgcggaccacgccctgcgcagccgcgactacgtcaacgtgatcgtcgccgggaagcagccctgcttcgactggctgtcgatggacgaggcccgcgtgcactgcgcccgcggcgccggcatctgggactgggccggcaccgaggacggtctgcgcgagcccgacgtggtgctggcctgcgccggtgacgtccccacgcaggaggtcctggccgccgcgcacctgctgcgccggcacctgcccgagctggccgtccgggtggtgaacgtcgtcgacctcgcccggctgctgcccgagaaggaacatccgcacggaatgaacgacttcgagtacgacggcctcttcaccaccgacaagccggtgatcttcgcctaccacggctacccgtggctcatccaccgcctcgcctaccgccgcgccggccaccagaacctgcatgtgcgcggctacaaggagtccggcaccacgaccacacccttcgacatggtcgtccgcaacgacctcgaccgctaccgcctcgtcatggacgtcatcgaccgcgtcccgggactggcggtgcgcgccacggccgtacgccagcggatggccgacgcccgcacccgccaccacgcctggatccgtgagcgcggcaccgacctgcccgaggtcgccgagtggacgtggaacgcctga

SEQ ID NO: 254 - DNA, 2394 bp, Streptomyces hygroscopicus ATCC 53653
atggccgacgcagcaacgacggcgccgaacgacctcaccgagcacgaactgcacgccctggacgcccactggcgcgccgcgaactacctcgcggccgggcagatctatctgctggccaaccccctgctgaaagagccgctgcgccccgagcacatcaagccgcggctgctcggccactggggcacctcgcccggcctgaacctggtccacacccacctcggccgggtcatcaaggcccgcgacctggacgcgatctgcgtctggggtcccggccacggcgggcccgcggtgctcgccgggtcctggctggacggcagttacgccgaggtctacccggacgtgagccgggacggggcgggcatggcccggctcttccgccagttctccttccccggcggggtgcccagccatgtggccccggagactccgggctcgatccacgagggcggtgagctgggctactccctggcgcacgcctacggcgcggcgctcgacaatcctgatctgctggccgtctgcgtcatcggcgacggggaggccgagaccgggccgctggccggctcctggcacgccaacaagttcctcgacccggtccacgacggcgccgtgctgccgatcctccacctcaacggctacaagatcgccaacccgacggtgctcgcccggctccccgaacccgagctggacgatctgctccgcggatacggccatgagccgatccacgtcgccgcgcggcccggggacgatccgctgcggacgcaccgggcgctggcccgggccatggaccaagccctcgaccgcatcaccctgctccagcgcaccgcccgcgaggaggacgccgtcgagcgcccgcgctggccggtcatcgtgctccgtacgcccaagggctggaccggtccggccgaggtcgacggcctgcccgtcgaggacacctggcgcgctcaccaggtgccgctgcccgccgtaagggagaacccggaccatctgcggcagctggagcggtggctgcgctcgtatcgccccgaggagctgttcgacgacgaggggcgcccgcgtccggacgtcctcgcgttcgtgcccgacggcgaccggaggctcggcgccaatccgcacgccaacggcggactgctgctgcgcgatctgcccgtccccggcctggcgcggtacgccgtgcccgtggacaagcccggggccaccctgcacgagccgacccgggtcctcggcgggctgctggagcagatcatggaggacaccgccgaccgccgcgacttccgcctcgtcggccccgacgaaacctcctccaaccggctcgacgccgtctaccgggccaccggcaaggcgtggcaggaggagatcctcgtcaccgatgagcatctgaaccggcacggcagggtcatggaggtgctctccgaacacctctgccagggctggctggagggctatctgctcaccgggcggcacggcctgttctcctgctacgaggcgttcgtgcacatcgtggactccatggtcaaccagcacatcaagtggctgaaggtggcccgcgacctgccctggcggcgccccatcgcctccctcaactacctgctgacctcgcatgtgtggcggcaggaccacaacggcttctcgcaccaggaccccggcttcgtggaccatgtgctcaacaagagcccccaggccgtacgggtgtatctgccgccggacgccaacaccctgctgtgcgtggccgaccacgtcctgcgcagccgcgattacgtcaacgtcgtcgtcgcgggcaaacagccctgcttcgactggctcgacctcgaccaggcccgcgtccactgcgcccgcggcgccggaagctgggactgggcggggacggagaccggcaccggcgaacccgatgtggtgctggccgccgcgggcgacgtgcccacccaggaggtgctggccgctgccgggatcctccgccgccatctgccggatgtggccgtgcgcgtggtcaacgtcgtcgacatgacccggctgctgcctcaggacgcgcatccgcacgggatgccggacgccgagttcgacgccctgttcacccgcgaccggccggtcgtcttcgcctaccacggctatccgtggctggtgcaccggctggcctaccggcgcgccgtccacccgcatctgcatgtgcgcggctaccgggagtcgggcaccaccaccacgccgttcgacatggtggtccgcaacgacctggaccgctaccgcctggtcatggacgtcatcgaccgcaccccggggctcgcggtgcgcgccgtgtccgtacggcagcggatgcaggacgcccgcacccgccaccaccagtggatccgcgagcacggcaccgacatgcccgagatcgccgagtggtcctggaccggatag

SEQ ID NO: 255 - DNA, 2388 bp, Streptomyces flavogriseus ATCC 33331
atgaccgacgcccgaacgccgtccggggcctccgccccctccgacgctgagatcgcggcactggacgcgcactggcgtgccgccaactacctggcggtcggccagatctatctgatggccaaccccctcctggaggagccgctggcccccgagcacatcaagccgcgactgctcggccactggggcacctcacccggactgaacctggtccacacccatctgaaccggatcgtccggacccggaagcgccgggcgatgtgcgtctgggggcccggccacggcggccccgccgtcctcgccaactcgtggctggagggcagttactccgagacgtaccccgatgtcagccgcgaccgtgccgggatgggcgcgctgttcaagcagttctccttccccggcggtgttcccagccatgtcgcaccggagacccccgggtccatccatgagggcggcgagctggggtacgcgctgacccatgcctacggcgccgccttcgaccaccccgagctgctggtcgcctgtgtggtcggcgacggagaggcggagacgggaccgttggccgcgtcctggcactccaacaagttcctggaccccgtgcacgacggcgcggtcctgcccgtcctgcacctcaacgggtacaagatcgcgaaccccacggtgctggcccggctgcccgaggacgaactcgacgcactcctgcgcggatacggccacgatcccgtgtacgtcgagggggacgagccggccgtcgtccaccgcgcgctggccgccgccatggacctcgccgtggaccgcatcgacgggtaccagcgcgcggcgcgctccgaaggcgcgtccgcgcgtccccgctggcccatgatcgtgctgcgcacccccaagggctggaccggcccggaggaggtggacgggctccccgtcgagaacacctggcgggcccaccaggtgccgctgcccggggtccgggacaatcccgatcacctgcgtcagctcgaggagtggatgcgctcctaccgccccgaggaactcttcgactccgagggcaggcccaccgcccaggtcctggaatgcgttcccgaggggaccgcccggctcggggcgacaccgtacgccaacggcgggctgctcctgcgcgaccttccgctcccgcccctcgagaaccacgcggtgcgggtcgacaggccggggaccgtcctgcacgagcccacccggatcctgggcggactgctcgaggacgtcatggcggccaccgccgaccgcaggaacttccgggtggtcgggcccgacgagaccgagtccaaccgcctcggcgcgctctacgaggccaccggaaaggcctggcaggcggaggtccttccgaccgacgaacatctggcccgtgacggcagggtgatggaagtcctgtcggaacacctgtgccagggctggctggagggttatctcctcaccggccggcacggcctgttctcctcgtacgaggccttcgcccatatcgtcgactcgatggtcaaccagcacatcaagtggctccgcacgtcgcggcggctgcactggcgcgcacccgtcgcctcgctgaactacctcctcacctcgcacgtctggcgtcaggaccacaacggcttctcgcaccaggaccccggcttcgtcgaccacatcctcaacaagagtcccgaagtcgtccgggtctacatgccgccggacgccaacactctgctgtccaccgccgatcacgtgctgcgcagccgtgactacgtcaacgtgatcgtcgccgggaagcagcccggcttcgactggctcaccctcgacgaggcacgcgcgcactgcgcccggggggccggggtctgggaatgggccgggaccgaggacggcagccgcgaacccgacgtggtgctggcctgtgccggcgacgtacccaccctggagacgatggccgcggccggactgctgcgccgtcatcttccggagctcgccgtgcgtgtggtcaacgtggtcgacatgacccggctgctgccgcacgaggagcacccgcacggcatgcccgacgcggagtacgacgccgtcttcacccgggacaggccggtgatcttcgcctaccacggctacccctggctggtgcaccgtctcgcgtaccggcgcgcgggacactcccatctccatgtgcgcggctacaaggaggaggggaccacgaccacgccgttcgacatggtggtccgcaacgacctggaccgctaccggctggtcatggacgtgctcgaccgggtgcccgggctgggggtccgcgccgtcgccgtacggcaggcgatggcggacgcccgcacccggcaccacgcctggatccgggaacacggcacggacatgcccgaggtcgccgactgggcctgggagggctga

SEQ ID NO: 256 - DNA, 2388 bp, Streptomyces griseus subsp. griseus NBRC 13350
gtgagcgacacccgcaccccctccgatccccccgtgctctccgacgacgaactctccgcgctcgacgcgcactggcgcgcggccaactacctcgcggtcggccagatctacctcatggccaaccccctgctgacccggccgctcgtccccgaggacatcaagccgcggctgctcggccactggggcacctcgccggggctcaatctcgtccacacccacctcaaccgggtgatcaaggaccgcgacctgaacgccctgtgcgtgtgggggcccggccacgggggaccggccgtcctcgccaattcctggctggagggcagctactccgagacctacccggacgtcggccgggacgccgagggcatgggactgctgttcaaacagttctcgttccccggcggcgtgcccagccacgtcgcccccgagacgcccggctccatccacgagggcggcgaactcggctactccctggcccacgcctacggagccgccttcgaccacccggacctcgtggtggcctgcgtgatcggcgacggcgaggccgagacggggccgctcgccgcctcctggcacggaaacaaattcctcgacccggtccacgacggggccgtcctgcccatcctccacctcaacggctacaagatcgccaacccgacggtcctcgcccgcatccccgaggacgagctcgaccggctgctgcgcggctacggccacgaccccctgttcgtcacgggcgacgacccggccaccgtccaccgggcactcgccgccgccctggacaccgccctggaccggatcggcgcctaccagcgggccgcccgcgaggacagcgcgaccgagcgccccgactggcccatgatcgtgctgcgcacccccaagggctggaccggacccgaggaggtcgacggagtccccgtcgagaacacctggcgctcccaccaggtcccgctccccggcgtccgcgagaacccggaacacctgcggcaactggaggcctggctgcgctcctaccggcccgccgaactcttcgacgccgacggccgccccaccgaacgggtcctcgcccgcgtccccgagggagcggcccgcctcggctccaccccgtacgccaacggcgggctgctcctgcgcgacctcccgctgcccgacccggcggaccacgccgtacgggtcgaccggcccggcaccaccctccacgaaccgaccaaggtgctcggcggcctcctggagagcgtcatggccgccaccgcggaccgcagggacttccgcgtcgtcggccccgacgagaccgcctccaaccggctggacgccctctaccgggccaccggcaaggcctggcaggccggcaccctgcccaccgacgaacacctcgcccacgacggccgggtgatggaggtgctctccgaacacctctgccagggctggctggaggggtacctcctcaccggacggcacggactcttctccagctacgaggcgttcgcccacatcgtcgactccatggtcaaccagcacatcaaatggctgcgcacctcgcggcggctgccctggcggcggcccatcgcctcgctcaactacctgctcacctcacatgtctggcgccaggaccacaacggcttctcgcaccaggaccccggcttcgtcgaccacatcctcaacaagagccccgaggtcgtccgcgtctacctcccaccggactccaacaccctgctctccgtcgccgaccacgtgctgcgcagccgggactacgtcaacgtgatcgtggccggcaaacagccgaccttcgactggctcacaccgcgggaggcccgaggccactgcgcgcgcggggccggggcctgggagtgggccgggaccgaggacgggagccgggaaccggacgtggtcctcgcctgcgccggggacgtacccacgcaggagaccctggcagcggcggacctgatccggcgccacctcccggagctcgccctgcgtgtggtcaacgtggtcgacatcgcccgcatgatgcccgacaccgagcatccgcacggcatgccggacgccgagtacgacgccctgttcacccgcgacaggccggtgatcttcgcctaccacggctacccgtggctgatccaccggctcgcctaccgccgccacggccacgcccacctccatgtgcgcggctacaaggaggagggcaccacgaccacgccgttcgacatggtcgtccgcaacgacctcgaccgctaccggctggtcatggacgtcatcgaccgggtgcccggtctcggcgtccgcgccgtcgccgtacgccaggagatggcggacgcccgcacccgccaccacgcgtggatccgcgaacacggcacggacctgccggaggtcgtcgactggacatggggcggctga

SEQ ID NO: 257 - DNA, 2382 bp, Streptomyces albus J1074
atgagtcaggcccccgaccgtaccggcggaccctccgccgaggagatcgccgccctcgacgcgcactggcgcgccgccaactacctggccgtcgggcagatctacctgatggacaaccccctgctcacccgccccctcacccccgaggacatcaagcccaggctgctcgggcactggggcacctcgccggggctgaacctcgtgtacacccacctcaaccgggtgatcaaggaccgcgacctgaccgccctcgccgtctggggccccggccacggcggcccggccgtcgtcgccaactcctggctggagggcagctggagcgaggtctaccgggacgtcccgcgcgacgccgacggcatggcccgcctcttcaagcagttctccttccccggcggtgtccccagccacgtcgcccccgacgtccccggctcgatccacgagggcggggaactgggctacgccctcacccacgcctacggcgccgccttcgaccacccggatctcttcgtcgcctgcgtcatcggcgacggcgaggccgagaccgggccgctcgccgcctcctggcactcggacaagttcctcgaccccgtccacgacggcgccgtgctgccgatcctccacctcaacgggtacaagatcgccaacccgacggtcctcgcccggctccccgaggacgaactcgacgccctgctgcgcggctacggccacgacccgctccacgtcgagggcgacgacccggagaccgtccaccgggaactggccctcgccctggacaccgcgctcgaccggatcgccgtcatccaggagcgcgcccgcgtccagggcgccgtcgaacgcccctcctggccgatgatcgtcctgcgcacccccaagggctggaccggcccccgcgaggtcgacggcctgcccgtggagaacacttggcgcgcccaccaggtcccgctgcccggcgtccgcgaggacgacgaccaccggcgccagctggaggagtggatgcgctcctaccgccccggggaactcttcgacgaggacggccgcccccgccccgaggtcctgcggtacgtccccgagggcgacgcccgcctcggcgccaccccgtacgccaacggcggccggctcacccgcgacctcccactgcccggcctcgccggccacgcggtggaggtcccggcgcccgggcagagcaccagcgagcccacccaggtactcggcggctggctggaggagctgatggccgccacggccgcccggcgcgacttccgcctggtcggccccgacgagaccgcctccaaccggctcgacgccgtctacggcgccaccggcaagacctgggaggagaagacctaccccaccgacgaacacctctcgcgcgacggccgcgtcatggaggtcctctccgaacacctctgccagggctggctggaggggtacctgctcaccggcaggcacggcctcttctcctgctacgaggcgttcgcgcacatcgtcgactccatggtcaaccagcacatcaaatggctgcgcgcctcccgcaggctcgactggcggcgccccatcgcctccctcaactacctgctgacctcgcacgtctggcgccaggaccacaacggcttctcgcaccaggaccccggcttcgtcgaccacatcctcaacaagagccccgaggcggtccgcgtctacctgccgccggacgccaacaccctgctcgccgccgccgaacacgtcctgggcagccgcgactacgtcaacgtcatcatctccggcaagcagcccaccttcgactggctgaccctggagcaggcccgcgcccactgcgcccgcggtgccgggacctgggcgtgggccgggaccgaggacggcacccgggaaccggacgtggtcctcgcctgtgccggagacgtccccacccaggaggtgctggccgccgccggcctgctccgccgccacctgcccgaactgagcctccgcgtggtcaacgtcgtggacgtggcgcggctgctgccccagggcgagcacccgcacggcatgccggacgccgagtacgacgcgctgttcacccgcgacaagccggtcatcttcgcgtaccacggctatccgtggctgatccaccgcctcgcctaccggcggcacggccacgaccacctgcacgtacggggctacaaggaggaggggaccaccacgacccccttcgacatggtggtccgcaacgacctcgaccggtaccggctggtcatggacgtcatcgaccgggtccccgggctcggcgtgcgggcggtcggactgcgccaggcgatggccgacgcccgcttccgccaccaccggtggatccgcgaacacggcagcgacatgccggaggtcgccgactggcgctgggagggctga

SEQ ID NO: 258 - DNA, 2388 bp, Streptomyces sp. Mg1
atgaccgcgttgaccgcgtattcgatcccggagctggacgcccactggcgcgccgccaactacctggcggtcggccagatctacctcatgggcaaccccctgctcgccgagccgcttcgaccggaacacatcaagccgcggctgctcggccactggggcacctcgcccggcctgaacctggtgtacacgcacctcaaccgcgtgatcagggaacgcgcggtcgaggccctgtgcatctggggcccgggccacggcggccccgccgtcctcgccaactcctggctggagggcacgtacagcgagacctacccgggcgtgggccgcgacgccgacggcatggccgaactgttccggcagttctccttccccggcggggtgccgagccacgtggcgccggagacccccggttccgtccacgaaggcggggagctgggatacgccctctcccacgcctacggagccgccttcgaccaccccggcctgctggtcgcctgcgtcatcggcgacggcgaggcggagaccggaccgctggccgcttcctggcattcgaacaagttcctcgacccggtccacgacggcgcggtcctgccgatcctgcacctgaacggctacaagatcgccaacccgacggtgctgtcccggatccccgaggccgaactcgacgcgctgctgcgcggctacgggcacgacccgctgtacgtgaccggcagcgacccggcccaggtccatccggccatggcccgcgcgctggaccacgcgctggaccggatctccctgatccagcaggaggcacggaaggcaggcaccgacccgggacgggaatacgcacgctggccgatgatcgtcctgcgcacgcccaagggctggaccggcccggcgaccgtcgacggcgacccggtcgagggcacgtggcgcgcccaccaggtcccgctcgcgggggtgcgcgagaaccccgcgcacctgaagcagctggaggactggctgcgctcgtaccggccggaggagctcttcgacgccgacggccgcccgacggcgcgggtcctggcctgcgtcccggaaggcgagcgccgcctgggcgcggtgccgtacgcgaacggagggcggctgctgaggcccctgccgctgcccacgctcgacgcgcatgccgtccccgtcgacaagcccggccgcaccctccacgaaccgacccgggtcctcgggcagttcctcacccaggtcatgcgggagacggccggacggcgggacttcagggtcgtcggaccggacgagaccgcctccaaccggctggacgacctctaccaggccaccggcaaggcctggcagggcatcacggaggccacggaccgcaacctggcgcgcgacggccgggtcatggagatcctgtccgaacacgtctgccagggctggctggaggggtacctcctcaccggccgccacggcctcttctccacctacgaggccttcgcgcacatcgtcgactccatggtcggccagcacatcaagtggctgaagacctcgcgcgagctgtcctggcgggcgccgatcgcctccctcaactacctgctcacctcgcacgtctggcgccaggacaacaacggcttctcccaccaggaccccggattcgtcgaccacgtcctcaacaagagccccgaggtcgtacgggtctacctgccgccggacgccaacaccctgctcgccgtggccgatcacgccctgcgcagccgcgaccaggtcaatgtgatcgtcgccggcaaacagccctgcttcgactggctgccgatcgaggaggcccgcacccacgtggcgcgcggcgccggagtctgggagtgggcgggcaccgaccacggctctggctccggctccggctcccgcgaaccggacgtcgtgctcgcctgcgccggcgacgtgcccaccatggaggtgctggccgccgcggccctgctgcgcgagcacctcccctcgctggccgtccgcgtcgtcaacgtcgtcgacatcgcccggctgatgccccacgacgaacacccgcacggcatgacgaaggccgagtacgacgcgctcttcaccaccgacaggccggtcattttcgcctaccacggctacccgtggctcatccaccgcctcgcctaccgccggaccggccactcccagctgcacgtccgcggctacaaggagtccggcaccacgacgaccccgttcgacatggtcgtgcgcaacgacatggaccgctaccggctcgtcatggacgtcatcgaccgcgttcccggcctcgcgagccgcgccgagggcgtgcgccaggccatggccgaccagcgcatccgccaccacgactggatccgcgagcacggcaccgacctgccggaggtggcggactggtcctggccgtactga

SEQ ID NO: 259 - DNA, 2394 bp, Streptomyces sp. SPB78
atgcaggaattcacgtacgagacaccggcccccgtggcgcccgagctttcggacgcggagctggaggcgctgctcgcgcactggcgggccgccaactacctggcggtcgggcagatctacctcatggacaacccgctcctgcgcgagccgctgcgccccgagcagatcaagccgcggctgctcggccactggggcacggtccccgggctcaacctcgtctacacgcacgtcaaccggctgatcaggctgcggcggcaaccggcgctgtgcgtctgggggccggggcacggcgggcccggggtgctcgccaacagctggctggagggctcgtactcggacgtctacccggacatcagccgcgacgagcggggcatgaagcggctgttcaagcagttctcgttccccggcggggtgccgagccacgtctcgcccgagctgcccggctcgatccacgagggcggggagctggggtactcgctgctgcacgcgtacggggcggccttcgacaacccggacctgctcgtgccgtgcgtcatcggcgacggcgagtcggagaccgggccgctcgcgggctcgtggcactccaacaagttcctcgacccggtgcacgacggggcggtgctgccgatcctgcacctcaacggctacaagatcgccaatccgacggtgctcgcgcggctgcccgagaccgagctgcacgacctcctgcgcgggtacggctaccgcccgatcgaggtcgtgggcgacgacccggcacacgtgcaccggcagatggcgggggcactcgcgcaggcggtcggcaggatcgacgagatccaggccgaggcgcgcaggggccgctccacggaccgggcgcactggccgatgatcatcctgcgcacgccgaagggctggacgggcccgaagctggtcgacgggctccctgtcgagggcacgtggcgcgcgcaccaggtgccgctcgccgaggtgcgcaccgaccccgagcacctgcgccagctggaggagtggatgcgctcctaccggcccgaggagctgttcgacgaggagggcaggccgcgcgcgcgggtcctggagtgcgtccccgagggggatctgcggctgggcgcgagtccgcacgcgaacggggggcggctcacccgctcgctgcccgctcccccgctggaggacttcgccgtcacggtcgaccgaccggggacgagcacgcacgagccgacgcgggtgctcggccagtacctcgcgcggatcatggaactcaccgccgaccggcgcgacttccggctcatgggcccggacgagacggcgtcgaaccggctcaacgcggtgtacgacgtgacggcgaagacgtggcaggaggagatcctgccggtcgacgagcacctgacgcgcgacgggcgggtcatggaggtgctctcggagcacatgtgccagggctggctggaggggtacaccctgaccggcaggcacggcatgttctcgacgtacgaggcgttcgcgcacatcatcgactcgatggccaaccagcacatcaaatggctgggcaccgcgcggaagctgccctggcggcggcctgtcccgtccctcaactatctgctctcctcgcacgtgtggcgccaggaccacaacggcttctcgcaccaggacccggggttcatcgaccacgtgctcaacaagagccccgaagtcgtgcgggtctacctgcccccggacgccaacaccgccctctccacggccgagcacgtcctccagagccgcgagtacgtcaacgtcgtgatggccggcaagcagccctccttcgactggctgaccctggacgaggcgcgggggcactgcgcgcgcggcgcggggatctgggagtgggcgggcaccgaggaggggcgcctgcccgacgtcgtgctcgcgtgtgccggtgacaccccgacgctggagatcctggccgccgcgcagatcctgcggcagcggctcccggagctggcggtcagggtcgtgaacgtcgtggacctcgcgcggctccttccggcgagcgagcacccgcacgggatgccggacgccgacttcgacggcctcttcacgaaggacaagccagtcatcttcgcctaccacggctacccgtggctgatccaccggctcgcctaccgccgtgccgtccacccgcacctgcacgtgcgcgggtacaaggagcggggcaccacgacgacgccgttcgacatggtcgtcctcaacgacctcgaccgctaccggctcgtcatggacgtcatcgaccgtgtgccgggactggcgcagcggcaggcggcgctgcggcaggagatggcggacacgcgcacgcggcaccgggcgtgggtgcgggagtacggcgaggacctgcccgaggtggcgcagtggcactgggaggggtga

SEQ ID NO: 260 - DNA, 2379 bp, Kribbella flavida DSM 17836
gtgcagcagatcgacgccaccccgttgagcgacgaggagttgcagggtctcgacgcgtactggcgagccgcgaactacctgtccgtgggacagatctacctgctcgccaacccgctgctgaaggagccgctggggcccgaccacatcaagccgcggctgctcgggcactggggcacgacgccggggctcaacctgatctacgcccacctcaaccgggtgatccggcagcgtgagcgcgacctgatgtacgtgatcgggccgggccacggcggtccggcgatcgtcgccaacacctggctcgagggcagctggaccgcgacgtacccgaacaccacccaggacgagccgggcatggcgcggctgttcaagcagttctccttccccggtggcattcccagccacgtcgctcccgaggtgccgggttcgatcaacgagggcggcgagctcggctactcgctcagccacgcctacggcgcggcggcggacaaccccgacctggtggtcgcctgcgtgatcggtgacggcgaggccgagaccggcccgctggcgacgtcgtggcactgcaacaagttcgtcgatccgcgtcgcgacggcgcggtgctgccgatcctgcacctcaacggctacaagatcgccaacccggcggtgctggcccggatcggcgacgaggagctcaccgcgttgctgcgcggcctcggccacgagccgtacctggtcgagggctccgacccggcgaccgtgcatcaggcgctggccgcgacgctggaccgctgcctggaccggatcgacgagatccagctggaggcgcggaccgccgagacaccgccgggccggtcggcctggccgatgatcgtgctcaagacgccgaagggctggaccggtccgcacacggtggacggcgagccggtcgaggacacctggcggtcccaccaggtcccgctgtccggcgtccggtcgaacgacgaccacctgcgccagctggaggactggctgcgcagctaccggccggaagagctgttcgacgccgacggccggccggtggaacggctgctggagctggccccgcccccgtcgctgcggatgggttccagcccgcacgccaacggcggcgtcctcactcgggacctggaactgcccgaccccgccgaccacgccgtaccggtgaaggcgccgggggccgaggacggggaaccgaccaaggtgttcgggcagtacctgcgggacgcgttcgtgctcaacgaaccgcaccgcaacctgcggctgttcggcccggacgagaccgagtcgaaccggctgaacgcggtgtacgaggtgaccggcaaggcctgggtggcggagcggcgggacaccgaccggaacctggcgatcgacggccgcgtgctggagatgctcagcgagcacacctgtcaaggctggttggaggggtacctgctgaccgggcggcacgggctgttctcgtcgtacgaggcgttcgtgcacatcgtcgactcgatggtgaaccagcacgcgaagtggctgaagtcgatcaaccggctcgactggcgccggccggtcccgtcgctcaactacctgctcacctcgcacgtgtggcggcaggaccacaacggcttctcgcaccaggatcccggcttcatcgaccacgtggtgaacaagaaggccgaggtggtccgggtctacctgccgccggacgccaacacgctgctgtccacgatggaccactgcctgcggacccggaactacatcaacgtcgttgtcgccggcaagcagccgcagccgaactggctggactgggagtcggccgcgctgcactgcgcccgcgggatcggcgtctgggacttcgccagcaacgacgacggcgagcccgacgtggtgatggcctgcgccggcgacgtgccgacactggagacgatggccgcggtcgatctgctgcgcgagcacctgccgcagctgaaggtccgggtggtgaacgtggtcgacctgatgcgcctgcaggacgcgaccgagcacccgcacgggctgaccgatccggagttcgacgcgctgttcaccaccgacaagccggtgatcttcgcgtaccacggctacccgtggctgattcaccggctgacctaccggcggcgcgggcacgccaacctgcacgtgcgcgggtacatcgaggagggcaccaccaccacgccgttcgacatggtggtgctgaacaacctcgaccgctaccacctggcgatggacgtgatcgaccgggtgccgtcgctgggcagccgcgcggcctcggtccggcagcacttctccgaccagcgtgtccggcaccgcgctcataccaccacgtacggcgaggacctgcccgaggtgcgcgactggcgctggggccgcccccgctga

SEQ ID NO: 261 - DNA, 2469 bp, Nocardia farcinica IFM 10152
atgacccagatggccagcgccgggggcgacacctcggccgacaacgtcggcgcgcacggcggacggaccgtcgcgccggtgccctacgagctcaccgaagccgccgggccgctggaccgcgcggagctggccgcgctggacgcctggtggcgcgcggccaactacctgtcggtcggccagatctacctgatggccaacccgttgctcaccgagccgctgcggcccgagcacatcaaaccgcggctgctcgggcacttcggcacggtgcccggactgaatctggtgtggacgcacgccaatcgtgtgatccggcagcgcgggctggacgcggtcttcgtggccgggcccggtcacggcgggccgggcccgaacgcctgcgcgtggttggagggcacctactccgagctgtacagccacatcccgcgcgacggcgaggggatggccgcgctgttcgcccagttctccttcccgggcggcgtgccgagccactgcgccccggagacgccgggctccttccacgagggcggcgaactcgggtattcgctgctgcacgcctacggtgcggcgctggacaatcccgacctgacggtgttctgcgtgatcggcgacggcgaggccgaaaccggcccgctggcgacgagctggcacggcaacaagttcctcaaccccggtcgcgacggcgcggtgctgccgatcctggcgctcaacgagtacaagatcgccaacccgacgctgttcgcccgcatcccggaaccggagctgatcaacctgctcgaaggctacggccacgagccgatcgtggtggccggcgacgatccgggcgtggtgcatcagcggctggccgcggcgatggacacctgcatgaaccggatcgcgcagatccagcgggccgcccgcgacggggccgacggcagccgcccggcctggccgatgatcgtgctgcgcacgccgaagggctggacctgtcccccggtggtcgacggcgaccgggtcgaggggaccttccgcgcccatcaggtgcccctgcccgcggcccgcaccgacgacggccaccgcgccgtcctcgagcagtggctgcgctcctaccgtcccgaggagctgttcgacgatcggggcaggccggtgcccgaactgctcgccctggcgcccgagggcgaccgccggatgagcgcgaacccggtcgccaacggcggggcgctggtgcgcgacctgcggctgcccgactggcgcgagttcggtgtcgaggtgaagacgcccggcggcagcacgcacgaggccacccgggtgctcggcggctggctgcgcgaggtgacccggctcaacccgcacaacttcctgaccttcgcccctgacgaactcgccagcaaccgcctgcaggacatcctcgaggtgaccgggcgcgattggcaggccgaggtcggcgagtacgacgtggcgctggaccggtccggccgggtgatcgaggtgctctccgagcacatctgccagggcctgctggagggctacctgctcaccggcaggcacggggtgttcacctgctacgaggcgttcatccacatcgtcgacgccatgttcaaccagcatgcgaagtggctcgacgccagcgccgcggtgccgtggcggcggccgctggcgagcttgaactacctgctctcctcgcacgtgtggcgccaggaccacaacggcttcacccaccaggacccgggcttcctggacgtggtgctcaacaagaagcccgagatcgtgcgcgtctatctgccgccggacgccaacaccctgctctccacctacgaccactgcctgcgctcgcgccactacgtgaacgtggtggtcgcgggcaagcagccacaggaggactggttgtcggtggagcaggcggccgtgcactgcgcgcgcggtctcggcatctgggaatgggcctgccacaacgacgatccgggcaccaccccggatgtggtgctggcctgcgcgggcgacgtgccgacgctggagacgctggcggcggccgccatcctgcgggatcgcctgccgcggttgcgggttcgggtgatcaacgtggtggatctgatgcggttgctgcccgccgaggagcatccgcacgggctgccggaccgggagttcgatacgctgttcaccaccgcgagcccgatcatcttcgccttccacggctatccgtggctgatccaccggctcacctaccgccgcaccaaccacgacggcctgcatgtgcgcgggtacaaggaggagggcaccaccacaacgcctttcgacatggtgatgctcaacgatctggaccgctaccacctggtcatggacgtcatcgaccgggtgcccgggctgcgcgagacggcggccgggctgcggcaggagatggtcgacgcgcgctggcgggcccgggcctggactcgcgagcacggcgccgacatccccgtggtcgccgactggacctggcccgagccgagccgctga

SEQ ID NO: 262 - DNA, 2409 bp, Frankia sp. EAN1pec
atgatcaacgtcgccgagatcggcgcggagtccggtgtgcagagcacggggccgctgtccaccgaggagctgcgactgatcgacgcctattggcgcgccgccaactacctcgcggtggggcagatctacctgctcgacaatccgttgctcaccgagccgctgcgggccgagcacatcaagccacggctgctcgggcactggggtaccacgcccgggctcaacctcatctacgcccacatgaaccgcgtcatccgccgcaacgacctcgacgcgatctacgtgatcggccctggccacggcgggccgggaatcgtggccaacacctacctcgagggcacgtacagcgagatctacccctccgtcacccaggacagggaggggctgcgccggctgttccggcagttctcgttccccgggggaattcccagccatgtggcgccggaggtgcccggttccattcatgaaggcggtgagctggggtacgcgctcacccacgcctacggcgccgccttcgacaacccgggcctggtggtcgccgccgtcgtcggtgacggcgaggcggagaccggcccgctggcggcgagctggcactccaacaagttcctcgacccggtgcgcgacggcgcggtgctgccgatcctgcacctcaacgggtacaagatcgctcagccgacgatcctcgctcgcatccccgagtcggagctcgacgcgctgatgcgcggctacggccacgagccgctgcacgtcaccggcgatgaccccgccgacgtccaccagcagttcgcccgggtgctcgacaccgccgtctcgcggatcttcgacattcaggaccgcgcccgccgcggcggcgactcgtcccgccccgtgtggccgatgatcgtcctgcgcacgccgaaggggtggacgggtccgtcgacggtcgacggccggccggtcgaggggaactggcgctcgcaccaggtgccgatcgccgagctgcacggcaaccccgagcatctcgccctgctggagtcgtggctgcgcagctaccggccatgggagctgttcgacgccgacgggcggctggtcccggagctggcggcgctggctcccgtgggcacccgccggatgagcgcgaacccgcacgccaacggcggtgagctgctgcgtgacctgacgttgccggacttccgcgactacgccgtcgacgtcccgcagccgggagtgggctccaacgaggcgacgcgggtgctcggcggcttcctgcgcgacgtcatgcgctcgaacccgaacaccttccgcgtgatgggcccggacgagaccgcgtcgaaccgcctcggggcgttgttcgagaccacgtcccgggcctggaacgccgagacggtgccgaccgacgaggacctcgccccggacggccgggtgatggaggtgctctccgagcacctgtgccagggctggctggagggctacctgctcaccggccggcacggcttcttctcgtgctatgaggcgttcatccacatcgtcgactcgatggtgaaccagcacgcgaaatggctgaaggcgacccggcacattccctggcgccggccgatagcctccctgaactacctgctcaccagccatgtctggcgccaggaccacaacggcttctcgcaccaggacccgggcttcatcgaccacgtggtcaacaagaaagccgagatcatccgggtctacctgccgccggacgcgaacacgctgctctcggtggccgaccactgcctgcgcagccggcattacatcaacgtcatcgtcgccggcaagcagccggcactgaactacctgccgatgtcggacgcgatcgcgcactgcacccgcggcctgggtatctgggactgggcgagcaacgaccacaccgaggacggcgacggcacccccgacgtcgtcatggcctgcgccggggacatcccgaccctggagacgctggccgcggtcgacatcctgcgccagaacttccccgagctgaaggtgcgggtcgtcaacgtcgtcgacctgatgtgcctgcaggcggaggccgagcacccgcacggcatgtccgacgcgcgcttcgacgcgctgttcaccgaggaccggccgatcatcttcgcctaccacggctacccatggctgatccaccgcctcacctaccggcggcggaaccacggcaacctgcacgtccgcggctacatcgaggagggcacgacgaccacgcccttcgacatggtcatgatgaacaacctcgaccgcttccacctggtcgtggacgtgatcgaccgggtcgccagcctcggcgcccgcgcggcgcacgtcaggcagcgaatgatcgacgcccgtctcgccgcccgcgcctacacccgcgaccatggcgaggacgacccgcgcatccgtgactggacgtggccttactga

SEQ ID NO: 263 - DNA, 2409 bp, Frankia sp. CcI3
atgacgagcgtcgtcgacgccgagcggagcggggcggatccggccgcggggccgttgtccccggcggagcttgacctcatccacgcctactggcgagcggcgaactatctgtccgtcggacagatctacctgctcgacaatcccctgctcaccgagccgctgcgtccggagcacgtcaaaccgcgcctgctcgggcactggggcacgactcccggcctgaacctcatctacgcccatctgaaccgcgtgatccgggcaaaggacctgaacgccatctacatcatcggtccgggtcacggcggtcccggcatcgtggcgaacgcctacctggaaggcacctacagcgaggtctacccctcgatcggccgggatgtggcggggatgcggcggctgttccggcagttttccttccccggcggaattcccagccacgtcgcgccggagactcccgggtccattcatgagggcggcgagctcggttacgcgctgacccacgcctacggcgcggccttcgacaatcccgacctggtggtctgcgccgtcgtgggggacggggaggccgagacgggcccgctcgcggcgagctggcactccaacaagttcctcgacccgggtcgcgacggcgcggtgctgccggtcctgcacctcaacggctacaagatcgccaatccgacgatcctggcccgcatccccgagcaggagctgaccgcgctcctgcgtggctacgggtaccatccgtacttcgtggtcggggacgacccggccgcggtgcaccagcggatggcgggcgtcctggacgccgccgtcggcgagatccacgagatccaggaccgggcccgccgccacggccgcaccgagcgccccacctggccgatgatcgtgctgcggacccccaaggggtggaccgggccggccactgttgacggcctgccggtcgagggcacgtggcggtcccaccaggtgcccgtcgcgcagttgcacgacaaccccgggcacttggcccagctggaggcgtggctgcgctcctaccggccggaggagctcttcgatgccggcggcgccccgcgggccgaactcgccgcgctcgccccccgcggtccccggcggatgagtgcgaacccgcatgccaacgggggcgagctgctgcgtgatctgactcttcccgacttccgtgactacgcggtcgacgtcaccgcccccgggaccaccctcgccgagccgacccggatcctgggcgcgttcctacgggacgtggtggccgccaatccgagcaccttccgggtgatgggcccggatgagaccgcctccaatcggctgggtgcgctcttcgaggtgaccgaccgcgtctggaacgccgggacggaaccgacggacgagcacctggccgtggacggtcgggtcatggaggtgctttccgagcatctgtgccagggctggctggagggctatctgctcaccggccggcacgggttcttctcctgctacgaggcgttcatccacatcgtcgactcgatggtcaatcagcacgcgaaatggctgaagaccacccggcacatcccgtggcggcgcccgatcgcatcgttgaactacctgttgaccagccacgtgtggcggcaggaccacaacggcttctcccatcaggaccccggattcatcgaccacgtcgtgaacaagaaggccgaggtcgtccgggtgtacctgcccccggacgcgaacaccctgctctccgtcggcaaccactgcctgcgcagccggcactacatcaacgtgatcgtggccggcaagcagccggcgttgaactacctgtcgatgccggcggcgatcgcccactgcacccgtggcctgggcatctgggactgggccagcaacgaccacgacgcgcccggcgacgggctgccggatgtggtgatggcctgtgccggggacatcccgaccctggagaccctcgccgcggtggacctcctgcgccagcacttccccgatctgaaggtgcgcgtcgtcaacgtcgtcgacctgatgtccctgcaggacgaggcggaacatccgcacggcatctcgcacgcccgcttcgacgcgctgttcaccaccgaccggccgatcatcttcgcctaccacggctatccctggctgatccaccggctgacctaccggcggcacaaccatcacaacctgcatgtccgtggctacatcgaggaggggacgaccaccaccccgttcgacatggtcatgctgaacaacctcgaccggttccacctggtggcggacgtcatcgaccgggtaccgagcctgggcgcccgcgccgcgcacgtccggcagcagatgatcgacgcgcggctcgcggcccggacctacacccgggaccacggcgaggacgccccggagatccggaactggacttggccctactga

SEQ ID NO: 264 - DNA, 2403 bp, Catenulispora acidiphila DSM 44928
gtgactcgcctctctcgacaatcaccgcgcaagagcccgctgtccgccaaggacctcgacgccgtcaacgcctattggcgtgccgccaactacctgtcggtgggtcagatctacctgctggacaatccgctgatgcgccggccgctgagcctggacgacgtcaagccgcggctgctgggccactggggcaccacgccggggctgaacttcatctacgcgcacatgaaccgggtcatcaaggcgcgggatctggacgcgatctacgtcgccggtcccgggcacggcggtcccggcgtgctggcgaacgtctatctggaaggcacgtacagcgagatctacccggggatcggccaggacgaggacgggatgcgcaagctgttccgccagttctccttccccggcggtgtgccctcgcacgtcgcgccggagacgccgggctcgatccacgagggcggcgagctgggctattccctggcgcacgcctacggcgcggcgttcgataacccggacctgctggtgtgcgcggtggtcggcgacggcgaggcggagaccgggccgctggccgcgtcgtggcactcgaacaagttcgtcaacccggtgcgcgacggcacggtgctgccgatcctgcacctgaacggctacaagatcgccaacccgaccgtgctgtcccgcatcccgcaggccgagctggagcaactgatgcgcgggtacggctacgagccgttcacggtcgtcagcgaggagggcgccgatccgctggaggcgcaccaggcgatggccgccacgctggacgcgatgctggaccggatcgccgacatccggacgcgcgcgctcaccggccgagacaacggcgagcgcccggcgtggccgatgctgatcctgcgcacgccgaagggctggaccggcccgaagaccgtcgacggcaagcgcacggaggactcctggcgctcgcaccaggtgccgatggccaacgtgcacaccaacccggcgcatctgaaggtgctggaggagtggatgcgctcctaccgcccggaggagctgttcgacccggccggtgcgctgatgccggagttggcggcgctggcgccgtccgggctgcggcggatgggggcgaacccgcacgccaacggcggtgtgctgctgcgggatctgaagatgccggacttccgcgactacgcggtcgagccggccgggcacggcgtcgagcacgcggagtccacgaagatcctcggcacgttcctgcgcgacatcatgagcgacaattcgggtgctgacaacttccgggtcttcgggcccgacgagacggcgtccaaccggctgcaggcgttgttcgaggcgacgggccggatgtggaacgccgagacggtgccgtgggacgacgagcacctggcgctggacggccgggtgctggagccgctgagcgagcacatgtgccagggctggctggagggctatctgctgaccgggcggcacgggttcttctcgtgctacgaggcgttcatccacatcgtggactcgatgttcaaccagcacgcgaagtggctgaagacgacccggcacatcccctggcgggcgccgatcgcctcgctgaactacctgctgacctcgcacgtatggcggcaggaccacaacggcttctcgcaccaggacccgggcttcatcgaccacgtcgtgaacaagaaggcggacgtgatccgcgtgtacctgccgccggacgcgaacacgctgctgtcggtggcggaccactgcctgcgctcgcgggactacgtgaacgtcatcgtcgcgggcaagcagccgcaactccagtacctgtcgatggaagaagcgatcgtgcactgcacgcgcggcatcggcatctgggagtgggcctccagcgacggcgacggcgagccggacctggtgatgggctgcgccggcgacgtcccgacgatggagaccctggccgccgtggacatcctgcgccagaacttcccagacctgaaggtccgcgtggtgaacgtcgtggacctcatgcgcctgcagggcagcgacgaacacccgcacggcctgtccgacaaggaattcgacgccctgttcaccaccgccaagccagtggtcttcacctaccacggctacccctggctcatccaccgcctgacctaccgccgcaccaaccacggcaacctccacgtccgcggctacaaggaggaaggcaccaccaccacccccttcgacatggccatgctgaacgacatcgaccgctaccacctagccatcgacgccatcgaccgcgtccccggcctcgccgaacgcgccggccacctccgccagcaactcctggacgcacgcctgaaggcacgccagtacacccgcgagttcggcgaggacgacccggcgatttcggggtgggcgtggccttactga

SEQ ID NO: 265 - DNA, 2394 bp, Acidothermus cellulolyticus 11B
atgaccgaaccgaccgccggccctggtgatgccgtgctctccgatcaagaactcgctgccatcgacgcgtactggcgggccgcgaattacttatgtgtcggccaactctacctgctggacaatccgctcctgcgcgaaccgctgcgtccggaacacatcaagccgcggctgctcggccactgggggaccacgcccggcctcaacttcatctacacgcacatgaaccgcttcattcgccgtgacgattggaacgccattttcattaccgggccgggacacggcggcccggctccggttgcgcaggcgtatctcgaagggacgtacagcgaaatctacccgtccatcacgcgggacgaagaaggattgcgccggctcttccggcagttctctttcccgggcggtatcccgagtcacgcggcgccggagacgcccgggtccatccatgagggcggcgaattagggtacagcctggcgcacgctttcggcgcggtgttcgacaatcccgacctgctcgccgtctgcgtcgtcggcgacggtgaagcggagaccgggccgctggccacgagctggcactccaacaagtttctcaatccgcggcacgacggtgcggtgctgccgatcctgcatctcaacggctacaaaatagccgggccgaccgttctcggccggataccgcgttcggaactgctcgccctctttgagggctatggttatcgcccgctgctggtggccggcgacgatccggcggccatgcaccagttgatggcccggaccctcgaggaggcgctggacgacatccgggagatccagcggcgtgcgcgcagcggcgttcccggccggcccacctggccgatgattattctcgaaacacccaaggggtggaccggtccctgcgaggttgacggccgcccggtcgagggcagtttccgctcgcaccagatacctcttaccgatccccgcggtaacgccgagcatctcgcaatgcttgaagcatggatgcgcagctaccgaccggaagagctcttcgacgcccacggcgccgtccgacctgaactcaccgacctcgcgccgcggggagcccgccggatgagtgccaatccgcatgcgaacggcggtgtcttgctccgtgacctcttcctccctgatttcaccgcatatgccgttccggtggaaaagccggcgacgacgactagcgaggcgactcgggtgctcggccgctacctgcgcgacgtgcttgccctcaacgcggagagtcggaatttccggatctttggtccggatgagacggcgtcgaaccgtctcgacgccgttttcgacgtcgagaaccgcatgctcaacgcggacattctgccgaccgacgatcacattgcgcccgacggacgggttatggaggtgctctccgagcacctctgccagggttggcttgaagggtatctcctcaccggccgtcatgggctattcaattcctatgaagcgttcatccacatcgttgattcgatgttcaatcagcatgcgaagtggctcaaggtgacccgcagcctcccctggcggcgtccgatcgcgagcctgaactatctcctctcgagccacgtgtggcggcaggatcacaacggcttctcgcaccaggatccgggcttcatcgacttggtcgtcaacaagaaggctgaagtcatccgggtctatctgccgcccgacacgaacacgctgctctcagtgatggatcattgcctgcggacgaggaattacgtcaacgtcgtcatcgcgggcaagcagccggcgctcaactacctttccatgccggacgccatcgcacattgcacccggggaatcggcgtgtggagctgggccagcaacgacatgggtgacgacggcagaggggaaccggacgtcgtcatggccgcggcaggtgacgtgcccacgcttgaggctttagcagccaccgcactgctgcgggaattcttcccggatttacgggtccgcttcatcaatgtcgttgaccttatgcggctgcagccgagcagcgagcacccgcacgggctgactgacgcagagttcgacgcgttgttcaccaccgacaagccggtcatctttgccttccacggttacccatggctcatccatcggctcacctaccgcaggacgaaccacaagaacattcacgtgcgcggctacaaggaagaggggacgacgaccacgcccttcgacatggccatgctcaacgacatcgatcgctatcacttggtgatggatgtcatcgatcgggtaccgagcctgggcacccgtgcctatcacattcgacagcgcatggccgatgaacgtctggcgaaacggcgttacacccgggacgtgggtgacgaccatccggacgtcaagaactgggtgtggccgtggtag

SEQ ID NO: 266 - DNA, 2397 bp, Nocardioides sp. JS614
atggacgcaagcctggacaccctcgatcgctggtggcgcgccgccaactacctgtccgtcggccagatctacctgatggacaacccgctgctgcgcgagcccctggtcgccgagcacgtcaagccgcgcctgctgggccactggggcaccacgcccgggctgaacttcgtgtacgcgcacctcaaccgggcgatcatggcccgtcagcagcagatgatcttcatcaccggtcccggccacggtggtccgggcctggtcgcgtcgtcctacctcgaggggacctactccgaggtctacaccgacatcacccaggatgcggccgggatgcagcggctgttcaagcagttctcgttcccgggtggcatccccagccacgtggccccggagacaccgggctcgatccacgagggcggcgagctcggctacgcgctctcgcacgcgtacggcgccgcgttcgacaaccccgacctcgtggtggccgccgtcgtcggggacggcgaggccgagaccggcccgctcgcgaccagctggcactccaacaagttcctggacccgcgtcgtgacggcgcggtgctgccgatcctgcacctcaatggctacaagatcgccaacccgaccgtgctggcccggatccccgaggacgagctggtctcgctgctgcgtggctacgggtacacgccgtacgtcgtggcgggctcggacgccgcccagatgcacgccgacttcgccggcaccctggaccggtgcctcgaggagatcgcggggatccagggcgaggcgcgcgccgcctcggacccgctgccgaggccggcctggccgatgatcgtgctgcgctccccgaagggatggaccggcccgaaggaggtcgacggcaagcgcgtcgaggacttctggcgctcccaccaggtcccgttcgccaacgcccgcagcgacgacgcgcaccgtgcggtgctcgaggagtggctgcgcagctaccgacccgaggagctcttcgacgagtcgggggcgcccgccccggacatcgccgccctgcacccgggcggtgagctgcggatgagcgcgtcgccgcacgccaacggcggcctgctgctcaagcccctgcggatgcccgacttccgtgactacgcggtcgaggtggacgcaccaggtacgggctcggtcgaggcgacccgggtgctgggcgggttcctgcgcgacgtgatggcgcagaacatgcacaacttccggatgttcgcccccgacgagaactcctccaaccggctccaggacgtcatggaggtgaccgaccgggcgtggaacgccgagatcctcggctacgacgaccacctcgcgccggacggccggatcatggagatcctctccgagcacacctgccagggctggctcgagggctacctgctcaccgggcgccacgggctcttctcctgctacgaggcgttcatccacctgatcgactcgatgttcaaccagcacgcgaagtggctggagtccacccggcgcatcgagtggcggcggccggtggcgtcgctgaactacctgctcacctcgcacgtgtggcgccaggaccacaacgggttctcgcaccaggacccgggcttcatcgaccacgtcgtgaacaagaaggccaacgtggtgcgggtctacctgccgccggatgccaacacgctgctctcggtgggcgaccactgcctgcgcagcaagcactacgtcaacgtcgtggtcgcggggaagcagccggcgctgcagtacctctccatggacgacgcgatcgtgcattgcaccaagggcgccggcatctgggactgggcgtcgaacgacggcgacgagggtcccgacgtggtcatcgcctgtgccggcgacgtgccgacgatggaggcgctggccgcggtcgacctgctgcgcgagcacctgcccgacctgcggatccggttcgtcaacgtggtggacctgatgcgcctccagcccgcgagcgagcacccgcacgggttctcggaggccgacttcgacgccctgttcaccaccgaccggccggtgatcttcgcctaccacggctatccgtggctgatccaccggctgacctacaagcgcaccaaccacgccaacatccacgtgcgcgggtacaaggaggagggcaccaccaccacgccgttcgacatgacggtcctcaaccacatggaccgctacaacctcgccatcgacgtgatcgaccgggtgccgcggctggcggcgacctcgagtgacgcgcgggaggagttcaagaacgccctgatccggcaccggcagtacatccgcacctacggcgaggacctgccggagatccgcgactggacctggcagggctccttcgggccccgctaccgcaccgcgacccccgagctcgacgccccggagggctga

SEQ ID NO: 267 - DNA, 2397 bp, Saccharopolyspora erythraea NRRL 2338
atgacgaccaccgacacctggagcacctcgaccgacgtggccgagcacctcggccgggacgagctggagcggctgcagctctggtggcgggcggcgaactacctgtcggccgggcagatctacctgatggacaacccgctgctggaagagccgctgcgacccgagcacgtcaagccccggctgctcgggcactgggggaccacaccggggctgaacttcgtctacgcgcacctgaaccgggcgatccggctgcgctcgctggacatgatgtacgtgatcggtcccggccacggcggccccgcgctggtcgcggcggcgtggctggagggcacctacagcgagatctaccccgacgtggcccaggaccacgagggtctgcgaaggctggtgacccagttctccttccccggcggagtgcccagccacgtggccccggagacgccggggtcgatccacgagggcggtgagctcggctactcgctctcgcacgccttcggcgcggccttcgacaaccccggcctgatagtgccctgcgtggtcggtgacggcgaggccgagaccgggccgctggcgacgagctggcactccaacaagttcctcgacccggccaccgacggcgcggtgctgccgatcctgcacctcaacggctacaagatcgccaacccggcggtgtgggcgcgcatcccggaggacgagctgctgtcgatgctgcgcgggttcggctacgagccctacgtcgtcgagggctcgtcgccgctgccgatgcaccacctgttcgcggccactttggaccgttgcctcgacgagatcgccgcgatccagcgccgcgcccgcggcgacggtcacccgtaccgtcctaagtggccgatgatcgtgctgcgcacgcccaagggctggacctgtccggcgaccgtcgacggcaagccgctggaaggttcgtggcgttcgcaccaggtgccggtcagcgacccccgcaacaacccggaacacctgcgcctgctggaggaatggttgcgcagctaccggccggaggagctgttcgacgccggtggccgtccggtcgagacgatccgggaaggcaatcccgtgggggagcgcaggatgagcgcgagcccgcacgccaacggcggtcatctgctgcgcggcttgcggctgccggacttccgcgactacgcggttcccgtgcaggcgccgggcgcggacaaggcggaggggacccgggttctgggccggttcctgcgcgacgtcctgcggctcaactccgcgcagcgcaacttccgcgtgttcgcgccggacgagaacaactccaaccggctcgacgccgtcctggaggcgtccccgcgggcctgggtcgccgagaccgagccggacgacgagtcgctggccccgggcgggcaggtgatggagatcctgtccgagcacacctgccagggctggctggagggctatctgctgaccggcaggcacggcttcttctcctgctacgaggcgttcgcccacatcgtcgactcgatggtcaaccagcacgccaagtggctgaaggtcagcaggcacctgccgtggcgcaggcccgtcgcgtcgctgaactacctgctgacctcgcacgtgtggcgccaggaccacaacggtttctcccaccaggacccgggtttcatcgaccacgtggtgaacaagaaggcagagatcgtccgggtctacctgccgccggacaccaacaccctgctgtcggtgtccgaccactgcctgcgcagccgcgactacatcaacctggtcgtcgcgggcaagcagcccgaaccgcagtacctcgacatggagtcggcgatcgtgcactgcgagaaggggatcgggatctgggactgggcgagcaccgactccggcggcgacccggacgtggtgatggcctgcgcgggtgacgtgccgacgatggagacgctggcggccgtggacatcctgcgcggccacttcccggacctgcgcatgcgcgtgatcaacgtggtggacctgatgcggttgcaggacgagcgagaacatccgcacgggttgtcggacgcggagttcgacagcctcttcacgcgcgacaccccggtgatcttcaactaccacggctacccgtggctgatccaccggctgacctaccgcaggcacaaccacgaaggcatgcacgtgcgcggctacaaggaggagggcaccaccacgacgccgttcgacatgtgcgtgctcaacgagatcgaccgcttccacctggccatcgacgtcatcgaccgggtgccgcggctcgggccgcgcgccgcctacgcgcgcgagcacctcaagggaaagctcatcgagcaccgccaccacgtgagaacccacggcgaggacatgcccgaggttcgcgactgggagtggccgtcgtga

SEQ ID NO: 268 - DNA, 2385 bp, Rhizobium leguminosarum bv. trifolii WSM2304
atggaaaagcatgtctcgaccgccgccctgaccgacgccgaactcaccctcacggaccgctactggcgggccgccaattatctctcgatcgggcagatctacctgcttgccaatccgctgctgcgcgagccgctgaaaccggagcacatcaagccccgcctgctcggccactggggcacgacacccggcctcaacttcatctatgcgcacctgaaccgtctgatccgcgcccgcgacctggacgtcatctacatatgcggccccggccatggcgggccgggcatggtggccaatacctatctcgaaggcagttatagcgagctctatcctgacatatcagaggatgccgaaggcatgcgcaagctcttccggcaattctccttcccgggcggcattccgagccatgcggcgccggaaacccccggctccattcacgaaggcggcgaactcggttacgccctcgtccatgcctatggcgccgccttcgacaatcccaacctcatcgtcgcctgcgtcgtcggcgatggcgaggccgaaaccgggccgctcgccgccagctggcaatccaacaaattcctcaatcctgcccgcgacggcgccgtgctgccgatcctgcatctgaacggctacaagatcgccaacccgaccattctcgggcgtgcggatggtgatgacctcaaacgtctcttcgaaggctacggctacgaacccttcttcgtcgaaggccatgagccgcacgatatgcatcagcagatggccgcgacaatggacgaggtcttcgaccgcatccgcgcgatccagaagcaggcccgcaacggcaaggccgccgagggctgcccgcgctggccgatgatcgtgctgcgcagccccaaaggctggaccggcccaaaggaggtcgacggcaagaaggtggaaggcttctggcgcgcccatcaggtgccggtctccaactgccgcggagatgatggccaccgcaagatcctcgaggattggatgcgcagctacgatccggaagatcttttcggcgccgacggccggctgaagcccgaacttcaggcgctggcgcccgtcggcaagcgccgcatgggcgccaatccccatgccaatggcggcttgctgcgcaaagaactcgatgttcccgatataagcgactacgcggtcgatatcggcaagcgcggcagcgccatggtgcagtcgacggagatcctcggccattacctgcgcgacacgatgaagcgcaacgcggagaccgccaacttccgtatcttcggccccgatgagacggaatccaaccgtctcggcagcgtcttcgaagtcaccgaccgcatctggatggaaggtatcgaaccttacgatatccacctctcccgggatgggcgtgtcatggaggtgctctccgaacatctctgccagggctggctggaaggctacctgctgacgggccgccacggtctcttttcctgctacgaggccttcatccacatcatcgattccatgttcaaccagcacgccaaatggctgaaggtgacgcgcgagctcgaatggcgaaagccgatctcatcactgaactatctgctgacctcgcatgtctggcgccaggaccataacggcttcagccatcaggatccgggtttcgtcgatctcgtcgccaacaagaaggccgacatcgtccgcatctatctgccgccggacgccaacaccctgctctgggtcggcgaccattgcctgcgcacttacgaccgcatcaacgtcatcgtcgccggcaaacagccggagccgcaatggctgtcgatggatgaagcggtgaaacactgcgaggccggcatcggcatatggcactgggcgagcaacgaggaagacacgatttctcccgacctcgtcatggcctgcgccggcgacgtgccgaccatggaaacgctcgctgccgtcgacctcctgcgcaaggccatccccgagctgaagatccgcaccgtcaacgtcgttgatctgatggcactgcaatccaaggatcagcatccgcacggcctgaccgacgaggccttcgatgcgatcttcacatcggacaagccggtgattttcgcctatcacggctatccctatctcattcaccgcctgacctataaacgcaccaaccaccgcaacatccacgtccgcggcttcatcgaggagggcacgacgacgacacccttcgacatgaccgtcctcaaccaactcgaccgcttccacctcgccatcgaagcgatcgagcgagtcccgggtttgaaggagaaagcatcggatgcactcaccgccttccgtggccagcttgcgaagcatcacgactatgtcagggagtatggcgaggacatgccggaggtgcagagctggacgtggccggcggcataa

SEQ ID NO: 269 - DNA, 2385 bp, Rhizobium leguminosarum bv. trifolii WSM1325
atggaaaagcatgtctcgaccgctgcccttaccgatgccgaactcaccctgatcgaccgctattggcgcgccgccaattatctctccatcggccaaatctatctgctgaccaatccgctgttgcgcgagccgctgaaaccagagcacatcaagccccgcctgctcggccattggggcacgacacccggcctcaactttatctatgcacatctgaaccgtctcatccgcgcccgcgatctcgacatcatctatatgtgcggccccggccatggcgggccgggcatggtcgccaacacctatctcgaaggcatctacagcgagatctatcccgatatttccgaggatgcagagggcatgcgcaagctcttccggcaattctccttccccggcggcattccgagccacgcggcacccgagacaccgggctcgatccacgagggcggcgaactcggttacgccctcgtccatgcctatggcgccgccttcgacaatcccgatctgatcgttgcctgcgtcatcggcgacggcgaagccgaaaccgggccactggctgcgagctggcattccaacaagtttctgaaccctgcccgcgatggcgccgtgctgccgatcctgcatctgaacggctacaagatcgccaatccgaccattcttggccgcgccagtcacgaggatttgcagagcctctttgaaggctacggctatgagcccttcttcgtcgagggtcacgagccacgcgatatgcaccagcagatggccgcaaccttcgacagggtcttcgaccgcattcgcgaaatccaggaggaagcccgcaatggcaaggcgcccgatatctgcccgcgctggccgatgatcgtgctacgcagcccgaagggctggacaggaccgaaggaagtcgacggcaagaaggtcgaaggcttctggcgcgcccaccaggtgccggtctccaactgccgcgagaatgaagggcatcgcaagatcctcgaggactggatgcgcagctatgatccgaaagacctgttcggcagcgacggccggctgaaacccgagctgcgggcgctcgcccctgtcggcgagcgccgcatgggcgccaatccgcacgccaatggcggtttgctgcgcaaggaactcgatgttcccgatatccgcgactatgcggtcgatatcggcaagcacggtagcgccatggtgcagtcgacggaaatcctcggtcactacttgcgcgacacgatgaagcgcaacgccgatgccgccaacttccgcatcttcggccccgacgagacggaatcgaaccgcctcggcagcgtcttcgaagtcaccgaccgtgtctggatggagggtatcgaaccctacgacgtccacttgtcccgggatggacgtgtgatggaggtgctgagcgaacatctttgccagggctggctggaaggctacctgctgactggccggcacggcctgttctcctgctacgaggccttcatccacatcatcgattccatgttcaaccagcacgccaaatggctgaaggtgacgcgggaacttgagtggagaaagccgatctcgtcgctgaattacctgctgacctcgcatgtctggcgtcaggaccacaacggcttcagccatcaggaccccggtttcgtcgacctcgtcgccaataagaaggccgatatcgtccgcatctacctgccgccggatgccaacaccctgctttgggtcggcgaccattgcctgcgcacctatgaccgcatcaatgtcatcgtcgccggcaagcagccggagccgcaatggctatcgatggacgaggcggtgaaacattgcgaggccggcatcggcatctggcactgggcgagcaacgaggacgacaccatcctgcctgatctcgtcatggcctgcgccggcgacgtgccgaccatggagacgcttgctgccgtcgacctgctgcgtaaggcaattccggaactgaagatccgcgccgtcaacgtcgtcgatctcctcgcactgcaatccagggatcagcatccgcacggcctgaccgacgaggcattcgatgcgatcttcaccgccgacaagccagtcattttcgcctatcacggctatccctatctcatccaccgcctgacttataaacgcaccaaccaccgcaacttccacgtccgcggcttcatcgaggaaggcacgacgaccacacccttcgacatgaccgtcctcaacgaactcgaccgcttccacctcgccatcgaagcgatcgagcgcgtgccgggcctgaaggaaaaagcaggagaagcgctcgccgccttccgtggcaagcttgcggaacatcacgactatgtccgcgaatatggtgaggacatgccggaggtacggaactggacatggccgatggcgtga

SEQ ID NO: 270 - DNA, 2388 bp, Rhizobium etli CIAT 652
atggaaaagcatatctcgaccgccgccgccctgaccgaggccgaactcggcctgatcgaccgctactggcgggccgccaactatctctcggtcggccagatctacctgcttgccaatccgctgctgcgcgagccgctgaaaccggagcacatcaagccgcgcctgctcggccactggggcacgacgcccggcctcaacttcatctatgcgcatctcaaccgcctgatccgcggccgcgatctcgacgtcatctatatatgcggccccggtcatggtgggccgggcatggttgccaacacctatctcgaaggcagctatagtgagatctatcctgatatctccgaggatgccgaaggcatgcgcaagctcttccggcaattctccttccctggcggcatcccgagccacgcggcaccggaaacgccaggatcgatccatgagggcggcgaactcggctacgccctcgtccacgcctatggcgccgccttcgacaatcccgacctgatcgtcgcctgcgtcattggcgacggcgaggccgaaaccgggccgttggcggcgagctggcattccaacaagttcctcaatcccgcccgcgacggcgccgtgctgccgatcctgcatctgaacggctacaagatcgccaacccgaccattctcggccgtgccgctgacgatgatctccgccgtcttttcgaagggtacggctatgaaccgttcttcgtcgacggccatgagccacgcgatatgcatcggcagatggccgcgacgctggacctgatcttcgaccgcatccgcgacattcagcaacaggcccgcaacggcaaggctgcagacggctgcccgcgctggccgatgatcgtgctgcgcagccccaagggctggacgggcccgaaggaggtcgacggcaagaaggtggaaggcttctggcgcgcccatcaggtgccggtttccaactgccgggaggacgatggccaccgcaagatcctcgaggactggatgcgcggttatgatccggaagacctgttcgatacgggaggccggttgaagcctgagctgcgggcactcgcccctgccggcaaacgccgtatgggcgccaatccgcatgccaatggcggcctattgcgcagggagttggctgttcccgatcttagggactatgccgtcgacatcggcaggcgcggcagtgttgtggcgcagtcgacgcaaatcctcggccactatctgcgcgacacgatgaagctcaacgccgagacagcgaatttccggatcttcggccccgacgagacggaatcgaaccgtctcggcagcgtttttgaagtcaccgaccgtgtctggatggaggatatcgaaccctatgatatccatctctcgcgcgatgggcgcgtcgtggaggtgctctccgaacatctctgccagggttggctggaaggctacctcttgaccggccgccacggcctgttctcctgctatgaggctttcatccacatcatcgactccatgttcaaccagcacgccaaatggctgaaggtgacgggcgagctggagtggcgaaagccgatctcctcgctgaactacctgctgacctcgcatgtttggcgccaggaccataacggcttcagccaccaggatcccggtttcatcgatctcgtcgccaacaagaaggcggatatcgtccgcatctatctgccgccggatgccaataccctgctctgggtcggcgatcattgcctgcgcacctatgaccgcatcaatgtcatcgtcgccggcaagcagccggagccgcaatggctgtcgatggacgaagcggtgaaacattgcgaagccggcatcggcatctggcactgggcaagcaacgaggaagaggccgtcgcgcccgacctcgtcatggcctgcgccggcgacgtgccgaccatggagacgctcgccgccgtcgacctcttgcgcaaggccgtgccggcgctgaagatccgcactgtcaacgccgtcgatctgctggcgctgcaatccagcgaccagcatccgcacggcctgaccgacgaggccttcgatgcgatcttcacgtcagacaagcctgtcatcttcgcctatcacggctatccctatctcattcaccgcctgacctataagcgcaccaaccacgagaacatccacgtccgcggcttcatcgaagagggcacgacgacgacgcccttcgacatgaccgtcctcaacgaactcgaccgctatcatctcgcgatcgaagcgattgagcgcgtaccgggcctgaaggaaaaggcggcggatgcacttgccgccttccacgacaagcttgccgagcatcacgcctatgtcagggaatacggcgaggacatgccggaggtacggaactggacgtggccgacggcgtga

SEQ ID NO: 271 - DNA, 2388 bp, Rhizobium etli CFN 42
atggaaaagcatgtctcgaccgccgccgccctgaccgatgttgaactcaccctgatcgaccgctattggcgggcggccaactatctctcggtcggccagatctacctgcttgccaatccgctgctgcgcgagccgctgaagtcagagcacatcaagccccgcctgctcggccactggggcacgacaccgggcctcaacttcctttatgcgcatctgaaccgcgtcatccgcgcccgcgatctcgacatcatctacatatgcggccccggtcacggcgggccgggcatggtcgccaacacctatctcgaaggcacctacagcgaaatctatcccgatatttctgaagacaccgaagggatgcgcaggctcttccgccaattttcctttcccggcggcattccgagccatgcggcgccggaaacaccgggatcgatccatgaaggtggcgaactcggctacgccctcgtccatgcctatggcgccgccttcgacaatcccgacctcaccgtcgcctgcatcgtcggtgacggcgaggccgaaaccgggccgctcgccgccagctggcattccaacaagttcctcaatcccgcccgcgacggcgccgttctgcccatcctgcatctgaacggctacaagatcgccaatccgaccattctcggccgggccaacgacgacgacctccgacgtctcttcgaaggctacggctacgagccgtttttcgtcgacggccatgagcctcgcgacatgcatcaacagatggcagcgacgctggaccaggtcttcgaccgcatccgcgaaatccaggagcaagcccgcagcagcaaggctgctgcgggctgcccgcgatggccaatgatcgtgctgcgcagcctcaagggctggaccggtccgaaagaagtcgacggcaagaaggtggaaggtttctggcgcgcccaccaggtgccggtctccaactgccgcgagaatgaaggccatcgcaagattctcgaggactggatgcgaagctacgatcccgaagatctgttcgatgacgagggccgcctgaacgccgacctgcgggcgctggcgcccgtcggcaagcgccgcatgggcgccagtccacatgccaacggcgggttgctgcgccgggagctcgatgttcccgatataggcgactatgcggttgacgtcggcaagcgcggcagcgtcgtcgcccaatcgacggagatcctcggacattacctgcgtgacacgatgaagctcaacgccaaggcggcaaactttcgcatcttcggccccgacgagacggaatcgaaccgcctcggcagcgtgttcgacgtcaccaaccgtgtctggatggaggatatcgaaccatatgatgtccatctctctcgcgatggacgcgtcatggaggtgctttcggaacatctctgccagggatggctggagggttacctgctgaccggccggcacggcctcttttcatgttatgaggccttcatccacatcatcgattccatgttcaaccagcatgccaaatggctgaaggtgacacgcgagctcgaatggcggaagccgatctcatcgctgaactacctgctgacctcgcatgtctggcgccaggaccataacggcttcagccaccaggatccgggcttcgtcgacctcgtcgtcaacaaaaaggccgacatcgtccgcatctacctgccgccggacgccaacaccctgctctgggtcggcgatcattgcctgcgcacctatgatcgcgtcaacgtcatcgtcgccggcaagcagccggagccgcaatggctgtcgatggaggaggcggtgaaacattgcgaggccggcatcggcatctggcgctgggcaagcaacgaggaggacacgatctcgcccgatctcgtcatggcctgcgccggcgatgtcccgacgatggaaacgctcgccgccgtcgatcttctgcgcacggccattcccgagctgaagatccgcaccgtcaatgtcgtcgacctcctggcactgcaatccagggaccagcatccgcatggcctttccgacgaggccttcgacgcgatcttcaccgctgataagccggtcattttcgcctatcacggctatccctatctcattcaccgcctgacctataagcgcaccaaccacgagaacatccacgtccgcggctttatcgaggaaggtactacgaccacgcctttcgacatgaccgtcctcaacgaactcgaccgctaccatctcgccatcgaagccatcgagcgcgtgccgggcctgaaggagaaggcgaaaggcgcgtttgccgccttccagggcaagctcgcggaacatcacgactatgtcagggaatacggcgaggacatgccggaggtgcggaactggacgtggccggccgcgtga

SEQ ID NO: 272 - DNA, 2415 bp, Agrobacterium radiobacter K84
atggaaaagcagccagccgccacgtttacacatccgctcgacgacgccgagctcgatctcatcaaccgctattggcgagctgccaattacctctccgtcggccagatctacctgctcgacaatccgctgctgcgcgagccgctgaaagccgagcatatcaagccgcgcctgcttggccattggggcacgaccccagggctcaacttcatatatgctcatatcaaccggatcatccgcaatcgcgatctcgatatcatctatatttgcggccccggccatggtggcccgggcatggtcgccaacacctatctcgaaggcacctatagcgagatctatccggatatttccacggatacgtccggcatgcacaagctgttccgccagttctcctttcccggcggcattccgagccacgcggcgcctgaaacacccggatcgatccatgaaggcggcgaactcggctatgctctggtgcatgcctacggcgccgtcttcgacaatcctgatctgatcgccgcctgtgtcattggcgacggtgaagcggaaaccggcccgcttgccgccagctggcactccaacaagtttctcaatccggcccgcgatggcgcggtgctgccgatcctgcatctcaatggctacaagatcgccaatcccaccatccttggccgcgacaccgaagaggatctgcgtcacctcttcatcggctacggctacgaacccttcttcgtcgaaggatcggacccgcatcagatgcatcaggctatggccgctaccttcgaacaggtcttcgatcgcatccgcgccatccaggccgaggcccgcaccggcatgccgggcaatttctgcccgcgctggccgatgatcgtgttcagaagtccaaagggttggaccggaccgaaggaagtggacggcaagaaggtcgagggcttctggcgagcgcatcaagtgccggtttccaattgccgcaaggatgccaaccaccggcagatcctggaagactggatgcgaagctatgatccacaggatctcttcgacacggacgggcgcttgaaagaggaactgcgcgcactggcaccgacggccaagcgccgcatgggcgccaatccccatgccaatggcggccttttgcgccgagagcttattgtgcctaatatccgcgcctatgcggtcgccgtcaaagagcgcggcagaacaatggcgcaatcgaccgaagtcctcggccattatttgcgcgatatcctgaccctcaatagcgatcataccaatttccgcatcttcggccccgatgagacggagtccaaccgcctcggtagcgtcttcgaagtgaccgaccgcgtgtggatggaggaaataaagccctatgacgtgagccttgcgcctgacggacgggtgatggaggtgcttagcgagcatctgtgccagggttggctagagggctatctgttgaccggccgccacggcctattctcctgctatgaagcattcatccatattattgattccatgttcaatcagcacgccaagtggctaaaggtgtcgcgagagctgccgtggcgaaagccgatttcctcgctgaactacctgctgacgtcgcatgtctggcggcaggaccataatggcttcagccaccaggaccccggcttcatcgatctagtcgccaacaaaagagccgataccgtgcgcatctacctgccgccggatgccaacacattgctttggaccggcgaccattgcctgaagacttatgaccgcatcaacgtgatcgttgccggcaaacagccggagccgcaatggctgtcgatggatgaagccatcaagcattgcgaggccggtattggcatctgggagtgggctggaaacgaacagggcgcggtcgaacccgatgtcgtcatggcctgcgccggcgatgtccccaccatggaaatgctcgccgccgtcgatcttctccgccagaacattccggaactgtcgatccgcgtggtcaacgttgtcgacctgatggcgctgcagtcaaaggaacagcacccgcatggtctcgccgacgcggtcttcgacaagttgttcacaccggatcgtccggtcatcttcgcctatcacggctacccttatctgatccaccgcctgacctaccggcgcaccaaccacggcaatatccatgtccgcggcttcatcgaggagggaacgacgacgacgccgttcgacatgaccgttctcaacgagctcgaccgctaccatcttgccatcgaggcgatcgagcgtgtgccgggtctgagggagaaggcgatgaatgtgatcaagcttttccgcgacaagctcgaagaacacggtcgctatatccgccaatacggcgaggacatgccggaaatcagcaattggaaatggccctatgacagcaatgggtaccgtttgtcctga

SEQ ID NO: 273 - DNA, 2379 bp, Brucella sp. 83/13
atgagcactgtgccagcaaaagggcctctcacaccgcaacagctttcgctcatcaaccgttactggcgcgcggcgaattatctttccgtcggccagatttacctgatgaaaaatcccctactgcgcgaaccgctccagcttgagcacatcaagccgcgacttctcggccattggggcacgacacccggcctcaatttcatctatgcgcatctcaaccgcatcattcagcaacgcaacgccaatgtgatctatatttgcggccccggccatggcgggccgggcatggtggccaacacctatctggagggcacctattccgaaatctatcccgcaatcagcgaagatgaagcgggcatggaaaagctcttccgccagttttccttccccggcggaataccaagccatgccgcgccggaaacgccgggctccatccatgaagggggcgaactgggttatgcgctcgtccacgcctatggtgcagccttcgacaatcccgacctggtggtggcctgcgtcgtgggcgacggagaagcggaaaccggcgcgcttgcaacttcgtggcactccaacaaattcctcaatccggcgcgcgatggtgcggttctgccgatcctgcatctcaatggctacaagatcgccaaccccaccgtgctggcccgcctttcggataatgatctggacaatcttttccgtggctacggttatgagcctttctttgtcgaaggcagcgagcctgccgacatgcaccagaagatggccgcgacactggacacgattttccagcgcattgaggacatcaagaaaaatgccgatgtgcactcacccgagcgcccgcgctggccgatgattattctcagaagcccgaaggggtggaccggccccaaaaccgtggacggtctggttgttgaaaactattggcgcgcccatcaggtgccggttgccaattgccgcgaaaacgatgcccatcgcaaaatcctcgaagactggatgaagagttacgacccgtccgatctgttcgacgaaaaaggggcgctgaagcctgaattgcgggcgctggcgccaaagggtgaagcgcgcatgggggccaatccgcatgccaatggcgggctcttgcgtaaagagcttcacatgccggatttccgccaatatgcggtcaatgtcaccgaaccgggagcgatagaagcgcaatcaaccaaaatattgggcgattttctgcgtgatgtgatgaaactgaacgagacggaaaagaacttccgcatcttcggccccgacgaaaccgcttccaacaggctcggcagcgtattcgaggcgacgaaccgggtctggatggccgaaacactggacatggatgaccatctcgccgccgacgggcgtgtaatggaggttctcagcgaacatctgtgccagggctggctcgaaggctatcttctcagtggcaggcacggcttcttttcctgttacgaagccttcatccacattatcgattccatgttcaaccaacatgccaaatggttgcaggttgcgcgcgaactggaatggcgcaagcccgtctcatcgctcaattatctgctgacctcccatgtctggcggcaggaccataacggcttctcccatcaggatcccggcttcgtcgatctcgtcgccaacaaaagcgccgatatcgtgcgcgtctatttcccgccggatgccaacacccttttgtgggtgggagatcactgcctgaaaacctggaaccgcgtgaatgtcatcgtggcgggcaagcagccggaaccgcaatggctgaccatggcggaggctgagaaacattgcgaagcaggtctcggcatatgggaatgggcgggcacggaagacgggctggaaccggatatcgtcatggcctgcgcgggcgatgtgccgaccatggaaacgcttgccgcggttgatcttctgcgccagtctctgccgcatctgcacattcgcgtggtgaatgtggttgacctcatggtgctgcaatcgccgcatcagcacccgcatggcatttccgatgaggaattcgaccggattttcaccaccaataggcctgtcatcttcgcctatcacggctatccttatctcatccatcgactggtctataagcgcaccaaccactccaatttccacgttcgcggttttatcgagcagggaacaaccacaacgcctttcgacatgaccgtgctgaacgagctggatcgtttccacctcgcgatggaagccgtcgagcgcctgccgctgggcgaaagcgttgccaaacccctgatcgacaatttcacggagaaacttgcgctgcataaggactatattcgacagcatggtgaggacatgccggaaatccgcaactggaaatggacatggccgcgataa

SEQ ID NO: 274 - DNA, 2490 bp, Ochrobactrum intermedium LMG 3301
ttgctaccgacgaggaacagattatcgccgccgaaacgctggacgctcttcggaaccccgcagttacagcgcccgccgcatctgcgtaaccatccgcgaaggagacagagaatgaccaaagcaccggcccaaggccccctggcacctcagcagctcgcgctgatcgatcgctactggaaagcggcgaactatctttcggtggggcagatctacctgatggacaatcccctgctgcgcaaaccgctggaacctgagcatatcaagccacgactgctcggccactgggggacgacgcccggcctgaatttcatttacgcgcacctcaatcgcatcattcgggaaagaaatgccaacataatctacatatgcgggccggggcacggtggaccgggcatggtagcgaacacctatctggaaggttcctattctgaaatctatccgggcgtgagcgaggatgaggcaggaatgcgcaaactgttccggcagttttcctttcccggcggcataccaagccatgtcgcgccggaaaccccgggctcgatccatgagggcggcgagctgggatatgcgcttgtgcacgcctatggcgccgctttcgacaatcctgatctggtggtcgcctgtgtggtcggcgatggagaggcggaaacgggaacccttgccgcctcgtggcattccaacaagtttctcaatcccgcacgcgacggcgccgtgctgccgatccttcatctgaacggctataaaatcgcaaatcccaccatcctcgcccgcctttccgatgacgacctcaccagtctcttcaggggctatggctatgagccgttcttcgtcgagggcagcgaacccgaggccatgcaccaacagatggcagcaaccctcgatgcgatcttcgcccgggtcgagacgataaagcgaagtgccgatgtgaaatcaccggagcgcccccgctggcccatgatcattctgcgaagcccgaaaggttggaccggcccgaaggaggtcgacgggctgatcgtagagaattactggcgatcgcatcaggttcccgtcgctaattgccgcgaaaatgatgcgcatcgcaaaattcttgaaaactggatgaaaagctatgacccggaggacctgtttgacgaaaaaggtgcgctgaagcccgaactgcgcgcgctcgcgccgcagggcgaacggcgcatgggggccggcccgcatgcaaatggcggcttgcttcgcaaggaactgcacacgcccgacttccggcaatatgccgtcgaggtcaccgaaccgggagcgctggaagggcaatccaccaaaatactcggtgaatatctgcgcgacgtgctgaagctgaacgagcgggagaagaatttccgtgtcttcggtcccgatgagaccgcttcaaaccgtctcggcgcggtcttcgatgccagcgaccgcgtgtggatggctgaaaccttagacatagacgaccatctgtcggccgatggccgcatcatggaagtattgagcgagaatctgtgtcagggctggctggagggctatctgctgaccggaaggcacgggtttttctcctgctacgaagccttcatccatattgtcgattccatgttcaaccagcatgcaaaatggttgcaggtcgcgcgcgaactgaaatggcgaaaaccgatttcatcgctcaactatcttctgacctctcatgtctggcgtcaggatcataacggcttttcccatcaggacccgggctttgtcgatctggtggccaataagagcgccgatatcatccgcgtctattttcccccggacgccaacacgctgctgtgggttgccgatcactgccttaaaacctgggatcgcatcaacgtcatcgtggcgggaaaacagcctgaaccgcaatggctgtcgatagacgaggccgtgcgccattgcgaagccggtctcggcatatgggactgggccggaaccgaggacggtctggaacccgacatcgtgatggcctgcgcgggtgatgtgccaacgatggaagttctcgccgctgtttctctcctgcgccagtccctgccgcatctgcgcatccgcgtcgtcaatgtcgtggacctgatggttctgcaatcaccgcaacaccatccgcacggcattgccgacgacgagttcgaccgcatcttcacgaccaaccggcccgtcatctttgcttaccacggttatccctatctcattcaccggctggtctataaacgcaccaaccattccaatttccacgtgcacggctttatcgaacagggaaccacgaccacgcctttcgacatgacggtgctgaacgaactggaccggtttcatctggccatggcggctgtcaggcggctgccaatcggcaatgacgtggcgggtcctttgatcgccacgttcgaggaaaagctggttcttcacaaacgttacgtgcgggaacatggcgaagacatgccggaaatccgggattggaaatgggacgcacggctgtaa

SEQ ID NO: 275 - DNA, 2388 bp, Ochrobactrum anthropi ATCC 49188
atgaataatcagactggcgcccagccgcttactccagatcagctgaaactgaccgaccgctattggcgtgcagccaattatctctccgtcggccagatttatctgatgcaaaatccgatgctgcgcgagcctttaaagcctgaccacgtcaaaccgcgtttgctgggccattgggggacaacacccggcttgaacttcatctatgtgcatctcaaccgcattattaaagaacgcaacaaggatgtgctctatgtttgcggtcccgggcatggtggcccgggcatggtagcgaacacctatctggaaggcacttatactgaaacctatcctgacattaccgaagatgttgaaggtatgcaaaagctcttccgccagttctcgtttccgggcggtattccaagccatgtggcacccgaaactccgggttccatccatgagggcggcgagcttggctatgcgcttgtgcatgcttacggcgcagcttttgacaatcccgatctcgtcgttgcctgtgtcgtaggtgatggtgaggccgaaaccggcccgttggcagcagcatggcattccaacaaattcctcaacgcgaagcgcgatggcgcggtgctgccgattcttcatctgaacggctataaaatcgccaatccgaccctgctcgcccgtatgtcggatgaagacctgcacagtcttttcaccggctatggctatgagccatttttcgttgaaggccatgaaccggaaaaaatgcaccagctgatggcagcaacttttgacatggcttttgaccgtatcaaaaccattaaagagcaggccgatcttaaatcgccggagcgtccgcgctggccgatgattattctgcgcagcccgaaaggctggacaggacccaaagtggttgatggtaaaatggtggagaaccattggcgttcccatcaggtgccggttgccaattgccgtgctgatgatgcacaccgcaaaatcctcgaagactggatgcgcagctatgagccggaagacctgtttgacgaaagcggtaagctcaaaccggaattacgcgcaatagcaccggatggtgaaaagcgcatgagcgccattccgcattccaatggtggcttgctgcgtaaggaactgaacacaccggatttccgaaaatatgcggtcaatgtcaccgaaccgggcgcggttgaagaacagaccaccaaaatcctcggcgactatctgcgcgatgtcatccgcctcaatgacgaagagaaaaacttccgcgtcttcgggcctgatgaaaccgcctccaatcgtctgggcagtgtttttgaagcaaccgaccgtgtctggatggctgaaactttaggcagtgacgaccatctggcggctgatggccgcgtgatggaagtgctgagtgaacatctgtgtcaaggttggctggaaggttatttgctgaccggacgccatggcttcttctcctgctatgaagcttttatccatattgtggattccatgttcaaccaacatgctaaatggttgcaagtggcacgcgaactgccatggcgcaagccggttgcatcgcttaactatctgctgacgtctcatgtctggcgtcaagatcacaacggcttctcccatcaggatccgggctttgtcgatctggttgccaataagagcgctgatattgtccgtgtttatttcccgccggatgccaatacgctgctttgggtgggtgagcactgcctcaaaacatggaaccgcgtgaacgtgattgtggctggcaagcagccatcaccacaatggctcaccatggatgaggcagaaaaacattgtgaagccggtcttggcaaatgggactgggcaggcagcgaagatggcatggaaccagatctggtgatggcttgtgctggtgatgtgccgaccatggaaacattggccgccaccgcaatgctgcgtgaagcattgccacatttgcgcattcgtgttgtcaatattgtcgacctgatggcgctgcaatcaccgcagcatcacccgcatggtattgccgatagtgaatttgatgcgcttttcaccaccgaccgtccggtgattttcgcctatcacggctatccatatctcattcaccgtctggtttataagcgcgccaatcatccgaacttccatgtgcgtggctttatcgaaaaaggcacaaccacaacgccgtttgatatggctgtcatgaatgaactggatcgttatcatctggcaattgaagcactccaccgcctgcctttggccgctgatattgccgagcctctgatcacttcgctcaatgagaagctgcaaaagcatcatgactatgtgcgtgaacatggcgaagacatgccggaagtacacgattggaaatggccgcatagcggcgttgttgcatga

SEQ ID NO: 276 - DNA, 2478 bp, Bradyrhizobium sp. ORS278
atggtgctgcgctactctcctgtacgctcccgcaggcgcgaagcggaaggcaagcgaggtcccatgcagagttctccccaccccaccagcccagccgacgatctcgatctgctcgaccgctactggcgcgccgccaactatctctcggtgggccagatctatttgctcgacaacccgctgctgcgcgagccgctgaagcccgagcacatcaagccgcgcctgctcggccattggggcaccacgcccgggctgaacttcatctacgctcacctcaaccgcgccatcgccgcccaggatctcgacgtgatctatgtctgcggcccaggccatggcggcccgggcatggtcgccaacacctatctcgaaggcagctacaccgagttctatccggacatcacgcgcgatgtggatggcttgcgcaagctgttccggcagttctccttccccggcggcattccgagccacgcggcgccggagacgccgggctcgatccacgaaggcggcgagctcggctacgccctggtccatgcctatggcgcagcgttcgacaatcccgacctgatcgtcgcctgcgtcgtcggcgacggcgaagccgagactggtccgctcgccgcatcctggcattcgaacaagttcctgaacccggcgcatgacggcgcggtgctgccgatcctgcatctcaacggctacaagatcgccaacccgaccgtgctcggccgcatgggcgacgccgagatcaagtgcctgttcgagggctacggctacgcgccgctgttcgtcgcaggcgacgagcccgaggcgatgcaccggcagatggcggacgcgctcgacgtggcgctcgcgagcatccgctcgatccggcagaacgcgcgccagccggatgcggcgatccagcgcccgcgctggccgatgatcatcctgcgcagcccgaagggctggaccggaccgaaggaggtcgacggcctcaaggtcgaaggcttctggcgcgcccatcaggtcccgatcgccaatccgcgcggcaagccggagcatctcgctttgctcgaagcctggatgaagagctatcagccggagacgctgttcgacgcgcagggccggctcgtgccggagctgcaggcgctcgcgcccaagggccggcggcgcatgggcgccaatccgcatgccaatggcgggctgctcaagcgcgagctgaagctgccggactatcgcgcctttgcggtcgaggtgcgctcaccgggcgagaccatcgccgaggcaacgcgcgagctcggcaagtttctgcgcgaggtgatcacgctgaacgcggatcataagaacttccgcatcatgggcccggacgagaccgcctcgaaccggctcgacgcagtgttcgaggtcaccgaacgagtctggatggaaggcatcgagccctatgatgtccatctcgcgcataatggccgtgtcatggaggtgttgagcgagcatctctgccagggctggctcgaaggctatctgctcacgggccgccatggcgtgttctcctgctacgaggccttcatccacatcatcgattcgatgttcaatcagcacgccaaatggctgaaagtatcgcgccatctgccatggcggcgaccgatcgcctcgctgaattatctcctcacctcgcatgtgtggcggcaggaccataacggcttcagccaccaggaccccggcttcgtcgaccttgtcgccaacaagaaggccgacatcgtccgcatctactttccgcccgatgcgaatacgctgttgtggatatcagaccactgcctgcgcacctacaatcgcatcaacgtcatcgtcgccggcaagcagccgtcgccgcaatggctctcgatgccggaagcggccgtgcattgcgacgccggcatcggcatctggccgtgggccggcaccgagcgcggcggcgcggagccggatgtcgtgatggcctgcgccggcgacattccgacgatcgagacactggcggcggtcgacctgctgcgcagggcgctcccagacttgaggatccgcgtcgtcaacgtcgtcgatctcatgaccctgcagcccgacaccgagcatccgcatggcctcagcgaccgcgacttcgacagcctgttcacgaccagcaagccggtgatcttcgcctatcacggctatccgcacctgatccatcgcctgacctacagccgcgccaaccatgccggcatgcatgtgcgcggcttcatcgaggaaggcaccacaacgacgccgttcgacatggtcgtgctgaacgaactcgatcgtttccatctcgcgatcgaggtgatcgagcgcgtgcccgggctcagcgtctcggccgcccaggtgaagcagagcttccgcgacgcgctgatcgcgcatgcgcgctacgtgcgcgagcatggcgaggacatgccggaggtccgcgactggatctggccaaacagcgcaggcgggacgacgccggcccaggcggcggattga

SEQ ID NO: 277 - DNA, 2418 bp, Bradyrhizobium sp. BTAi1
atgcagaccacttctccccagcagacccacacggccgacgacctcgacctgctcgaccgctattggcgcgcggcgaattatctctcggtcgggcagatctacctgctggacaacgcgctgctccgcgagccgctgcagccgcagcacatcaagccgcggctgctcggccattggggcacgacaccgggcctcaacttcatctacgcgcatctcaaccgcgcgatccggatgcaggatctcaacgtcatctatgtctgcggccccggccatggcggcccgggcatggtcgccaacacctatctcgaaggctcctacagcgagatctatccggacatcacgcgcgacgcggacggcttgcgaaaactgttccggcagttctccttccccggcggtatccccagccatgcggcgccggagacgccgggctcgatccatgaaggcggcgaactcggctatgcgctggtccatgcttatggcgccgcgttcgacaatcccgacctgatcgtcgcctgcgtggtcggcgatggcgaggccgagaccggcccgctcgccgcgtcctggcattcgaacaagttcctcaacccggcccatgacggcgcggtactgccgatcctgcatctcaacggctacaagatcgccaacccgaccgtgctcggccgcatgagcgacgccgagatcaaatgcctgttcgaaggctatggctatgcgccgctgttcgtcgcgggtgacgagcctcaggcgatgcacaggcagatggcggacgcgctcgatgtcgcgctcgccagcatccgctcgatccagcagaatgcgcggctgccggatgcggtgatccaccgcccgcgctggccgatgatcgtgctgcgcagcccgaagggctggaccgggccgaaagaggtcgatggcctcaaggtcgaaggcttctggcgcgcgcaccaggtgccgatcgccaatccgcgcggcaagccggagcatctcgcgctgctcgaagcctggatgaagagctatcagccggagacgctgttcgacacgcagggccggctggtgccggagttgcaggcgctggcgccgaagggcacgcgccgcatgggcgccaatccgcacgccaatggcgggctgttgaagcgcgagctcaagctgccggacttccgcgctttcgccgtcgcgctgcgcgccccgggcgagaccatcgcggaggcgacgcgcgagctcggaaaattcctgcgcgaggtcatcacgctgaatgcggatgcgagaaacttccgcatcatgggcccggacgagaccgcttcgaaccggctggatgcggtgttcgacgtcaccgagcgggtctggatggaaggcatcgagccctacgacgtccacctcgcccatgacggccgcgtcatggaggtgctgagcgaacatctctgccagggctggctggaaggctatctgctcaccggccgccacggcttgttctcgtgctacgaagccttcatccacatcatcgattcgatgttcaaccagcacgccaaatggctgaaggtgtcgcgccatctgccgtggcgccggccgatcgcgtcgctgaactatctcttgacctctcacgtctggcgccaagaccataacggcttcagccatcaggaccccggctttgtcgacctcgtcgccaacaagaaggctgatatcgtccgcatctacttcccgcccgatgccaacacgctgctgtggatcgccgaccactgcctgcgtacctatgaccgcatcaacgtgatcgtcgctggcaagcagccctcaccgcaatggctgacgatgcaggaggcggcgacgcattgcgatgccggcatcggcatctggtcatgggccggcaccgagccggccgacgcagcgcccgacgtggtgatggcctgcgccggagacatcccgaccttggagacgctcgccgccgtcgacctgttgcgcaaggcgctgcccgagctcaagatccgcgtcgtcaacgtcgtcgatctgatgaccttgcagcccgacactgagcatccgcacggactgagcgaccgcgatttcgacagcctgttcacgaccgacaagcccgtcatcttcgcctatcatggctacccgcatctcatccatcgcctgacctacagccgcaccaatcatgccggcatgcatgtgcgcggcttcatcgaggaaggcaccacgacgacgccattcgacatggtggtgctcaacgagctcgatcgtttccaccttgccatcgaagtcatcgagcgcgtgccggggctcagcgtctcggcggcccatgtgaagcagacattccgcgacgcgctgatcgaacacacgcgctatgtccgcgagcacggcgaggacatgcctgcgatccgcgattgggtctggcccaacagtacaggcggaacgactccggcggaggctggcgactga

SEQ ID NO: 278 - DNA, 2406 bp, Bradyrhizobium japonicum USDA 110
gtgaaggtcggcaggaacatgacaaatcaacaacaatcggccgccgcgagcagcgacctcgatctccttgatcgctactggcgcgccgccaactacctctccgtcgggcagatctacctgctcgacaaccccctgctgcgcgaaccgctgcgggccgagcacatcaagccgcgtttgctcggccattggggcacgacgcccggcttgaacttcatctacgcccatctcaaccgcgtcatccgagcgctggacctcaacgtgctctatgtctgtggtcccggccatggcggcccgggcatggtcgccaacacttatctcgaaggcagctacagcgagatctatcctaacatcgcgcgcgatgcggacggattgcgcaagctattccggcagttctccttccccggcggcatcccgagccacgccgcgccggagacgcccggctcgatccacgaaggcggcgagctcggctacgcgctggtgcacgcctatggcgcggcgctcgacaatcccgacctggtcgtcgcctgcgtcgtcggcgacggcgaggccgaaaccggcccgctcgcggcgtcctggcactccaacaagttcctgaacccggcgcatgacggcgcggtgctgccgatcctgcacctgaacggctacaagattgccaacccgaccgtgctcggacgaatgtctgacagcgagatccgcgatctcttccgcgggttcggccacgagcccctgttcgtcgagggcgacgatcccaaattgatgcaccggatcatggcggatgcgctcgacgtcgcattcgccagcatccgctcgatccagcagcacgcccgcgacgggcgcaaaaatatcgagcggccacgctggccgatgatcgtgctgcgcagcccgaagggctggaccggtccgaaggaagtcgacggcaagaaggtcgaaggtttttggcgcgcgcatcaggtgccggtcgcaagctgccgcgagaaccctgcgcatctgaaggtgctcgaagactggatgcgcagctacgagccggagaaactgttcgacgcgagcggcgcgctcgtccccgagctccaggcgctggcacccgagggcaatcgccgcatgggcgccaatccgcatgccaatggcgggttgctgaagaaggagctgaagctgccggacttccgcagctttgccgtcgaagtgccgcagcccggcgccgtcacgggagaagcgacgcgcgagctcggcagatttttgcgcgacgtcattcgcctcaacgcgcaagagcgcaatttccgcatcatgggcccggacgagacggcatcaaatcggctagatgcggtgttcgagacgaccgaacgtgtctggatggagccgatcgagccttacgacgtgcatcttgcgcaggacggccgcgtgatggaggtgttgagcgagcatctctgccagggctggttggagggctatctgctcaccggacgccacggcttcttctcctgctacgaggccttcatccacatcgtggattccatgttcaaccagcacgccaaatggctgaaggtgacgcggcatctgccgtggcggcggccgatcgcctcgctcaattatctgttgacctcgcatgtctggcgccaggaccataacggcttcagtcatcaggaccccggcttcgtcgacctcgtcgccaacaagaaggccgacatcgttcgcatctacttcccgcccgatgccaacacgctgctgtggatcgccgaccattgcctgcggacgtacaaccgcatcaacgtgatcgtcgccggcaagcagccggcgccgcaatggctgtcgatgcaggacgccgccacgcattgcgatgtcggcatcggcatctggacctgggcgggcacggaagacgcgggtggcgagcccgatgtggtgatggcctgtgccggcgacgtgccgacattggagacgcttgccgccgtcgacctgctgcgcaaggcgctgccggatctgaatatccgcgtcgtcaacgtcgtcgacctgatgacgctgcagccgcaggaccagcatccgcacggcctgtccgaccgcgacttcgacagcctgttcacgcgcgacaagccggtgatcttcgcctatcacggctatccccatctgatccaccggctgacctataaccgcaccaaccatgccggcctgcatgtgcgcggcttcgccgaggaaggcaccacgacgacgccgttcgacatggtcgtgctcaacgagctcgaccgctaccacctcgcgatcgaggcgatcgaacgcgtgccgggtcttgcgaccagggccgcgcaggtgaagcagcagctccgcgacaagctgctcgagcactcacgttacgtacgcgaacacggcgaggacatgcccgagatccgcgactgggtctggccgggcaagccgggctga

SEQ ID NO: 279 - DNA, 2409 bp, Nitrobacter hamburgensis X14
atggaaatggcagcaccacataatcaggctagttccaatgatcttgatctgctcgacaggtactggcgcgccgccaattatttgtcggtcggacaaatctaccttctcgacaatccgctattgcacgaagctttgcgtcccgagcacatcaaaccacggttgctgggacactggggtacgacaccgggactcaacttcatctacgcgcacctcaatcgggcgatccgcgcgttcgatctgaacgtgatttacatctgcgggcctggccatggcgggcccggcatggtggcgaacacttacctcgaaggcacttatagcgagatctatcccaacatcagccgcgacactgacggtctgcgcaagctgtttcgtcagttttccttccctggtggcattccaagccacgccgcgccggagacgcccggctcgatccacgaaggcggcgaactcggctatgcgctgacgcatgcctatggcgcgacattcgacaacccggatctcatcgtcgcctgcgtgattggcgatggtgaggccgagaccggaccactcgccgcttcgtggcattccaacaagtttctgaacccgatacatgatggcgcggtgctgccgatcctgcatctcaatggctacaagatcgcgaacccgaccgtgctcggccggatgggcgatgaagagattcggcaactctttacaggctatggccacgcaccgctgttcgtggagggtgacgagcccacgctgttgcatcggcagatggccgatgcaacgaaacaggcgatcgagagcattcgtgcgatccagagaaccgcgcgcgatgggcgcaagacaaccgatcttccgaaatggccgatgatcgtgctccgcagtccaaagggctggacggggccgaaggaagtcgatggcctgaaggttgagggcttctggcgggcgcaccaggtcccgatcgccaatccgcggggaaatcctgagcatctgaacctgctcgagcaatggatgcgcagctatcagccggagctgctgttcgacgagaatggctgcttgcaaccggaattgcaggcactcgccccgcgcgggggccgacgcatgggcgccaatccccacgccaatggcgggctcttgaaacgcgaactcaagctgccggattttcatgactacgccgtcaaggtgccccaccccggcggtacggttgccgaagcaacacgggtgatgggacagttccttcgcgacgtcttgcgcctgaatgcggagacacgaaactttcggatcatgggcccggatgagaccgcctcaaaccgtctcgacgcggtgttcgaggcaactgaacgcgtctggatggagagcaccgagccttacgatgttcatctggctcaggatggtcgcgtcatggaggtcttgagcgaacatctctgccagggctggcttgagggatatctgctgagcggacggcatggcttcttctcatgctacgaagccttcatccacatcgtggattcgatgttcaatcagcatgccaagtggctgaaggtttcacgtgggctgccgtggcgtcgatcgattgcatcattgaattatcttctgacttcgcatgtctggcggcaggatcataatggcttcagtcaccaagaccctggctttgtcgaccttgtggtcaacaagaaggccgatatcgtgcgcgtctatttcccgccggatgccaattcactgctctggatcaccgaccactgcctgcgcacctacgatcgcatcaacgtgatcgtcgccggcaagcaaccggcacagcagtggctgaccatgcaacaaaccgccacgcattgcgacgctggcatcgggatctggagatgggccggcacagaggtcgacggcaccgaacccgatgtggtgatggcctgcgccggtgacgtgccgacactggaaacgttggctgctgtcaatctgcttcgcgaagggttgcccgacctgaaaatccgtgtcgtcaatgtcgtcgacctgatgaccttgcaaccgagggaggcgcatccgcacggtctcagcaaccgcgatttcgacggaatgttcacccacgacaagcctgtaatcttcgcctaccatggttatccgaacctgatccatcgcctgacgtacaatcgtaccaaccacgccggaatgcacgttcgcgggttcaaggaagaaggcaccacgacgacaccattcgacatggtcgttcggaacgaactcgatcgttttcatctggcgatcgaagtcatcgagcgcgtgcctggcctcagcaccgctgctgcccacctcaagcaacaatttcgcgacgcattgatcgaacatgcgctttatatttgccagcacggcgaagatatgccgcgcatccgcgactggacctggccctatggccattacgtcgccactgacactgcttga

SEQ ID NO: 280 - DNA, 2436 bp, Methylobacterium extorquens AM1
gtgaccgagccaaccaacccgcaaggacggaccgcgccatcctctgccaccctcggcggcgaggaactcgccttaatcgaccgctactggcaggcggccaactatctctcggtcggccagatctacctgctcgacaatccgttgctgcgcgagccgcttcagccgcagcacatcaaatcacggcttctcggccattggggcacgacaccgggtctgaacttcatctacgtccacctcaaccggctgatcaaagcgcgtgatctcgacgcgatctacatctgcggccccggccatggcggtcccggcatcgttgccaacacctacctcgaaggcacctacagcgaggtctatcccgacatcgcacaggatacggagggcatgcgccggctgttccggcagttctcgttccccggcggcatcccgagccacgtcgcgcccgagacccccggctcgatccacgagggcggagaactcggctacgccatcgtccacgccttcggcgcggtgttcgacaatcccgacctgatcgcggcttgcgtgattggcgacggcgaggccgagaccgggccgctcgccgcctcgtggcagtccaacaagttcctgagcccggtcaccgacggcgcggtgctgccgatcctccacctcaacggctacaagatcgcaaacccgaccgtgctcggtcggatgcgggacgacgagttggagtccctgttcaccggcttcggctacgagcccttcttcgtcgagggcgaccagcccgagcccatgcaccgggcgatggccgaagcgctcgaccgcgcggtggcgcgcatcaaggacatccaggccgaggcgcggggcggcggcatgggcttccggcgcccgcgctggccgatgatcgtgctgcgcagccccaagggctggactgggccgaagaccgtggacggcaaacgggtggagggcttctggcgcgcgcatcaggtgcccgtgggcaacgcccggaccgatgacggccaccgccagatcctcgaagactggatgcggagctatcgccccgaaaccctgttcgacgagaccggccgcctgcggcccgaactcgccgccctggcgcccgagggcaaccggcgcatgagcgccaacccccacgccaatggcggtctgctacgccgggagctgcgctgtccccggtggcaggatttcgccctcacggtgtccaagcccggcgccgaaatcggcgaggccacccgcaccctcgggcggtatttgcgcgacgtgatcaggctcaacgccgaggcgcgcaacttccgcatcatggggccggacgagaccgcctcgaaccggctcgacgcggtgttcgaggcgaccgaccgggtttggatcgagaatatcgagccctacgacgtcagcctcgcccacgagggccgggtgatggaggttctgagcgagcatctctgccagggctggctcgaaggctacctgctcaccggccgccacggcctgttctcctgctacgaggcgttcatccacatcgtcgattcgatgttcaaccagcacgccaagtggctgaaggtgtcgcgcgaactcggctggcgccggccgatctcctcgctcaactacctcctgacctcgcatgtctggcgccaggaccataacggcttcagccaccaggatcccggcttcatcgatcacgtcgccaacaagaagtcggacatcgtccgggtctacctgccgccggacgccaacaccctgctctgggtggccgaccactgcctgcagacctacgaccgcatcaacgtgattgtggccggcaagcagccgcagccgcaatggctcagcgcgcacgaggccggtctccattgcgaggcgggcatcggcatctggtcctgggccgggacggacgagaccgggctcgaacccgatgtcgtgatggcctgcgccggcgacgtgccgacgctcgaaaccctggccgccgtcgatctcctgaagcaggccgttcccggccttcgcatccgggtcgtcaacgtggtcgatctgatgaccctgcaatcgaacagggaccacccgcacgggctgacggacgccgcgttcgacagcctgttcacccgcgataagccggtgatcttcgcctatcacggctatccctatctcattcaccggctgacctattcccgggccaaccacgccaacatgcatgtgcgcggcttcatcgaggagggcaccacgacgacgccgttcgacatggtggtgctgaacgagctcgaccgtttccacctcgccatcgaagcgatcgaccgggtgccggggctggtgacgcgggcggcaggagccaagcaggcgttccgggaccgcctcacggcacacaagctctacatccgcgagtacggtgaggacatgcccgagatccagggctggaaatggccctacgagacgcgccaggaaaccggaaccccgcactga

SEQ ID NO: 281 - DNA, 2403 bp, Chelativorans sp. BNC1
atggatgttgccaaaaccgatgtcgggacaccgagcttgtcagagtttgaggcgatcgaccgttattggagagcggcaaactatatctcggtgggccagatctatctcatggacaacccgctgctccgcgagccgctcacggcggagcatgtcaagccccggcttctggggcattggggaacgacgccgggtctgaacttcgtctacgtccatctgaaccgggtcatccgtgcgcgcgacctgaacgtgatctatgtctgcggtccggggcacggcggccccgcgatggtggccaacacctatctcgaagggacatacagcgagatctatccggatgtgccccaggatgcggaaggcctgagaagactattccgccagttctcctttcctggcggggttcccagccatgctgccccggaaacaccgggctcgattcatgagggcggagaactcggctacgcgctggcgcacgcctacggcgccgctttcgacaaccccgacttgctggttgcgtgcgtggtcggcgacggcgaggcggaaaccggtcccaccgccgccgcgtggcattccaacaagttcctcaacccggcgcgagacggtgccgttctgcctgttctccacttgaacggctacaagatcgccaatcccacgatcctcggccggatggaagacgaggaactgcgcgctctcttcaccggctatggatatgagccgttcttcgtggaaggcagcgagcccgccgaaatgcacccgctgatggcgcggacgctcgacacggcgctcgaccgcatctccgccattcagcagcaggcacgcgatccggcgtggtcgggagagcgccttcgctggcccatgatcgtcctgcgcagcccgaagggctggaccgggccgaaagaggtggacggcaagaaggtcgaggacttctggcgttcgcaccaggtgccggttgccaacgcgcggggcaatgacgagcaccggcgcgtgctgcaggactggatgctgagctacaaggcgcaggaactgttcgacgagagcgggcgccttcggccggaacttgcggctctcgcgccttcgggaaacaagcgcatgggcgccaatccccatgccaatggcgggcttctgaagcgcgacctcgtcctgccggactggaaggcatacgccctcgacgtgcggcagccgggaggattgaagggcgaggccacgcgcgtgatgggcacctatctacgcgacgtgatgaagctcaacgtggataatttcaggctgatggggccggacgagacatcgtccaaccggctcgacgccgtcttcgatgttaccgatcgtgtctggatggagaggatcgagccctacgacgtgcacctgacgcgcgacggccgtgtcatggaggtgttgagcgaacatctctgtcagggctggctggagggctatctgctaaccggccggcatgggctcttctcctgctatgaagccttcatccatatcgtggattccatggtcaaccagcacgccaaatgggtgaaggtctcgcgcgagctctcctggcgcaagccgatcgcttcgctcaattacctgcttacctcccatgtctggaggcaggaccacaacggcttcagccatcaggatcccgggttcgccgatttcgtcgccaacaagaaggcggatacgatccgcctctacttcccgcccgacgcgaacaccctgctgtgggtgaccgaccactgcctcaagacctacaaccgcatcaacgtcatcacggccggcaagcagccggcgccgcaatggctgagcgccgatgaggccgagatccactgcagggcaggggcgggcgtctgggaatgggcggggacggtggctcgggacgaagaaccggatgtggtcatggcctgcgccggcgacgtgccgacgctggagacgctggcggccgtggatattctgcgcacggatttccctgacctgaagatccgcgtcgtcaatgtggtcgacctgatgacgctgcaatcggcgacagagcatccgcatggccttgacgatcagggcttcgacgccctgttcacgacggacaaaccggtgatcttcgcctatcacggctatccctatctcatccaccgcttgacctacaaacgcgccaaccacgacaacatgcatgtgcacggctttcgcgaggaaggcacgaccaccacgcccttcgatatggtcgtcatgaattcgctcgaccggttccatctcgccattgccgccgccactcgcgtgacgcggctggacgtcaaggcggacgaactggtcgcacggctcaacgacaagctcgttgagcacgccgcctatatccgccagcacggcgaggacatgcccgagatccgcgattgggggtggccctacaagacggccgccgaagccggtgactga

SEQ ID NO: 282 - DNA, 2409 bp, Mesorhizobium opportunistum WSM2075
atgaacgacaaggctggtgcaacgccgcgggcgatcggcctcgaacggatcgatctcatggaccgctactggcgtgccgcgaactacatctcggtcggccagatctacctgctcgacaatccgctgttgcgcgaacccttgaaggccgagcacgtcaagccgcggctgcttggccattggggcacgacgccgggcctgaattttctctacctgcatctgaaccgcgttatccgcgaacgcgaactcgatatcctgttcatctgcggcccgggccatggcggccccgcgatggtcgccaacacctggctcgagggcacctacagcgaaatctatcctgatatcgggcagggcgaggacggtctgaggaaactgttccggcagttttccttccccggcggcgtgccaagccacgccgcgcccgaaacgcccggctccatccatgagggcggcgaactcggatatgcgttggtccatgcctttggtgcggccttcgacaatccggatctggtggttgcctgcgtcgttggcgacggcgaagccgagaccggtccgctcgcggcgtcatggcattccaacaagttcctgaacccggcgtcggatggcgccgtcctgccgatcctgcatcttaacggctacaagatcgccaatccaacaatccttggccgcatggacgaccaggagttgcgaaaccttttcgctggctatggctacgaaccgttcttcgtcgaaggccacgagccgcttgccatgcaccaatccatggccgggacgctcgacacggtgctcgatcgcatccggtccgttcaggaacaggcccggtcgccgggatggcgtggcgggcgtccgctgtggccgatgatcgtgctgcgcagccccaagggctggaccggaccaaagaaagtcgatggcgagaaggtcgaaggcttctggcgtgcgcatcaagtgccggtgtcgaacgcgcggggaaatgaggaacaccgcaagatcctcgaaacctggatgcgaagctatgagccggagaaactgttcgacagaaacggacaccttctgccggaactcgctgcgctggctccgactggatcaaagcgcatgggcgcgagcccatatgcgaatggcgggctgttgaagcgcgaccttgtgcttccggactggaaaggcctggcgctggaagtgccccggccgggaggggtcgttgccgaagcgacgcggatttgtggaagctaccttcgcgacgtgttccgcctcaatgccaaagcgcaaaacttccggctcatgggaccggatgagacatcgtccaatcgcctcgacgatgtgttcgaggccaccgatcgggtctggatggagggcatcgagccttacgacgtccatctttcccgcgacggccgcgtcatggaagtgctgagcgagcatctctgccagggctggctcgaaggttatctgctcaccggccgtcacggactgttctcatgctacgaggccttcatccatatcgtcgattccatggtcaaccagcatgccaaatggctgaagacctccggcgaactcgcctggcgcaagccgatcgcctcgctcaactatctcttgacctctcatgtctggcgccaggaccacaatggcttcagtcatcaggatccgggttttgccgacctggtcgccaacaagaaggccgacaccgtcaggctctacttcccgccggatgccaacaccctgctgtggattaccgaccattgcctgaggacctataaccgcatcaacgtcatcacagccggcaagcagccgacgccgcagtggctgtccgtcgaggaagccgaagcccattgcaaagcgggcgcgggcatctgggaatgggccggcaccctggccaagggcgaggagccggatgtagtcatggcctgcgccggagacgtgccgacgctggaaacgctggccgcgacggacattttgcgctccgcgatccccgacctgaaaatccgcgtcgtcaacgtcgtcgacctgatgacgttgcagtcgaacaccgagcatccgcacggtctcgccgaccaggccttcgacgcgttgttcaccaaaacacggccggtcattttcgcctatcacggctatccctacatcatccatcgcctgacctatcgccgcgccaaccatgacaacatgcatgtgcacggcttccgcgaggagggcaccacgacgacgccgttcgacatggtggtgctcaacgaactcgatcgctaccacctcgcgcttgccgctatcgagcgcgtgccgggactggccgaaaggaccgaaggccttgccggcgagctccacgaccggctggtgaagcacaaggcctatgtccgcgagcatggcgaagatatgcccgaaatccagaaatggagctggcccgcgaacgcggcaaaggtccgccaatga

SEQ ID NO: 283 - DNA, 2388 bp, Nitrobacter winogradskyi Nb-255
atggcggaactggacgatacgcaactgggcttgatgaacctctactggcgcgcggctaactacgtgtcggtcgggcaaatctacctgatggataatccgctgctgcgaaagccgttgaaggcggaagacgtgaagccgcggctgctcggtcactggggtacgacgcccgggctgaatttcatctacgtgcatctgaatcgggtcatcagggagcgtggcacagacgtcctctacatctgcggtcccggtcacggcgggcctgcaatggtcgccaacacctacctggagggctcgtacagcgagatctatccggggatcacgcaggatgaagcaggcttgcagaaacttttccggcagttttcattcccgggtggtgtgcccagccacgtcgccccagagacgcccggctccatccacgagggaggagaactcggctacgcccttgtccatgccttcggcgccgctttcgacaatcccgacctcacggtcgcctgtgtcgttggggacggggaagccgagacgggtccgctggccgctgcgtggcattccaacaggtttctgaatccgcaggtcgatggcgcggtcctgccgatcctgcatcttaacggctacaagatcgccaatcccgccctgttggcgcgcatgtctgaagccgaactcagcgatctcttcaggggctacggctatgagccgctctttgtcgaggggcacgagccgatcccaatgcaccgcaccatggctgagtccctggacctggccatggatcgtattcgtgacatccagcgagaggcgcggaaggagggctggtcgggcgagcgcccgcgttggccgatgatcatcttgcgcagcccgaaaggatggacaggaccgaaggaggtcgacgggaagaaggtggaggacttctggcgctcgcatcaggtcccggtttccaacgcccgcggtgatgccacacaccgcaagatcctcgaggagtggctgcgtagctatcggccgcaggagctgttcgacgggaagggtcgcttcctgccggagatcgccgccctagcgcccgaaggtgcgaaacgcatgggcgcgctgccgcatgccaatggcggtctgctgaagaaggaccttatcctgccggactggaagagcctcgcgctcgacatcgggcaaccgggagaaacgatcgccgaggctacccgcttgatgggagcttatctgcgtgaggtcatccgccttaatgccgaggcaaggaatttccgcctcatgggtccggacgagaccgcctcgaacaggctcgacgccgtcttcgaggtgacgaaccgcgtctggatggagaagattgaatcctatgatgtgcacctcgcgtgcgagggccgggtaatggaggttctgtcagagcatctttgccaagggtggctggagggttacctgctgactggacgacatggcgtgttctcctgctacgaggccttcatccacatcgtggattctatggtcaatcagcatgccaagtggctgaaggtctcggccgaactgccatggcgcaagccaatcgcctcactcaactatctcctgacctcccacgtctggaggcaggaccacaacggcttcagccaccaggatccgggcttcgccgacttcgtcgccaacaagaaggccgacatcgtccgcctttattttccgccggatgccaacacgctgctctgggtcacggaccactgcctgagaacatggaatcgcatcaacgtgatcacggccggcaagcagcctcagccgcagtggctcacagccgagcaggcggaacgccattgcgaggcgggcgccgggatttgggaatgggcgtgcacatgcccggctgacgaggagcctgacgtggtgatggcctgctgcggcgacgtgccgacactggaaattctcgccgccgtcggcctgctgcgccgcgagttgcctgatcttcgtattagggtggtcaatgtcgtcgacctgatgacgctgcaatctcacacgacccatccgcacgggttcaccgacgatgaattcgacgctctcttcacgaaggagaagcccgtgatctttgcctaccacggctatccctacctcattcaccgcctgacctataagcgaaccaaccacgccaatttccatgtccatggtttccaggaagaaggtacgaccaccacgccattcgatatggcggtcatgaacgaactcgaccgcttccatctggtcatagccgccgtcaggcggctgccgaatcttggcatgggcggcgaacgagtgatcggacggtgcgagcaagcgctggccgagcatgcctcgtatgcccggcaatatggtgaagacatgcctgaaatccgggaatggagctggccctacaagactgccgccgaggcgggagactga

SEQ ID NO: 284 - DNA, 2583 bp, Methylobacterium radiotolerans JCM 2831
atggtcggcgtcaggtttagcagctaccgggaggccgacttggacgcgacgcacggggcaaaggagcgccaccaaggcggccatcgggacgaggcacaaggcctggcattcgtgcccgggccgctcggacccgggaaccttcggcggatcgatgcctactggcgagcggccaactacctgtcggtcgggcagatctacctcatggccaacccgcttctgcgcgagccgctgaagcccgagcacgtcaagccgcggctcctcgggcactggggcacgacacccggcctcaacttcatctacgcgcacctgaaccgggccatccgccaacgtgacctcgacatgatcgcggtctgggggccgggtcacggcgcgcccgggctcgtcgccaacgcctacctggagggcacctatagcgagatctacccgaacgtggcgcaggacctcgacgggatggcccggctgttccggcagttctcctttcccgggggcatcccgagccacgcctcgccggaactgccgggctccatccacgagggcggcgagctcggctattccctggcccatgctttcggcgccgccctggacaaccccggcctgatcgtcgcttgcgtggtcggcgacggcgaggcggagaccgggccgctcgccgcgtcatggcactccaacaagttcctgaacccgacgaccgacggcgccgtcctgccgatcctgcacctaaacggctataagatcgccaacccgacgctcctcgcccggatgcccacggacgagcttcgcagcctcctcgtcgggtacggctacgagccgtccttcgtcgagggcgacgaaccggccgccatgcaccaagccatggcgacggccctcgacgcggtcctcgacgagatcgcagccatccggcactccgcgcgctgcggcgagctccgtcgaccgcgctggccgatgatcgtgctgcgcagccccaagggctggacgggaccgaaggacgttgacggcaagccggtcgagggaacctggcgttcgcatcaggttcctgtcgcggccacgcgggaaaacccggagcaccgcgcgatcctggaagcctggatgcgctcctacaggccggaggagctgttcgcggaaggcggctcgctcgtccccgagctcgccgcgctggctcccaagggaccgcggcgcctctcagccaatccgcatgccaacgctcatgggacacgccccctccgcctgccggatctgcggcagctggctgtcgcggtctcggaaccgggacgttcccagggcgaagctacccgcgcgctcggaaggtacctgcgcgaggtcctgaccctgaacgcggacagccgaaactttcgcctcatggggcccgacgagaccgcctcgaaccggctggacgcggcgttcgaggtgacgggccgcgcctggcaggaagagatcctgccgggcgatgaccacctcgcccgagacgggctggtcatggaggtgctgagcgagcatctctgcgagggctggctcgaaggttacgtgctcaccggccgccatggactgttcgcgacctacgaggccttcgcgcacgtggttgactcgatggtgaaccagcacgccaagtggctgaagtcctcccgcgacttgccctggcgccggccggtgccgtccctcaacatcctgctctcgtcgcatgtctggcggcaggaccacaacggcttcagccaccaagacccgggcttcatcgacttcgtggcgaacaagcgcggggacacggcgcggatttacctgccgccggacgcgaactgcctgctctgcgtcaccgaccactgcctgcgcacctacgaccgcatcaacgtcgtcgtggccggcaagcagcccgcgccgcagtggctcagcctggacgaggcagtcacgcactgcgctgccggcgtcggagtctgggagtgggcctcgaacgagggggaagcggagcccgacgtcgtgatggcctgcgcgggcgacgtgccgacgcaggagacgctcgccgccgtggactggctgcgccggcacgtcccggagatgcgggtccgggtggtgaacgtcgtcgacctgatgacgctgccggcgcccgagacgcacccgcacgggctcgatgacccgacgttcgacagcctcttcacgcgcgaccggccggtagtgttcgcctaccacggctatccatggctgatccacaggctgacctacaagcggaccaaccacgggaacttccacgtgcacgggttcatcgaggagggcacgacgacgacgcccttcgatatgtgcgtgctgaaccggctcgaccggttccacctcgcgcaggccgcgatccgggccgtcccgcgactgggcgcccgggcagagcacgccgaggaggcgctccgggatgcgctggccgcccatcgcgagcacgtccgccggaccggcgacgacctgccggaggtacgggattggacctggtcgggacggcacgcccccggggaccacgaccgccggatcgagggcgacatcatgcagtgcggcccgaccgacgcggacgggcccggccggtcggggaccgtggacggttgtacggttgtcacctga

SEQ ID NO: 285 - DNA, 2556 bp, Methylobacterium radiotolerans JCM 2831
atggacgcgaggcgcgagccgacgaagacccgccaggaacgccgcgatggcggccgtgcggacgacggtcacgacctaaccttcgtgccggggccactcggacccgacagcctgcagcggatccacgcctactggcgggccgcgaactacctgtcggtcggccagatctacctcatggccaacccgctcttgcgagagccgctgaagcccgagcacgtcaaaccaaggctcctcggccactggggaacgacgccgggcctcaacttcatctacgcgcacttgaaccggatcatacggcagcgcgccctcaacatgatcgcggtttggggaccgggtcacggcgcgccggggctcgtcgccaacgcctacctggagggcacctacagcgagatctaccccgacgttgcgcgggacgcggaagggatggagcgtctgttcaggcagttctcgtttcccgggggcatcccgagtcacgcctcgccggagctgcccggctccatccacgagggcggcgagctcggctattccctagcccatgcgttcggcgcagccctggacaaccccggcctgattgtcgcctgcgtggtcggcgacggcgaggcggagacggggccactcgccgcgtcctggcactccaacaagttcctgaatccgaccaccgacggagccgtactgccgatcctgcacctcaacggctacaagatcgccaacccgacgctcctcgcccggatgcccgctgacgagcttcgcagcctcctcgtcgggtacggctacgagccgaccttcgtcgagggcgacgaaccggccgccatgcaccaggccatggcggcggccctcgacgcggtcctcgacgagatcgcagccatccggcactccgcgcgctgcggcaaggtccggctaccgcgctgtccgatgattgtgctgcgcagccccaaaggttggactggaccgaaggccgtcgatggcaagccggtcgagggaacctggcgctcgcatcaggttcccgtcgcggctacgcgggagaacccggagcaccgcgcgatcctggaagactggatgcgctcctaccggccggaggagctgttcgcggaggacggctcgctcgtaccggaactcgccgtcttggcaccgaaggggccgcggcgcatctcggccaacccgcacgccaacgcgcacaagagcgcgtccttgcggctgccggacctgcgggactgcgccgtccccgtgccgggacccggccgctcccgagccgaggccacccgcacgctcggcggctacctgcgggaggtcctgtccctgaacaaggacgcccgcaacttccggatcatgggtcccgatgagaccgtctcaaaccggctggacgcggtgttcgacgtgacgggccgcgcctggcaggaggcgatgttgccgggcgacgatcaccttctgcgcgacggccgggtcatggaggtgctgagcgagcacctctgcgagggctggctcgaaggctacgtgctcaccggacgccacggcctgttcgcgacctacgaggccttcgcgcacgtcgtcgattcgatggtgaatcagcacgccaagtggctgaagtcctcgcgcgacctgccctggcgccggccggtgccgtccctgaacatcctgctctcgtcccacgtctggcggcaggaccacaacggcttcagccaccaggacccgggctttatcgacttcgtggcgaacaagcgcggtgacacggcgcggatctacctgccgccggacgccaatacccttctgtgcgtcacggaccactgcctccggacctatgaccgcatcaacgtcgtcgtggccggcaagcaacccgccttccagtggctgaccctggacgaggccgtcacacactgtgcggccggcgtcggcatctgggaatgggcctcgaacgagggcgagacggagcccgacttggtgatggcctgcgccggggacgtgccgacgcaggagaccctcgccgcggtggactggctccgtcgacacgttcctgaactgcgcatccgggtggtgaacgtcgtcgacctgatgacgctgccggcgcccgagacgcatccgcacggcctcgacgatccgaccttcgacagcctgttcacccgggaccgtccggtggtgttcgcgtatcatggctatccgtggctcatccaccgactgacctacaagcggacgaaccacggcaacttccacgtccacggcttcatcgaggagggcacgacgacgacgcccttcgacatgtgcgtgctgaaccggctcgaccggttccacctcgcgcaggccgcgctgcgcgccgcgccgcggctgggcgcccggggtgagcacgccgaggaggcgctccgagacgcgctggccgcgcaccgcgcatatgtccgtcagaccggcgacgatctgcctgaggtgcgggattggacctggccggaacggcacgcccccggggatcacgaccgccggatcgagggcgacatcatgcagtgcggcccgaccgacacggccaagcctgggcaggcggggacggtggacgggtgggcggtcgtaaattga

SEQ ID NO: 286 - DNA, 2586 bp, Methylobacterium extorquens DM4
atggacgcgaggcgtgacgcgaggaaccaccgcgaggaccgatacgacggtggccaccgggatgacgggcatggccttgccttcgtacccgggccgctcggaccggacagcctcaagcgcatcgacgcctactggcgggccgcgaactacctctcagtcggccagatctacctgatggccaacccgctgctgcgcgagccgctgaggcccgagcacgtcaagccgcggctcctcggccactgggggacaacaccggggctcaacttcatctacgcgcacctcaatcgcgtcatccgcgagcgcgacctcgacatgatcgcggtctggggaccaggccacggcgcgccagggctcgtcgccaacgcctatctggaaggtacctacagcgagatctacccggatgtagcgctggacatcgacggcatggcccggctgttccggcagttctcgttcccgggcggcatcccgagccacgcctcgcccgagttgcccggctcgatccacgaaggtggcgagctcggctactccctggcgcacgcattcggttcggccctcgacaatcccggcctgactgtcgcctgcatcgtgggggacggcgaagccgagaccgggcctctcgcagcctcctggcactcgaacaagtttctgaacccgaggtctgacggcactgtcctgccgatcctgcacctcaacggatacaagatcgcgaacccgacactcctcgcccgcatgcccgaggacgagctgcgcagccttctcgtcggctacggttacgagccgacctttgtcgagggtgacgagcctgcccccatgcatcaggccatggcggcggcgctcgacgcagccttcgacgccatcgcggagatccgcgcgagcgcgcggcgcggcgagacaggccggccgcgctggcccatgatcgtgctgcgcagcccgaaaggctggacgggtccggagagcgtggacggcaagcccatcgagggcacctggcgctcgcaccaagtgccggttgccgcagtgagagaggacccggaacaccgcgccatcctcgaagcctggatgcgctcctaccgtccggaggagctgttcgcggaggatggctcgctcgtaccggaccttacggcgctatcgccgaaggggccgcggcgcatctcggcgaacccgcacgccaacgcgcacaagagtgcccccttgcgcctgccggacctccggcgcctagccgttgcggtgccggaacacggccgcaccacggctgaggccactcgcgcgctgggcgcctacctgcgggacgtcatgaccctcaacgcagaggcccgcaactttcgcatcatgggccccgacgagaccgcctcgaaccggctggacgcggtcttcgaggtgacgaaccggacctggcaggaggagatcctgcccggcgacgaccatctcgcgcgcgacggccgcgtcatggaggtgctcagcgagcacctctgcgagggctggctggagggctacgtcctcaccggccgccacggcctgttcgcgacctatgaggccttcgttcacgtggtcgactcgatggtgaaccagcacgccaagtggctgaagtcctcgcgcgacctgccctggcgccggccggtgccttctctcaacatcctgctgtcgtcccacgtctggcgccaggaccacaacggcttcagccaccaagacccgggcttcatcgacttcgtggcgaacaagcgcggcgacacggcccgcatctacctcccgccggacgcgaacacccttctctgcgttacggaccactgcctacggacctacgaccgcatcaacgtggtcgtggccggcaagcagcctgcgctgcagtggctgagcctggacgaggccgcgcggcactgcgcggccggggcaggtatctgggagtgggcctcgaacgagggtgacgcggagccggacgtagtcttggcctgcgccggcgacgtgccgacccaggagacgttggccgccgtcgactggctgcgccaccacgtcccggagctgcgggtcagagtggtcaatgtcgtcgacctgatgacgctgcccgggcgcgagacgcacccgcacgggctcgatgacccgactttcgacagcctgttcacgcgcgaccggccggtggtgtttgcctaccacggctatccgtggctcatccatcggctgacctacaagcgcacgaaccatgcgaacttccacgtgcacggcttcgtcgaggagggcacgacgaccacgccgttcgacatgtgcgtgctgaaccggctcgaccgctaccatctcgcgcaggccgccctacggtccgcgccgcgactgggagcccggggggagcacgccgaggaggcgctcagggacgccctggcccgccatcgcgagcacgtctgccggactggcgacgatctgccggtggtgcgggactggacatggccagagaggcttgctcggtcccccgcccctgggacccgaccagatgacgggcgcgtgcttctcgccacgacggttgctgacgaggtcatgctggacgagtacgagcagggtggccgaggcgagagcgcggagttggggccgagatcggcgtcctga

SEQ ID NO: 287 - DNA, 2547 bp, Methylobacterium extorquens AM1
atggacgcaacacacggttcgagggagcaccacgacggcgaatgtcgagacgacggcgacggcttggcgttcgtacccgggccgatcgggcctgacggcctccggcagatcgacgcctactggcgcgccgcgaactacctgtcggtcggccagatctacttgatggccaacccgctcctgcgcgagccgctcaagcccgagcatgtgaagccgcggctgctcgggcactggggtacgacaccgggcctgaacttcatctacgcgcacctcaatcgcgtcatccgcgagcgcgacctcgacatgatcgcggtctgggggcccggccacggggcgccggggctcgtggccaacgcctacctggagggcacctacgccgagacctacccggacgtggcgcacgacctcgacgggatggcccggctgttccggcagttctcgttccccggcggcatcccgagccatgcctcgcccgagttgcccggctcgatccacgagggcggagagctcggctattccctggcgcatgccttcggcgcagccctcgacaatcccggtctgacggtcgcctgcgtggtcggcgacggcgaggccgaaaccggcccgctggcggccgcctggcacggaaacaagttcctcgacccgcggtccgacgggacggtcctgccgatcctgcatctcaacggttacaagatcgcaaacccgaccgtcctcgcccgcataccccgcgaggagttgcgcagcctgctcgtcggctacggctacgagccgaccttcgtggaaggcgacgagccggccatcatgcaccaagccatggcggcggcgcttgacgcagccttcgacgccatcacagagatccggatacgggcgagacgcggcgaagctgggcgaccgcgttggcctttggtcgtgctgcgcagcccgaagggctggactgggccggggagcgtcgatggcaagccggtcgagggcacctggcgctcgcaccaggtgccggtcgccgccgtgcgcgagaacccggagcaccgtgcgatcctggagcgctggatgcgctcctaccggccggaggagttgtttacgccggacggctcgctcgtccccgacctcgccgcgctgccgccgcgggggccgcggcgcctgtcagccaacccgcacgccaacgcgcacaggggcgcacccttgcggctcccggagctccggcgtctcgccgtcaccgtgccggagcgcggtcgtaccaaggccgaggccacgcgcgcgctcggggtctacctgcgggacgtcctgaccctgaacgcggaggctcgaaacttccgcatcatgggtcccgacgagaccgcctcgaaccgcctcgacgccgtcttcgaggtgacgagccgcgcctggcaggaagagatcctgcccgaggacgaccatctcgggcgcgacggtcgcgtcatggaggtgctgagcgagcacctctgcgagggctggctggagggctacgtgctgaccggacggcacggcctgttcgcgacctacgaggcctttgcgcatgtgatcgactcgatggtgaaccagcacgccaagtggctgaagtccgcgcgcgacctgccctggcgccggccggtgccctcgctcaacatcctgctctcgtcccatgtctggcgccaggaccacaacggcttcagccaccaggatccgggcttcatcgacttcgtggcgaacaagcgcggcgacacggcgcggatctacctgccgccggacgcgaactgcctgctctgcgtcatggatcactgcctacgcacctacgaccgcatcaacgtcgtggtggccggcaagcagcccgcgctgcaatggctcgacatggacgcggcggcccggcattgcgcggccggtgtcgggatctgggactgggcctcgaacgagggcgaggcggagccggacgtggtgatggcctgcgcgggcgacgtgcccacccaggagacgctcgcggccgtggattggctgcgccggtacgtcccggagctcaaggttcgggtcgtcaacgtcgtcgacctgatgaccctgccggcgcgcgagacgcacccgcacgggctcgatgacccgacattcgacagcctgttcacacgcgaccggccggtgatgttcgcctatcacggctatccctggctcatccatcggatgacctacaagcggacgaaccacggcaacttccacgtgcacggcttcatcgaggagggcacaacgaccacgccgttcgacatgtgcgtgctgaaccgcctcgaccgctaccacctggctcaggccgccctgcgggccgtcccggggctgggagcccggggcgagcacgccgaggaggcgctccgcgatgcgctggccgcccaccgcgtgcacgtctgccgggccggggatgatctaccggaggtcaaggactggtcctggccggatcggcatggcgacgaacatccggaccgccgccgcatcgaggccgacatcatgcagtgcgacacagccggtgccgaggagccgcgaccggccaggaccgccgacgatcgggcgtgcaacgcctga

SEQ ID NO: 288 - DNA, 2499 bp, Methylobacterium nodulans ORS 2060
atgacagtcctgacaggctcgtctcggaacgatgcgcgcgctgcgcggcaggatgcgggcgacggcttcgtgccgggtccgctcggcccccaggagctggcgggcctcgacgcgtattggcgggccgcgaactacctgtcggtcggtcagatctaccttctcgacaacccgctcctgcgcgagccgctcgcccccgcgcatgtcaagccgcggctgctcggccattggggcaccacgcccggcctcaacttcatctacgcccatctgaaccgggtgatccggcggcgcgacctcgacatgatcgcggtctgggggccgggccacggggcgccggggcttgtcgccaacgcctatctcgaaggaacctacagcgaggtctaccccgacgtcgcgccggacgcggagggaatgcgccggctcttccgccagttctcgttcccgggcgggattccgagccacgcctcgcccgaactgcccggctcgatccacgagggcggagagctcggctactcgctcgcccatgccttcggggccgccctggacaatccggacctgatcgtcgcctgcgtggtgggcgatggcgaggccgagacgggggcgctcgccgcctcctggcactcggcgaagttcctcgacccgcggacggacggcaccgtcctgcccatcctccatctcaacggctacaagatcgccaatccgacgatcctggcgcgcatgcccgaggcggagctgatgagcctgcttaccggctacggctacgatccaatcgtcgtcgccggcgaagagccggcgccgatgcatcaggcgatggcggcggcgctcgaccgcgcgctcgaccgcatcgcgcaaatccggcgcgaggccggctgcgagcggccgcgctggcccatgatcgtgctgcgcagcccgaaaggctggaccggcccgaaggtcgtcggcggcctgcccgtcgaggggacgtggcgctcgcatcaggttccggtggccgccacgcgcgagaacccggagcacttggcgatcctcgagcgctggatgcgctcctaccgtcccgagaccctgttcgacgccgcgggacgccttgtgccggacctggccgccctggccccggcgggcgagcggcggctctccgccaacccgcaggcgaatggcgggcgccacgcccagccgctccgccggccccccatcgcggaccatgcggtgagcgtcgaggcgcccggggccgccacggccgaggcgacgcgggtgctcggcgcctatctgcgcgatgtcgtcaccctcaacaccgcgagccggaacttccggatcatggggccggacgaaaccgcctcgaaccgcctcgacgccgtcctgtccgtgacgaaccgggtctggcaggaggagatcctgccgggcgacgaccatctgggccgcaccggccgggtgatggaggtgctgagtgaacagctctgcgagggctggctcgaaggctacctgctgaccggccgccacggcctgttcgcgagctacgaggccttcatccacgtggtcgactcgatggtgagccagcacgccaagtggctcaaatcctcccgcgcgctgccctggcgccggccggtcccgtcgctaaacctgctgctgtcctcccatgtctggcgccaggaccacaacggcttcagccaccaggatcccggcttcatcgacttcatcgccaacaagcgcggcgacgtcgcgcgggtctacctgccgccggacgccaattgcctgctgtgggtgatggaccactgcctgggcacgcatgaccgcatcaacgtggtcgtggccggcaagcagcccgcgccccagtggcttgctcccgacgcggcggcgcgccactgcgcggcggggatcggcgtgtgggacttcgcctcgaacgagggggagggcgagcccgacgtggtgatggcctgcgcgggcgacgtgcccacgatggagaccctggcggcggtggactggctgcgccgggcggtgcccgacctgcggatgcgcgtcgtcaacgtcgttgacctgatgacgctgccctcgccagacatgcacccgcacgggatcgaggacgcggccttcgacgggctgttcacgaaggaccggccggtgatcttcgcctatcacggttatccctggctgatccatcggctgacctaccggcgcaccaaccacgccaacttccacgtccacggctttcaggaggagggcacgaccacaacgcccttcgatatggcagtgatgaaccgcctcgaccgccatcacctggcgatcgccgccctgcgccgcgtaccgcgcctcggtgcacgggcggaccgggccgtgcacgcgctggaggagcggctcgcggtccatcgcgcgcatgtctgtcggaccggcgaggacctgccggagatccgggattggcgctggccgcagccgggcatggcaaagccggaggagtcgggcgcccgcatccaggagccggaccgggaggcgctcaaagccggcggcagttcttga

SEQ ID NO: 289 - DNA, 2502 bp, Methylobacterium nodulans ORS 2060
atgacagtcctgacaggatcgcctcggaacgatgcgcaccccgcgcagccggatgcgcgcgacgacttcgtgccgggtccgctcggcccccaggagctggtgggcctcgatgcctattggcgggccgcgaactacctgtcggtcggtcagatctaccttctcgacaacccgctcctgcgcgagccgctcgcccccgcgcatgtcaagccgcggctgctcggccattggggcaccacgcccggcctcaacttcatctacgcccacctgaaccgggtgatccggcggcgcgacctcgacatgatcgcggtctgggggccgggccacggggcgccggggcttgtcgccaacgcctatctcgaaggaacctacagcgaggtctaccccgacgtcgcgccggacgcggagggaatgcgccggctcttccgccagttctcgttcccgggcgggattccgagccacgcctcgcccgaactgcccggctcgatccacgagggcggagagctcggctactcgctcgcccatgccttcggggccgccctggacaatccggacctgatcgtcgcctgcgtggtgggcgacggcgaggccgagacgggggcgctcgccgcctcctggcactcggcgaagttcctcgacccgcggacggacggcactgtcctgccgatcctccatctcaacggctacaagatcgccaatccgacgatcctggcacgcatgcccggggctgagctgacgagcctgctcgtcggctacggctacgatccaatcgtcgtcgccggcgaggagacggcgccgatgcatcaggcgatggcggcggcgctcgaccgcgcgctcgaccgcatcgcgcaaatccggcgcgaggccggctgcgagcggccgcgctggcccatgatcgtgctgcgcagcccgaaaggctggaccggcccgaaggtcgtcggcggcctgcccgtcgaggggacgtggcgctcgcatcaggttccagtggccgccatgcgcgacaacccggagcacctggcgatcctcgagcgctggatgcgctcctaccatcccgagaccctgttcgacgccgcgggacgtcttatgccggacctggccgccctggcgccggcgggcgagcggcggctctccgccaacccgcaggcgaatggcgggcgccacgcccagccgctccgccggccccccatcgccgctcacgcggtcgcggtcgaggcgcccggggccgccacggccgaggcgacgcgggtgctcggcgcctatctgcgcgatgtcgtcaccctcaacgccgcgagccggaacttccggatcatgggtcccgacgagaccgcctcgaaccgcctcgacgccgttctgtccgtgacgaaccgggtctggcaggaggagatcctgccgggcgacgaccatctcgcccggtccgggcgggtcatggagatcttgagcgagcagctctgcgagggctggctcgaaggctacctgctgaccggccgccacggcctgttcgcgagctacgaggccttcatccacgtggtcgactcgatggtgagccagcacgccaagtggctcaaatcctcccgcgcgctgccctggcgccggccggtcccgtcgctgaacctcctgctgtcctcccatgtctggcgccaggaccacaacggattcagccatcaggatcccggcttcatcgacttcatcgccaacaagcgcggcgacacggctcgggtctacctgccgccggacgccaattgcctgctgtgggtgatgaatcactgcctgggcacgcatgaccgcatcaacgtggtcgtggccggcaagcagcccgcgccccaatggctcgctctcgacgcagctttgcgccattgcgaggcgggcatcggcgtctgggactgggcctcgtccgaaggggagggcgagcccgacgtggtgatggcctgcgcgggcgacgtgcccacgatggagaccctggcagcggtggactggctgcgccgggtcgttcccgatctacgggtgcgggtggtgaacgtcgtcgacctgatgacgctgccctcgcccgacctccacccgcacgggctcgacgatgcgaccttcgacggcctgttcacgcgggaccgcccggtggtgttcgcctatcacggttatccctggctgatccatcggctgacctaccggcgcaccaaccacgcgaacctgcatgtgcacggtttcatggaggagggcacgacgacgacgcccttcgacatggctgtgatgaaccgtctcgaccgtcaccatctcgcgatcgcagccttgcgtcgggtgccgcgcctcggcgcccgggcggaccgcgccgagcgcatgctgcaggagcggctcgccgtccatcgcgcgcatgtctgtcggaccggcgaggacctgccggagatccgggactggcgctggccgcagccgggcatggtgaagccggacgaggcgggcgcccgcgcaaccatggggcggaccggggggagcacgaagccggctggcagtccatga

SEQ ID NO: 290 - DNA, 2499 bp, Methylobacterium sp. 4-46
atgacgggaacggcgggaacgacgcgggcgacggcttcggtgcggggcagggacgggtccgtgcccgggcccctcgccccgcacgacctcgccggcctcgacgcctactggagggcggcgaactacctctcggtcgggcagatctacctgatggagaacccgctgctgcgcgagccgctgacgcccgcgcaggtgaagccgcggctcctcggccactggggcaccacgccggggctgaacttcatctacgcccacctgaaccgggtgatccgcgcgcgcgacctcgacatgatcgcggtctggggcccgggccacggcgcgccggggctggtggccaacgcctacctggagggcacctacagcgagatctacccggacgtcgcccaggacgaggccgggatggcccgcctgttccggcaattctccttcccgggcgggatcccgagccacgcctcgccggagctgcccggctcgatccacgagggcggcgagctcggctactccctcgtccacgccttcggggccgccctcgacaatcccgacctgatcgtcgcctgcgtggtgggcgacggcgaggccgagaccggggcgctcgccgcctcctggcactcggcgaagttcctcgacccgcgccacgacggcaccgtcctgccgatcctccacctcaacggctacaagatcgccaacccgaccatcctcgcccgcatgcccgaggcggagctgaggagcctcctcgtcggctacggctacgacccgatcatggtggcgggcgacgagcccgccccgatgcaccaggccatggcggcggccctcgacgacgccctcgaccgcatcgcgcggatccggcacgaggccgcggcggagcgcccgcgctggcccatgatcgtgctgaggagcccgaagggctggaccggcccggcgcaggtcgacggcaagcccgtggaggggacctggcgcgcccaccaagtcccggtggcggcgatccgcgacaaccccgagcacctcgcgatcctcgacgcgtggctgcgctcctacgcgccggagacgctgttcgacgcggccgggcgcctgcggcccgacctcgccgccctggcgccgcgcggcgagcggcggctctcggccaacccgcaggccaatggcgggcgccaccccaagcccctgcgccggccgcccctcgcgcagcacgcgatcccagtcccggcgccgggcgccacggaggcggaggcgacgcgggtgctcggcggctacttgcgcgacctcctctccctcaacgccgaggcccgcaacctgcgcatcatggggccggacgagaccgcctcgaaccgcctcgacgcggtgttcggggtgacggaccgcgcctggcaggagcggatcctgcccggcgacgagcatctcggccgcttcgggcgggtgatggaggtgctgagcgagcagctctgcgagggctggctcgaaggctacctgctcaccggccgccacggcctgttcgcgagctacgaggccttcatccacgtcgtcgactcgatggtgaaccagcacgccaagtggctgaaatcggcccgggcgctgccctggcggcggccggtgccgtcgctcaacctgctgctctcgtcccacgtctggcgccaggaccacaacggattcagccaccaggacccgggcttcatcgacttcatcgccaacaagcggggcgacaccgcgcgggtctacctgccgccggacgccaacaccctgctgtgggtggcggatcactgtctgggcacgcacgaccgcatcaacgtcatcgtggccggcaagcagccggcgccgcaatggttctcccccgaggcggcggcgcgccactgcgaggccgggctcggcgtcctcgacttcgcctcgacggaggggcagggggagccggacgtggtgatggcctgcgccggggacgtgcccacgatggagacgctcgcggcggtggacgcgctccgccgcgcggtgcccgacctcgccatccgcgtcgtcaacgtcgtcgacctgatgaccctggcctcgcccgacgcgcacgagcacggcatcgacgacgcggccttcgacgggatcttcacccgggaccggccggtgatcttcgcctatcacggctatccctggctgatccaccggctcacctacaagcggacgaaccacgcgaacttccacgtccacggcttcatcgaggaggggacgacgacgacccccttcgacatggcggtgatgaaccgcctcgaccgccaccacctcgccatcgcggccctgcgccgcgtcccgcgcctcggcgcccgggcgggccgggtcgagcgcgccctgcgggagcggctcgccatccaccgcgagcacgtctgccggaccggggaggatctgcccgagatccgcgactggcgctggggggagggggaatggccgccggccgcctccgcggatccgtcccgcgaggaggatgcggatccgcgcgacctcgaggcgggctggcaattcatgagctga

SEQ ID NO: 291 - DNA, 2499 bp, Methylobacterium sp. 4-46; identical to SEQ ID NO: 290

SEQ ID NO: 292 - DNA, 2337 bp, Oceanicola granulosus HTCC2516
atgagcgacgacctcacgcaagtggacgcctggtggcgcgcggccaactacctctcggcggcgcagatctacctgctcgacaacccgctgctccaggagccgctgcgcgcggatcacatcaagccccggctcctcggtcactggggcacctcgccggggctcaacttcgtctatgcccacctgaaccgcgcgatccgcgcccgcgacctcgacatgatcttcatcgccggccccggtcacggcgggccggccgtcctcgccaacgcctggctcgagggcacctatggcgaggtctaccccgaggccggccatggcgcggaggaaatccgccgcttcgtcaagcagttctccttccccggtggcgtgccgagccatgccgcgcccgagacgccgggctcgatccacgagggcggcgaactcggctacagcctgatgcacgcgcacggggccgccttcgacaatcccgacctgcacgtcgcctgcgtgatcggcgacggcgaggccgaagcggggccgctcgcggcgagctggccgtcgatccgcttcgtcgatgccgcccgcgacggcgcggtgctgccgatcctgcacctcaacggctaccgcatcgccgggccgacggtgatgggccggatggacgacgcggcgctcgacgcgctgtttcgcggccacggctacgcgccgctcttcgtctgcggcgacgagccggcgcggatgcaccgcgacatggccgccgcgctcgacgccgccttcgactccatcgcggccatccagcgcgccgcccgcgacggcaccgcgacgccggccgagacgccgcgctggccgctgatcgtgctgcgcagccccaagggctggaccgggccggagcgcgtcgacggcgcgccggtcgagggcacccaccgcgcccaccagatcccgctgcccggcgtgaaggacgaccccgaccacctgcgccagctcgaggcgtggctgaagagctaccgccccgacgagctgttccgcgacggcgcccccgccgaggccctgcgcgccatcgctcccgagggcgtccgccggatgagcgccaacccggccgccaacggcggccgcctgctgcgcccgctcgacctgcccgccctcgcgcccgccgaggtcgaggtccctgcccccggcgcggtgcaggccagcgccaacaaggcgctcggcgcctggctgcgcgaggtgatgcgcgccaacccggacaacttccgcctgttcggccccgacgagaccgagagcaacaagctcgacgccgtcttcgacgtcaccgggcgcaaggcgacgggggaggtgcgcgacgacgatgccgacctcgcgcccgacgggcgggtgatggaggtgctgtccgagcacctctgccagggctggctcgagggctacctgctgaccggccggcacgggctcttcaacagctacgaggccttcgtccacatcgccgcctcgatgttcaaccagcacgccaagtggctgcgggtgagcgggggcctcgcgtggcgcgcgccggtggcctcgctgaactacctgctgacctcccatgtctggcggcaggaccacaacggcttcagtcaccaggatcccggcttcctcgatcacgtcgcctccaagggcgcggaggtcgtgcgcatctacctgccgcccgacgccaactgcctgctgcaggtggcgcgggcctgcctcgagagccgcgaccgggtcaacgtcatcgtctcgggcaagcacgaggagagccagtggctgtcgcccgaggcggcgcgggcgcattgcgaggccggcctcggcgcctgggactgggcttccgacgaagtaccgcccgacgtggtcatggcctgcgcgggcgacgtgccgacgcaggagacgctcgccgccgtcgcgctgctgcgcgagcacctgcccgacctggcgctgcgggtggtcaacgtggtcgacctcatggcgctgcagcccccgccgcgcaacgccgacgggctggacgatgccgggttcgacgcgctcttcaccaccgacaagccggtgatcttcgccttccacggctatcccggcctgatccacgagctcacctaccgccgccgcaaccatcacaactttcacgttcacggctacagcgagagcggcacgaccacgacgccggcggacatggcggtgcgcaacgcgctcgaccgcttccacctcgtcctcgccgccctgcgccgcagcggccgtgacgacccggcggccgaggcgctggccgcccattgccgcgaccggctcgaggcccaccatgaccacgtgcgcgccaccggcaccgacctgcccgagatccgcgactggcgctggccgggctga

SEQ ID NO: 293 - DNA, 2382 bp, Nodularia spumigena CCY9414
atgactttagtaagtaccccacaaacaaagcctttagcagatgaagaactgcataaaataaacgcttactggcgtgcggctaactatctttcagttgggcaaatatatctattcgacaatcccctgctacgagaacctttaaaaaaggaacacgtcaaaccccgacttttgggacattggggaacaacaccggggctgaactttatttatgttcatctcaaccgagtcattaaaaagtatgacctcaacacaatatacattgctggccccggtcatggcggccccggactggtagccaatacctacctagaaggaacttacagcgaatactatcccaacatttcccaggatactgagggaatgaaaaaactcttcaaacagttttcttttcctggtggtattccgagccatgtagcaccagaaacccctggttcaattcatgaaggtggtgaactgggttatgcacttgttcatgcttatggtgcggcttttgataaccccgacttaattgtggcggctgttgtaggcgacggtgaagcggaaacaggggctttagcgacaagttggcattctaacaaatttctcaatcctgtccatgatggtgcagtgctgccgatattacacctgaatggctataaaattgctaaccccaccttactcgcaaggttgagttatgaggaattggaaaatctatttttaggttatggttacaaaccttattttgtcgaaggtgttgaacccgcagatgttcaccagcaaatggccgcaactttagatattgcgatcgccgaaattcaaaacatccaaagagaagcccgtgtacatggtttcagccagcgtccccagtggccgatgattatcctcagaacccccaaaggttggacaggccccaaggaagttaatggcaaaaaaaccgaaggttactggcgatcgcatcaagtaccatttggtaacgtcaccagcaacccagaacacctgaaattactcgaagaatggatgaagagttacaaaccagaagaactcttcgatgctaacggaacactcattcccgaactcgcagaactagcgcccgcaggacatcgacgcatgggcgacaatccccacaccaacggcggtatgctgctgcgggacctaaaaatgcctgatttcccagactatgcagttgatgttacccacccagggacaacttacgccgaagctaccaaagtgatgggacagcttctgcgggatgtcatgaaactcaacgaagaaagcagcaactttcgcatctttggccctgacgaaacagcatcaaatcgcctcggtgctgtgctggaagtcacagaccggacttgggtagccgacatcctcccagaagacgaaaatctttcccccaatggtcgggtgatggaagtcctcagtgaaaccaattgtcaaggctggttagaaggctacctacttacaggtcgtcatgggtttttctcctgctatgaagcctttatccacatcattgactcgatgttcaaccagcacgccaaatggctgaaaaccaccaatgatatcccttggcggcgacccattgcttctctcaactacttactaacttctcacgtttggcgacaagaccacaacggtttctctcaccaagaccctggttttatcgaccatgtactcaacaaaaaagccgagattattcgcgtctatctaccacccgatgctaatactttgctatcagtcacagaccattgcttgagaagtcgtcactatgtaaatgtcatcgttgcaggtaagcagccatcattacaatacctagatatggatgccgcaatcaagcactgcaccaaaggactgagtatttgggaatgggctagtaacgataaaggtagcgaacccgatgtagtcatggcttgtgctggggacgttcccaccttagaaaccttagccgccgtggatattctccgccagcacttcccagaattaaaggtgcgggtagtgaacatcgtcaacttgatgaaactacagccccaaagtgagcatccccacggtttaagcaataaagagtttgatacaatttttaccacagataaaccgatcatctttgcttttcatggttatccctggctgattcatcgcctgacttatcgccacaccaaccacaagaacttgcacgtccgtggttataaggaagaaggaactaccactaccccctttgatatggtagtgctgaacgatcttgatcgctttcacctcgtaatggacgtaattgaccgcgtaccacaactaggttctaaagccgcttatgtgaaacagatgttacaagataagctgattgaacataagcactatattcagcaacacggtgaagatatgccggaaattcgcgattggaaatggtcttattaa

SEQ ID NO: 294 - DNA, 2382 bp, Nostoc punctiforme PCC 73102
atgacattagccagtcctctacaaacaaagcctttaacagatgaagaattacgcaagataaacgcttactggcgtgcagctaactatctttcagttggacagatatatctactcgacaatccactactgagagaaccgctaaagcttgaacacgtcaaacccaggctcttgggtcactggggaacaacaccagggctgaactttatctatgctcacttgaatcgggtcatcaaaaaatatgacctaaacacgatctatattgctggccctggtcatggtggccctggactagtagccaacacctacctagaaggcacttacaccaagtattatcacaacatctcccaggatgctgaaggaattcagaaactcttcaagcaattttcttttcctggtggtattcccagccacgttgcaccagaaacccctggttcgatccatgaaggcggggaactaggttatgcccttgtccacgctttcggtgctgcctttgataaccctgacttgatcgttgctgctgttgtgggtgacggcgaagctgaaacaggtgctttagcaactagctggcattccaacaagtttcttaaccccgtgcatgatggggctgtactgccgatcctgcacttgaatgggtataaaattgctaatccaacagtactggcacggatcagccatgaggaattagaaagcttatttgtcggctacggctacaagccctactttgtcgaaggtgacgatcccgcagatgtacatcagcagatggcggcgactctagatatagcgatcgccgaaattcaaagtatccaaagagaagcccgcgtacatggttacactgaacgtcctcagtggccgatgattgtcatgaaaacccccaaaggttggacagggccaaaggaagttgatggtaaaaaaactgaaggttcttggcgatcgcaccaagttccctttgggaatatcgccaaacagccagaacatctgaaactcctagaagattggatgaagagttacaaaccagaagaactcttcgacgctaacggcacactaatcccagaactagcagaattggctcccaaaggccatcgacgcatgggtgacaatccccacgctaacggcggtcttttgctgcgcgacctgaagatgcccgacttccaaaagtatgctgtagatgttctcaaaccagggcaagcgatcgctgaagctacccaagttgcaggaattttcctccgggatattatgcaacttaaccaagaaagccgcaacttccgcatcgtcggccccgatgaaacggtatcaaatcgcttaggcgctgtgctagaagttacagatcgggattgggcagcccagatactccccgaagatgaccacctttcccccgatggtcgggtgatggaaattctcagcgaaactaattgtcaaggatggttagaaggctacctcctcacaggacgacacgggtttttctcttgctacgaggcgtttatccacatcgtggactcgatgttcaatcagcacgccaaatggctgaaaacgactagacatattccttggcgtaaaccaattgcttcccttaattatctacttacctctcacgtttggcggcaagaccataacggtttttcccaccaagaccctggttttattgaccatgtagttaataagaaagcagagatcgttcgcgtgtatttgccccccgatgccaacactctgctatcggtaactgaccattgtttaagaagccgcaactatgtcaacgtcatcgttgccggaaagcaaccagcattgcaatacctaaatatggatgctgctatcaagcactgcaccaaaggcatcggtatttgggaatgggcaagcaacgataaagacggcgaaccagatgtagtaatggcttgtgctggggatatccccaccttagaaactttagcggctgtggacattctgcgccagcacttccctgagttaaaggtgcgggtagtgaacgtagtcgatttgatgacactacagccaaaaagtgaacacccgcacggtttgagcgaaaaagactttgacacgattttcaccaccgataaacacattatctttgcctttcatggctatccttggctgattcatcgcttaacctatcgccacaccaatcacgagcagttgcatgtgcgtggctacaaggaagaaggaaccaccaccactccctttgatatggttgtgcttaacgagctagatcgcttccatctagtgatggatgtaatcgatcgcgtaccaaagctaggatatagggcagcttatgtcaaacagcagttgcaagataaactgatcgaacacaaacattacattgagaagtacggcgacgatatgccggaaattcgtgactggaagtggccctattaa

SEQ ID NO: 295 - DNA, 2382 bp, Anabaena variabilis ATCC 29413
atgactttagcaagtcctccacagataaagcctttaacagacgaagaactgtataaaatcaacgcctactggcgtgcagctaactatttgtcagttggacaaatttatctacttgataatcccctactaagagaaccactcaacaaagaacacgttaaaccccgtctcttaggacactggggaactacgccgggactgaattttatttacgtccatctcaatcggattatcaaaaaatacgaccagagtatgatttacatcgccgggcctggtcacggtgggcctggactggtagcgaatacttatctagaagggacatacagcgagtattatcccaacatctcccaagatgctggcggtatgcagaaactgttcaaacagttctcctttcctggtgggattcccagccatgtagcgccggaaactcctggttcaattcatgagggtggtgaacttggttatgctttggttcatgcctttggtgcggcttttgataatcctgatttaattgtggcggctgttgttggtgatggggaagcggaaacaggtgcgttagctactagttggcattccaacaagtttctcaatccggctagtgatggtgcagtactgccgattctccacctgaatgggtataaaattgctaaccccacagtcttagcacggttaagctacgaagagttagaaagcttatttgtgggctatggctacaaaccttactttgtcgaaggttccgatcccgccgttgtgcatcaacaaatggcagcaactttagatacagtgattgcggaaattcacagtatccaaagagaagcccgtgtacacggatttagcaagcgtccccagtggccgatgattatcctcaggactcccaaaggatggacagggccgaaagaagtagacgggaagaaaacagaagattactggcgatcgcaccaagtaccctttggtaatgtcacaggtaatccagaacacctgaaactactagaagaatggctcaagagttacaaaccagaagaactctttgatgctaacggcagacttgtaccagaattagcagaattggcaccaaaaggcgatcggcggatgggcgataatccccacgccaacggcggtatcctgttgcgtgatttggtaatgcccaattttcaaaactacgccgtcgaagttccccaaccaggtagagtcactgcggaagccacccaagtcacaggtaaatttctgcgggatgtgatgaaactcaacctagatagccgtaacttccgagtcttcggccccgatgaaaccgcatcaaatcgcatcaacgccgtcttagatgtcaccgatagaacttgggtagctcaaaaactacccgaagatgaccatcttgatcccagtggtcgggtgatggagatcctgagtgaaacctgctgtcaaggatggttagaaggatatctgctgacaggccgtcacggcttcttctcctgttacgaagcttttatccacattattgactccatgttcaaccagcacgccaaatggttgaaaaccactcgccacatttcatggcgcagaccagtagcctctctcaattaccttctgacctcccacgtttggcgacaagaccacaacggtttttctcaccaagaccccggatttattgatcatgtagttaacaaaaaatcggagatcattcgggtatatcttccccccgatgccaacaccttactatcagtgacagaccactgtttaagaagccggaactatgtcaacgtcattgttgcaggtaaacaaccagcattacaatttctagacatggatgcagcaattaaacactgcaccaaaggcattggtatttgggaatgggctagcaacgaccaaggtagtgaaccagatgtagtcatggcttgcgccggagatgttcccaccttagaaactttggcagctgtagacattttgcgccaacacttccccgatttaaaagtacgggtagtcaacgttgtcgatttgatgacactacagcccaaaacagaacatccccacggtctaaatcccaaagactttgagactattttcaccaccgacaaacccatcattttcgccttccacggctacccttggctaatccatcgtctaacttatcgccaacccaaccacaacaaccttcatgtgcgcggttacaaggaagaaggaacaaccacgactccctttgatatggttgtgctgaacgacctcgatcgcttccatctagtcatggacgtaatcgatcgcgtacccaaactgggctacaaagcagcttacgtcaagcaacgactacaagacaagctcatcgaacacaaacactacatttccaaatacggtgaagatatgccagaaattaacgactggcaatggccgtattag

SEQ ID NO: 296 - DNA, 2133 bp, 'Nostoc azollae' 0708
atgacattagccagcactcgacaaataaagccattatcagacacagaattacaaaaaatcaacgcttattggcgtgcagccaactatctctcagtcggacaaatatacctactcgacaaccccctactgaaagaaccgctaaaaatagatcatgttaaaccgcgtttgttaggacattggggaacaactccagggctgaacttaatatatgcccacctcaatcgcgtcattaaaaaatatgacctcagcaccatttatattgctgggcctggacacggtggacccggacttgtcgctaatacttacttagaaggcacatacagcgaatattaccccaacatctcccaagatgctggggggatgcgaaaactatttaaacaattctcttttcctggtggtattcccagtcacgtcgcaccagaaacccctggttctatccatgaaggaggagaactgggttatgctttagttcacgcctatggtgctgcttttgacaaccctgatttaattgtcgctgctgttgtcggtgatggagaagcagaaaccggcgctttagctaccagttggcattctaacaaattcctcaaccctgttactgatggggcggttcttcccattttacatttaaatgggtataaaattgccaatcctactattttagcacggataccccatgaagaactagaaagtttgtttattggctatggctataaaccatactttatcgaaggttctgaccctgcggatgttcaccaaaaaatggcggcaactttagatatagttattgccgaaattcaaggtatccaaagagaagtgcggatacatggtttcaaaaagcgatcgcaatggccgatgataatattacgtactcctaaaggttggactggaccaaaggaagtagatggtaagaaaacagaagattattggcgatcacaccaagtcccatttggtgatatagctggtagagcagaacatctgcaactactagaagactggatgaagagttacaaaccagaagaactatttgacgcaaacggtcaactccttcccgaactggcagaactcgcacctacaggtcagcgtcgcatgggagacaacccctacgcaaacggcggtatattgctgcgtgatttaatcatgccagacttttccaactatgcagtagaagttccgaaaccaggaacagttaacgcagaagccaccaaagtgaccggcaaattcctgcgggatatcatgaaagaaaaccaggaaagccacaactttcgagttttcggacccgacgaaaccgcatctaaccgcatcgacccagtgttagaagtcacaaatcgtacttgggttgctgaaactctcccggaagatgaccatttatcacctaatggtcgggtaatggaaatgcttagcgaaacaaactgtcaaggatggttagaaggatatctgcttacaggtcgtcatggtttcttctcctgttatgaagcatttattcatatcattgactcgatgtttaaccaacacgctaaatggttaaaaacaactcgtcatatttcttggagaagaccaattgcatctttaaattatcttctcacttcccatgtttggcgacaagatcataacggtttctctcaccaagatcctggttttctagatcatgttattaataaaaagtccgaaattattcgcgtctatctgccacctgatgctaacactttgttatcagtaaccgaccactgtttaagaagtcgtaactatgtcaatgtcattgtggctggaaaacaacctgcattacaatatttagacatagatacagctattaaacactgtaccaaaggtttaggaatttgggaatgggcaagtagtgatcaaggtggtgacactgatgtagtgatggcttgtgctggggatattccaactttagaaaccttagcagcagtggatattttgcgtcagtatttcccagaactaaaagtgcgggtagtgagcgtagttaatttgatgaaactacagccacaaagtgaacatcctcacggtttaaccagcaaagagtttgatactatttttaccactgataaaccggttatttttgcttttccatggttatccttggttaattcatcgtctcacctatcgtcatactaa

SEQ ID NO: 297 - DNA, 2382 bp, Gloeobacter violaceus PCC 7421
atggtagtagccaagattgaaaaaaccggcaccttgagcacagagcagttgcaaaagatgcacgcctactggcgggcggccaactatctgtcggtgggccagatttatctaatggacaatcccctgttgcgcgagccgcttaaactcgagcatgtcaagccgcggcttttggggcactggggcaccaccccagggctgaatttcatttatgtccacctcaaccgcgtgatccaagacgaggatctcgacatgatctacatcgccggaccggggcacggcggacccggtttggtggcaaacacttatctcgaaggcacctacagcgagtactacccgaacatctccgaggacgccgaggggatgaagcgcctcttcaagcagttctcctttcccggcggcatcccgagccacgtcgccccggagacccccggctcgatccacgaagggggcgagttgggctacgcggtctcccacgcctacggcgccgtcttcgacaatcccgatctgatcgtcgcctgcgtggtaggcgacggcgaagccgagaccggtccgctcgccacctcctggcactccaacaagtttctcaatcccgtgcgcgacggggcggtattgccgattttgcacctcaacggttataagattgccaacccgacggtgctcgcgcgcatcagccacgaggaactggagaagctctttgaaggctacggctacaagccttatttcgtcgaaggctccgagtacgaaccgacccaccagttgatggcagcgacactcgatacctgcatcgccgagatcaaggccatccagcacgaggcgcgtaccggcggcgcgaccgcccgtccccggtggccgatgatcgtcctgcgcacccccaagggctggaccggccccaaggaagtggacggcaaaaagaccgaggatttttggcgctcgcaccaggtgcctttttcggagatggcgggcaagcccgagcacgtgcagttgctcgagacctggatgcgcagctaccagccggaggagctgttcgacgagaacggtacctttttgggcgagctcaaggccctggcccccaaggggcaccggcgcatgggagacaatccccacgccaacggcggcatcctgctcaaagatctgaagatgcccgattttcgctcctatgcggtggatgtggccaaacccggcaccaccttcgcagaagcgaccaaggtgatgggcatcttcttgcgcgacgtgatgaaggcgaacctcgatcagcgcaactttcggatcgtcggccccgacgaaacggcttccaaccgttggggaccgctttttgagatcaccaaccgcacctggatggacgcaatccacccctacgacgatcatctctcgcaggacggccgggtgatggaaatcctcagcgagcacacctgccagggctggctggaggggtacctgctcaccggtcggcacggatttttctcgtgctacgaagcgtttattcacttggtcgattcgatgttcaaccagcacgccaaatggctgaagaccacccggcacatcccctggcgccgcccgatcgcttcgctcaactacctgctcacctcccacgtctggcgacaggatcacaacggtttttcgcaccaggatccgggctttatcgaccacgtggtcaacaaaagagcggaggtcatccgggtgtacttgccgccggatgccaacacacttttgtctgtcacagatcattgcctgagaagccgccactacgtgaacgtggtcgtggcgggcaaacagcccgccttgcagtacctcgacatggacgcggccatcaagcactgcaccaagggcatcggcatctgggactgggcgagcaacgaccagggcgtggagccggacgtggtgatggcctgctgcggggacatccccaccctggagacgctcgcggcagtggacatcctgcgtcagaacttccccgatctgaagatccgagtgatcaacgtcgtcaacttgatgaagctgcagccggaaagcgagcacccccacggcctgtcggacaaagatttcgattcgatctttacccccgacaaaccggtggtgtttgccttccacggttatccctggctcatccaccggctcacctaccggcgcaacaaccacaacaacatccacgtgcgcggctacaaagaagaaggcaccaccaccacgcccttcgacatggtggtaatgaacgacctcgaccgcttcaacctggcggacgacgtgatcgaccgggtgccccggctgcgctacaccgccgcccacgtcaagcagatgctccacgacaagctcatcgagcacaagcagtacatccacgagcatggcgacgacatgcccgagatccgcgactggtgctggccgtactag

SEQ ID NO: 298 - DNA, 2376 bp, Synechococcus sp. JA-2-3B'a(2-13)
atggttctggcagaacagctctcgacaaaaccgctcaccgccgacgagcttcgcaaaatggatgcctactggcgggccgccaactatctgtcggtcgggcaaatctatttgatggacaacccgctgctgcgagaacccctaaaactggaacatgtgaagccacgcctgctggggcactggggcaccacacccgggttgaacttcatctacgtgcatctcaaccgcatcatcaaacgggaaaacctcaacatcctctacatcaccggccccggccacggtggccctgctctggtggccaacacctacttggaaggcacctacagcgaggtgtatcccaacatcggccaagacgccgaaggcatgcgcaagctcttcaagcaattctccttccccggcggcgtgcccagccacgtggctccggaaacccctggctccatccacgaggggggagaactgggctatgccctggcccacgcctttggggctgcctttgataaccccgatctgctggtggcctgtgtggtgggggatggagaagcggaaaccggccccttggccgcttcctggcattccaacaagttcctcaaccccatccacgacggagcagtgctgccgattctgcacctgaacggctacaagatcgccaatcccaccgttttggcccgcctcagccgtgacgagctgcaaagcctgtttgtgggctacggctacaagccctacttcgtagaaggctgcgagccggcagagatgcaccagttgatggccgccactttggacacggtgatccacgagatccaagaaatccagcagcatgcccgcagcaaaggggatcccactcgtccccaatggccgatgatcatcctgcgcacccccaaaggctggaccggccccaaagaggtggacggcaaaaaggtggaagatttctggcgctcccaccaagtgcccctggcggatctggccaaaaaaccggagcacctcaaggctctggaggactggatgcgcagctacaagccggaagaactcttcgatgaaaatggccgtctgctgccggagctgcaagagctggcccccaaaggggaaaaacgcatgggggctttgccccacgccaacggcggcctgctgacgcgggagctgaaaatgccggatttccgtcgctacgccgtgcctgtcccccgccccggcaccaccgaagccgaagccacccgagtgctggggcaatttctgcgggatgtgatgaagctcaacccccacaacttccgcctctttggccccgatgaaaccgcttccaaccgcttggatgctgtgtttgaggccagcgaccgcacctgggtagctcccatctacgattgcgacgagcacctctccccagatggacgggtgatggagatcctcagcgagcacgtctgtcagggctggctagaaggctacctgttgaccgggcgacacgggttcttttcctgttacgaagccttcatccacctggtggactcgatgttcaaccaacacgccaaatggttgaaaaccacccggcacattccttggcggcggcccattccttccctcaactacctgctgacttcccatgtgtggcggcaggatcacaacggcttcagccaccaggatcccggctttttggatcacgtggtcaacaaaaaggccgaaatcatccgcgtctacctgcccccggataccaatactttgctctcggtggccgaccactgtctgcgcagtcgccactacgtgaacgtgatcgtggcaggcaaacagccggccctgcagtacctggacatggatgcggccatcaaacactgcacccagggcttgggaatctgggaatgggccagcaacgatcagggttcagagccggatgtggtgatggcctgctgtggcgatgtgccgacgatggaaaccctggcggcggtggactttttgcggcagcacctgccggagatcaagatccgggtggtgaacgtggtgaacctaatgaagctgcagccgcccagcgaacacccccacggcattagcgacaaggagtttgtcagtatcttcacccccgacaagcccatcgtgtttgccttccacggctatccttggctcatccaccgcctcacctaccgccgtcccaaccaccacaacctgcacgtgcgcggctacaaggaggaaggcaccaccaccacccccttcgacatgtgcgttctcaaccaggtggatcgctttaacttggccaacgacgtcttggagcgggtggatcgcttcaagtaccggcgggatcacgtccagcagcttatccgggacaagctggtggagcacaagcagtacatctgcaaacacggggaagatctgccggaggtgcgcaactggaagtggccctattga

SEQ ID NO: 299 - DNA, 2373 bp, Sinorhizobium medicae WSM419
atggacgcctactggcgggcttccaactatctctcggtcggccagatatacctgctcgacaatccgctattgcgggaatccctgaagcgcgagcacatcaagccgcgactgctcggccactgggggacgtcgcccggtctcaacatgctctatgtgcatctgaaccgggtcatcaagcgcgacgatctcaacatgatctacgtcatcggccccggccacggcggaccgtcattggtggcgcacgcttatctcgaaggcacctacagcgagttctatccgaatatcagcgaggatacggaagggatgaagcgactgttcaagcagttcagcttccccggcggcataccgagccatgtcgcgcccgaaactcccggcagcatccacgagggcggcgaactcggatacgcgctcagccatgcctatggcgcggcattcgacaatcccgatctgatcgtcgcctgcgtcgttggcgatggggaagctgagaccggtccgctcgcgaccggctggcaaagcaacaaattcctcaatcccgcccgcgacggctgtgtgctgccgatccttcacctgaacggctataagattgccaacccctgcttcctcgcccgcatccccgaggaggaactgcgcaagttcttcgaggggatgggatacaggccctatttcgtcgagggccgtgatcccgaggatgttcaccagaagctcgcaggcgtgctcgacaccgcggtcggcgagatcaaggaaatctgggccgatgcccgtacgaacggcaatctcaagcgcccggcatggccgatgatcgtctttcggacgccaaagggctggacgtgcccgccggagatcgatggcaagaaatgcgaggactattggcgatcgcatcaggtgcccatgggcgagatggacaagccggagcatatccgcattctcgaacaatggatgaaaagctatcggcccgaggagcttttcgacgagaccggccggctcacggctgaaattgcatcgctcgctccggcgggccaccgccggatgagcgacaacccccacgccaacggcgggttgcttctgcgtgatttgaagatgcctgatttcagggaatacgccgtggaggtaaccagccctggcgcgactatggccgagtcagcccgcgcgatgggcaagttcctgcgcgacgtgatgaaggcaaacctggagagcaagaacttccggctgttcagtccggacgagaacaactccaaccgctggcaggatgtgctcgaggtgaccgatcgctgctacatggcggatatctatccggaggacgaccatctctcgccggacggccgcatcatggaagtattgagcgagcaccagtgccagggatggctggagggctatctgctgacaggccgccacggcttcttctcctgctacgaagccttcatccacatcatcgactcgatgttcaaccagcatgccaagtggctcaaggtgtgtggcgaaatcccgtggcgcagacccatcggctcactgaactatttcctcagttcgcatgtctggcgacaggatcacaacggcttcagccatcaggaccccggcttcatcgaccatgtcgtcaataaaaaggcggacgtgatccgcgtctatctgccgccggacgccaacaccctgctctgcgtcacggaccactgcctgcgcagccgcgactatgtcaacgtggtcgtcgccggaaaacagcctgcgccgcaatggctgacgatgagcgaggccgtcaggcactgcgccatgggcctcagcatctgggattgggcgagcagcgacaagggcagcgagcccgatgtcgtcatggcctgttgcggcgacgtcccgaccctcgaaacgcttgcggcggtgcaactgctccgcgaacacctgcccgagctgaaggtgcgggttgtcaatgtcgtcaacctgatgaagctgcaacctgcggaggagcatccgcacgggctatcggaccgtgatttcgacgccttcttcacaagagacaagccgatcatcttcgccttccacggttatccgtggctgatccaccgatttacctatcgcagaaaaaatcacggcaacctgcacgtgcgcggctacaaggaggaaggcacgacgaccaccccgttcgacatggtggtcctgaacgagctcgaccggttccacctcgtcgaggacgttatcgatcggctgccgcaactcggcgcccgtgccgcctatttcaagcaggcaattcacgagaagctgatcgagcatcgcgaatatatcgagaagcatggcgacgacatgcttgcgatcagcggctggaagtggggcgtgaaagacacgacggcagcgtcccggaaaacctctacggaaggggacaacgtctga

SEQ ID NO: 300 - DNA, 2466 bp, Rhizobium leguminosarum bv. viciae 3841
atggtttcgctcaagacggcacgagatgcaaaggtcgccctacacgcgaagatggcaacgggcggccccctttcgacggaagaattgcagtccatcgacgcctattggcgcgcatcgaactatctgtcggtcggacagatttatcttctcgacaatccactgctgaaagaaccattgaggcgcgagcacataaagccgcgactgcttggccattggggcacgtcgccgggtttgaacatgctttacgtgcatctcaaccgcgtgatcaaacgcgatgatcttgagatgatctacgtcatcggaccaggacatggcggaccgtcgctggttgcgcacgcctatctcgaaggcacctacagcgaagtttatcccaatataagtcaggatgccgagggcatgaagaggctgttcaagcagttcagcttccccggcggcatccctagccacgttgccccggaaacccccggcagtatccacgagggcggcgaactgggttatgccctcagccacgcctatggggcggcgttcgacaacccgaatctgattgtcgcctgcgtcgtcggcgacggggaggccgaaaccgggccgcttgcaacaggctggcacggcaacaaattcctcaatcccgctcgcgacggctgcgtgctgccgatcctgcatctgaacggctacaagatcgccaacccgtgcttcctcgcccgcattccccgggacgaactgaggaagttcttcgaaggcatgggctacacgccgtatttcgtcgagggtagcgaccctgaaaacgtgcaccagcaattggccggcgtgctcgacacagcagtggcggatatccaggaaatctgggcaacagcccgcaccaaaggcaagataaaacgcccgatgtggccgatgatcattttccgcacgccaaagggctggacctgcccccccgagatcgacggcaagaagtgcgaggattactggcgggcgcaccaggtgccgatgggcgacatggacaaaccggagcacatccgcattctgcaggaatggatgaagagctaccgccctgaggaattgtttgatgacagcggtcgcttcaagccagggctggcggcgctggcgcccgtggggcaacgccgaatgagcgacaatccgcatgccaacggcggattgctattgcgggacctgaaaatgcccgacttccgggactacgcggtatccgttccaagccccgggcaaacacacactgaggccgcgcgggtgatgggcaagtttctccgcgatatcatgaagatgaacatggacagcaagaacttccgactgttcagccccgatgagaacaactccaatcgctggcaggatgtactggaggtcaccgaccgctgctacatggcggatatctatccggaagacgatcatctttcgcccgatggcagagtgatggaggtgctcagcgagcatcaatgccaaggctggctggaaggttacctgctgaccggccggcatggcttcttttcctgctacgaagctttcatccatatcatcgactcgatgttcaaccagcacgccaaatggctgaaggtgtgcaacgacattccatggcggcgatcggtcgcctcgcttaactatttcctgagttcccacgtctggcggcaggaccacaatggctttagccatcaggacccggggttcatcgatcacgtggtcaacaagaaggcggatgttgtccggatctacctgccgccggacgccaatacattgctctctgtaaccgatcactgcttgcgcagccgcaactatgtcaacgtggttgtcgcaggcaagcagccagccccgcagtggctgacgatggatcaggccatcaagcattgcagcgaaggtctcggcatttgggaatgggccagcaatgacaagggaagcgaacctgacgttgtgatggcatgttgtggggatgttccaacgcttgagacgctggcggcggtcgagctaatccgggagcacctgccggagctgaaagttcgtgttatcaacgtcgtgaacctgatgaaacttcaacccccgtccgagcatccacatgggctgccggatcgcgattttgatgcgctgttcaccaagaacaagccgatcatcttcgccttccacggctatccgtggctcatccaccggctcacctaccgccgtaccaatcacggcaatctgcacgtccgcggctacaaggaagaaggaacgacgacgacgccgttcgacatggtggtcctgaatgaaatggaccgcttccatctggtcgaggacgtcatcgaccggctgccgcaactcggtgcacgcgctgcatatttcaagcaggcaattcgcgagaagctggtcgaacatcgccaatatattgagaagtatggcgacgacatgccggcaatcagcggctggaaatggggctcgaaagctcagccaaaaacacgtcaaaggacctccaccgaaggggacaatgcttga

SEQ ID NO: 301 - DNA, 2454 bp, Sinorhizobium meliloti 1021
atgacttcccccaggacggcacgtgacgtttccagccaagagccattatccgccggtccgctgtctgcagatgaacttcagcggatggacgcctactggcgggcgtcgaactatctctccgtcggccagatctacctcctcgacaacccgcttctcagcgagccgctgaagcgggagcacatcaaaccgcggcttctcggccattggggtacgtcgcccggcctgaacatgctctatgtgcacctgaaccgggtgatcaagcgcgacgatctggagatgatgtatgtcatcggccccgggcatggcgggccctcgcttgtcgcccacgcctatctggagggcacctatagcgaggtctatccggacatcagccaggacgccgaaggcctgcggaagctgttcaagcagttcagcttccccggcggcatcccgagccatgtcgcgccggaaacgccgggcagcattcacgagggcggcgagctcggctatgcgttgagccatgcctacggtgccgccttcgacaatccggagctgatcgtcgcctgcgtggtgggcgacggggaagccgaaacgggcccgctcgcgaccggctggcacggcaacaagttcctgaacccggcgcgcgacggctgcgtcctgcctatcctgcacctcaatggatacaagatcgccaatccctgctttctcgcacgtattcccagagaggagctgcagaagtttttcgagggcatgggctatgcgccgcttttcgtcgagggtcatgatcccgcagacgtgcatcagcagctggcggccgcgctcgataccgcgctcgcggatatcaggcgcattcagaccgacgcccgggtcaacggcaatctgaaacgccctgcatggcctatgatcgtcttccgcacacccaagggctggacctgcccggccgagatcgacggcaagaaatgcgaggattactggcgatcgcatcaggtcccgatgggagacatggacaagccggagcatatccgcatcctcgaaggctggatgaagagctatcggccggaggagctcttcgacggtgacgggcggctgacggcggaactggcggcgcttgccccaacaggacggcgccggatgagcgacaatccgcatgccaatggcgggctgttgctgcgcgacctgaagatgcccgacttccgcgattatgcggttgcggttcagagccccggagcggccacggccgagtcggcccgcgtgatgggcagctatctgcgcgacgtgatgaagctcaacctgaagtccgggaacttccgcctgttcagtccggacgaaaacaactcgaaccgctggcaggacgtgctcgaggtcacggatcgctgtttcatggcggacatctatccggaagacgaccacttgtcgcccgacggacggctgatggaggtcctgagcgagcatcaaagccagggctggctcgaaggttatctcctgaccggacgccacggcttcttttcctgctacgaagccttcattcacatcatcgattcgatgttcaaccagcacgccaaatggctgaaggtctgcaacgagatcccgtggcggcgcccgatcgcttccctgaactatttcctgagctcgcatgtctggcgccaggaccataacggcttcagccatcaggaccccggcttcatcgatcacgtggtcaacaagaaggcggacatcatccgcgtctatctgccgccggacgccaatacgctgctgtcggtgacggaccattgcctgaggagccgcaactacatcaacgtcgtcgttgccggcaagcagccttctccgcaatggctgaccatggaccaggcggtgaagcattgcaccgagggcctcggcatctgggaatgggcaagcaacgacaaaggctgcgagccggatgtggtcatggcatgttgcggcgatgttccgacgctggagacgctcgccgcggtgcaattgctgcgcgaacacctgccggaattgaaggtgcgggtgatcaacgtcgtcaatctgatgaagctgcagccatcgggagagcacccgcacggcctgccggaccgcgacttcgacgccctgttcaccaaggacaagccgatcatcttcgcctttcatggctatccctggctgatccaccgcctcacctatcgccgaacgaaccatgccaatctgcatgtccgcggctacaaggaagaggggacgacgacgacacccttcgacatggtggtgctcaaccatctggaccggttccatctggtcgaggacgtcatcgaccggctgccgcaactcggcgcccgcgcggcctatttcaagcaggcgattcacgagcggctgatcgaccacaggcaccatatcgagaaatacggcgaggacatgccggtgatcagcggctggaaatggggcgccggcagcgccggcaaggcacagggaacatcgaccaaaggcgacaatgtctga

SEQ ID NO: 302 - DNA, 2514 bp, Verrucomicrobium spinosum DSM 4136
atgagcaaaaattcccgcaaatcctcatccgccaaaacaggttcccccacggctgccaagaaaaacaccaacgcgaaggatcctacctctggtgccattaaaggaccactgtctgaagaccaactcgccaggatggatgcatggtggcgtgcggccaactacctctccgtggggcagatctatctgcaggacaatcccctgctgacgaagcggctcaagcgtgagcacattaaacctcgccttctgggccattggggcaccacgcccggcttgaacttcatttacgttcacctcaaccggatcatcaaggagcacgacctgaacatgctcctcatcactggcccgggtcacggaggccccggcattgtggccaacacgtacctcgaaggaacgtacagcgaggtgtatccagagatcagcgaggatgaggtggggctgcaacgcctcttcaagcagttttcctttcccggtggcattcccagccatgtcgccccggaaacgcccgggtccattcatgaggggggcgagctcggttactccctttctcacgcctatggggcagcatttgacaatcccgacctcatcatccctaccatcgtgggtgatggcgaagctgagaccggtcctcttgccaccggatggcatggcaacaagttcatcaaccctgtgcgcgacggtgccgtcttgcccatccttcacctcaatggctacaagatcgccaacccttgtttcctcgcccgcattccacacgaagagcttcagaagttcttcgaagggatgggctatcgcccatggttcgttgaaggtgacgaccccgccatccttcaccagcaaatggcgtccaccttggacaaggtgacgcaggagatccgctccatctggaagaacgcacggacacacggtttccaaggccgccctgcctggcccatgatcgtgctccgcacgcccaaaggatggacctgccccaaagaaatcgatgggctcaagtgcgaaggctattggcgcgctcaccaagtgcccatgggagacatggacaagcctgaacacgtaaaagtgctggaggcctggatgaagagctaccgccctgaggagctctttgatgccaccggtcatctccatgaaaatatcgccagcctcgctccgggcggcacacgtcgcatgagtgccaatccgcacaccaatggcggtctcctgttgcgcgatctccgcctccctgacttccgcgactacgccaccaagtgcccggccccgggagagaacttcgccgaggccacccgggaaatgggacggtttctgcgtgacgtgatgaagctcaacctggagaggcaaaactttcgccttttcagcccggatgaaaacaactcgaaccgctggcaggatgtcctgcaggtgaccagccgcgcctacgccgcggagatcctcccggaggacgatcatttgtccccggacggacggatcatggaggtcctctccgagcaccagtgtcaggggtggctggagggttatctcctgacgggacgccacggcttcttcagttgctacgaggctttcatccacatcattgactccatgttcaaccagcatgcaaagtggttgaaagtctgccggcacatcccatggcgacgccccattgcttcattgaactatctgcttagctcccacgtctggcgacaggatcacaatggcttcagccaccaggaccccggcttcctggatcacgtcatcaacaagaagtcggaggtcatacgcgtgtatctgcccccagatgccaacaccctgttaagcgtgaccgaccactgcctccgcagccgcaactacgtgaacgtcgtggtcgcaggtaaacagcccgctccagtctggctctccatgcaggacgccgcccaacattgcgctgccggtgtcggcatctgggactgggccagcaatgaccagggtggcgaacccgatgtcgttatggcctgctgcggagacgtccccaccctggagaccctggccgccgtcgagctcatccgtcagcatgcgccggacgtgaaagtccgcgtggtgaatgtcgtggatctcatgaaactacagcctgtcgaagagcatcctcacggtctgcacgaccgtgagttcgacgccatcttcaccagggacaagccggttatcttcgccttccacggctacccctggctcatacaccgcctcacgtatcgacgcaccaaccactgcaacctgcatgtccggggctacaaggaggaaggcacgaccaccacgccttttgacatgtgtgtgctcaatcagctggaccgtttcaccctcatgggagacgcactgagccgcgtcacaagactaggcagccgtttgggttacattctccagttcgtccatgagcaacttcaccaccaccgcgcgtacatctgcgagcacggcgatgatgtacccgagattcgtgactggaagtggaacgcaaaactaaacggtgcaacccgccgtggagtccgccaggcggatacttccgccgacaacacttga

SEQ ID NO: 303 - DNA, 2436 bp, Methylobacterium extorquens PA1
atggacgcgatcctcaaagctcggcggcagcccaagcgcacggcgcggacatccgagctggccctgatcgatgcctactggcgggcggcaaactacttgtcggtcggtcagatctacctctacgacaacccgctactggtggaacgactgaccaaggagcacatcaagccgcgtctactcggccactggggaaccactccgggtttgaatttcatctatgttcatctgaatcgtcttattaaaaagcatgatcttgatgttatctatattacagggccggggcatggcggtcctgccttgatcgccaacgcatacctcgaggggacttacagcgaagtctatccgaacatctccgccgatgctgagggcatgaagcgcctcttcaagcagttctccttcccaggcggcatcccgagccatgtggctcctgaaacaccgggctcgatgcacgaaggcggagagctgggctattccctctcgcacgcctacggcgccgcgttcgacaaccccgacctcatcgtcgcttgcgtcgtcggcgatggcgaggccgagaccgggcctcttgccacaagctggcattcgaacaaatttctcaaccccgtgagcgatgggacggttctgccgatcctgcacctcaacgggtacaagattgccaacccgactgtactggccagaattagccacgcggagcttgaacatctcttccgtgggtacgggtacaccccctacttcgtggaaggacatgatccggccgagatgcaccagcgcatggcctccaccatggatgctgtcctgcgggacattcgccggatcaagtcggacgcgcgcgacaagggtttcacgggccggccgttctggccgatgatcgttcttcggacgccaaaaggatggacatgtccgaaggaaatcgatggacggcgcacagaggattactggcgctcgcaccaagtgccaatgggcgagatgcacgacaatcccgcccatgtgcgcatgctcgaagactggatgcaatcttatcggcccgccgagctcttcgacgaaggcggccgacttcgctcggaacttgccgagcttgccccgacgggcgaccgccgcatgagcgccaatccgcataccaatggaggcactctgctccgcgacctgcggctcccggattttcacgactatgcaataccggtgaccgcccccggtgccgccgtcgccgagtccacgcgcgtgatgggacgcttcctccgcgacgtcatggacctgaacgcagaagcgcgaaacttcaggctgttcagtccggacgagaataactcaaatcgctggcaggacgcgctcgaggtgaccaaccgcgcctgggtggccgagacgtatccctgggatgatcacctcgcgcatgacggccgcgtgatggagatgctgagcgagcatcaatgtcagggctggctcgaaggctatctgctgacgggtcggcacggcttcttctcgtgctacgaggccttcatccacatcatcgactcgatgttcaatcagcacgccaagtggctgaaggtctgcaaccatattccgtggcggcgacccattgggtctttgaactaccttctctccagccacgtctggcgtcaggatcacaacgggttcagtcatcaggatccaggcttcatcgaccatgtcgtgaacaagaaagccgaggtcgttcgtgtctacttaccaccggatgcgaattgtttgctttccgtaaccgatcactgcttgcgaagccgcaactacgtcaacgtgatcgtcgcgggtaaacagccagcaccccagtggctcacgatggatcaggcggtcaagcactgcaccgccgggcttgggatctgggaatgggcgagcaacgaccgcggcagcgagccggacgtcgtgatggcgtgctgcggggatgtgccgacccttgaaacgctcgcggccgtcgacctcctccgctgccatgcgccggatctcaaggtgcgcgtcatcaacgtcgtgaacctgatgaagctgcagcccgacacggagcatccacacggcctgtcagatcaggatttcgatgccctgttcacgacggacaaaccggtcgtcttcgcctttcacgggtatccttggctcattcaccggctggtttaccgacgtcacggacacagcaacttccatgtgcgtggctacaaggaggaaggcacgacgagcacgccgttcgacatgtgcgtgatgaacgacatggatcggttccatctcgtcagcgatgtcatcgaccgggtgccgggcctggccgctcgggcggcctacgccaagcaagcgatccgggacaagctaatcgaccatcgcgcgtacattcatcggcacggcgacgacatgccggaagtatccggctggtcctggagcccgatggcgacgacgcgcggtctcggctcgacggagagtgacaatgtgtga

SEQ ID NO: 304 - DNA, 2367 bp, Nitrobacter sp. Nb-311A
atgaatgcgtactggcgggcggccaactacctttcggtcggtcagatctatctttacgataacccgctgcttaagcagtcgctcacaaaggatcacatcaagccgagacttctcggccactggggaacgacgccaggcctgaatttcatttatgttcacctcaatcgggtgattaacaagcacgacctcgacgtaatctacatcacaggtcccggacacggtggtcccgggctggtcgcgaacgcctacctggaggggacctatagcgaggtctatccgaacatttctcccgatgaagagggaatgaagcgactattcacccaattctctttcccgggcggtgtcccgagccacgtcgcaccggagacccctggttcgattcacgaaggcggcgaactcggctacgcactttcgcatgcctacggagcagccttcgataaccccaatttaatcgtggcctgtgtcgtcggcgacggcgaagcggaaacagggccgctggcaaccagctggcattccaataagttcctgaacccggcgagcgatggggtggttttgccgatactccacctgaacggctacaagatcgccaacccctgtgttctcgcgcgcatcagtcatgatgagttggatcacttgtttcgcggctacggctatacgccgtatttcgtggagggggatgagcccgagaaaatgcacgagttgatggctgcaaccatggataaggttgtcggggaaattcggcgcattaaatccgctgcaaaggatggcttcgtggaacgtccattatggccgatgatcgtgctccgcacacccaaaggctggacatgtccgaaagaaattgatggcaagcgcaccgaggattactggcgatcgcaccaggtgccgatgggcgagatgcatcagaacgcggctcatgtccgtcttctcgaagagtggatgaagagctatcggccttcagagctgttcgatgacagcggccaactccgccccgagttggccgatctcgccccgcgaggtgcgcgtcgcatgagcgccaatccgcataccaatggcgggttgatcctgcgcgaattgcggctgccaaatttccgcgattacgctgtcgacgtgaccgcaccgggcgccgaaaccgccgaatccacgagagtcatgggccggttccttcgcgatgtcatgaagctaaacatggagacccggaatttccggctcttcagtccggacgaaaacaactcgaaccgctggcaggatgtgctcgaagtcaccaatcgtgcctgggccgcaagcacctatccctgggatgatcatctcgcgcccgatgggcgggttatggaaatgctcagcgagcatcaatgccagggttggctcgagggctacctcctgaccggccggcacggctttttctcttgctatgaggcgttcatccacatcattgactcgatgttcaatcagcacgccaagtggctgaaggtttgcaatcaaataccatggcgacggcctatcggatcgctgaactacttattgtcgagtcacgtctggcgccaggaccacaacggcttcagccatcaagatcccgggtttatcgatcacgtcattaataaaaaagctgaggtcatccgcgtctatctcccgccagacgctaattgcttgctctcggtcactgatcactgtctgcgcagccgaaactacgtcaacgtcgtcgtcgcggggaagcagcccgctcctcaatggttgacgatggacgaagctgtcaggcattgcgaagctggattgggaatttgggaatgggccagcaacgaccacggcggcgagcccgatgtcgtaatggcttgctgtggtgacgtgccaacgctggagacgctcgccgccgtagacctccttcgaagatacgcgcccgatctaaaggtccgcgtcatcaatgtcgtcaatctgatgaagctgcaacccccgagcgagcatccgcacggtctgtctgatcatgatttcgacacgctgttcacggtcgacaagccgatcatcttcgcgttccacgggtacccgtggctaattcacaggctgatataccggcgcacgagccacgacaacgtgcatgtgcgaggctacaaggaagagggcaccactacgacaccgttcgacatgtgcgtgctcaacgagctagatcgcttccacctcgtcagcgacgtaatcgatcgcgtaccaaaactcggatcgcgcgctgcctatgccaagcaggccattcgcgacaagctcatcgaccacaggaccttcatcgtccggtatggggacgatatgccggagatcactggctggagatggggacagcaggctgcttctgcggccgttcgctcgaccgaggcggacaacgtctaa

SEQ ID NO: 305 - DNA, 2406 bp, Gemmata obscuriglobus UQM 2246
atggccgaaccgatcccggacgccctgctgaaccggatggacgcctactggcgcgccgcgaactacctgtcggtcggccagatctatctgctcgacaacccgctgctccgggagccgctccgcaaggagcacgtcaagccgcgcctcctggggcactggggcaccaccccggggctgaacttcatttacgtccacctgaaccgggccatccggcagcacgacctgaacgtgctgtacgtgtgcgggccggggcacggcggcccggggatcgtggcgaacgtgtacctcgagggcacgtacaccgaggtgtacccgcacatcgggccggacgccgcgggcctgaagaagctgttcaagcagttcagcttcccgggcggcatcccgagccacgtcgccccggaaacgccgggcagcatccacgagggcggcgaactcggctacgccctgtcgcacgcctacggcgcggtgttcgacaacccggacctgatcgccgcgtgcgtggtgggcgacggcgaggccgaaaccggcccgctcgcgaccgggtggcactcgaacaagttcctgaacccggtgcgcgacggcgcggtgctgccgatcctgcacctgaacgggtacaagatcgccaacccgtgcttcatggcccgcatgcccgaggacgaactccgcaagctgttcgaggggtacgggtacgcgccccattttgtgtccggcgaggacccgctccccacccaccggcagatggccgcggcggttgacgcgtgcgtggccgagatcaaacggattcaggccgacgcgcgggcgaacgggttccgcacgcggccgcagtggccgatgatcgttctgcgcaccccgaaggggtggacgtgccccaaggagatcgacgggaagcggtgcgaggggtcgtggcggagccaccaggtgccgatgagcgaggccggcaccgagagccacctccgcgtgctcgaagggtggatgaaatcgtaccgccccgaggagctgttcgacgccgccgggacgttcaagcccgaactggccgagctggccccgcggggcacgaagcggatgggcgccaacccgcacgccaacggcggccggctcctggtcgacctcaagctccccgacttccgcgactacgcggtgaaggtggcgcaccccggcgccgaaaccgccgaatcgacccgcgtgcagggcaagtacctgcgcgacgtgatgaagctcaacctggaggcgcagaacttccggctcttctcgcccgacgaactcgcgtccaaccgctggcaggacgtgctcgaagtcaccgaccggtgctacacggcggagatcgtcccgggcgacgaccacctctcgccggacgggcgcgtgctggaggtgctgagcgagcaccagtgccagggctggctggagggctacctgctcaccgggcggcacgggttctttagctgctacgaggcgttcatccacatcgtggactcgatgttcaaccagcacgccaagtggctgaaggtgtgcaaccacatcgagtggcggaggccggtcgcgagcctcaactacctcctcagctcgcacgtgtggcgccaggaccacaacgggttcagccaccaggaccccgggttcatcgaccacgtgatgaacaagaaggccgaggtgattcgcgtctacctgccgcccgacgcgaactgcctgctgagcgtcaccgaccactgtttgcggagccgcgactacgtaaacgtggtgatcgccgggaagcagcccgggccgcagtggctcgacatgacctccgccgtgcagcactgcgccgaggggctgggggtctgggagtgggcgtcgagcgcgggggccgccgagccggacgtggtcctcgcgtgctgcggcgacgtgccgacgctcgaggtggtcgcggccgcggacctgctgcgccggcacctgccggacctcaaggtgcgcgtggtgaacgtggtggacctgatgaagctccagcccccgaaggagcacccgcacgggctcagcgacgccgcgttcgaccgcctgttcacgaaagacaagccggtcatcttcaacttccacggctacccgtggctgatccaccggctgacgtaccgccggacgaaccacaacaacatccacgtccgcgggtacaaggaagagggcacgaccaccacgccgttcgacatgtgcgtgctcaacgagatcgaccggttcaagctggtgatcgacgtgatcgagcgcacccccggtctcgcggcgcgtgcggggcacgtgaaggagctgatggacgccaaacacaaggcgcaccgcgcgtacgtcaccgagcacgggatcgacatgcccgaggtgagcggttgggagtggggtcagcgcgggaaggtgccccgcggttcgagcgataccgccgcggacaacgcctga

SEQ ID NO: 306 - DNA, 2394 bp, Desulfomicrobium baculatum DSM 4028
atgcagacaaaggccctctccccggaactcgttgcaatgatggacgcctactggcgcgccgccaactacctgtcggtcggccagatttatctttatgacaacccgctgctgaaaaaagagctcatgctgaagcacatcaagccgcgcctgctcggtcactggggcacggtgccgggcctgaacttcatctatgtgcatttgaaccgcatcatcaaggcgtacgatctgaacatcatcaatatcaccgggccgggccatggcgggcccgggcttgttgccaacgcgtatctcgaagggacctacagcgaggtctatccccacatttcgcaggacgaggagggcctgacgcggctcttcaagcagttctccttccccggcggcatcccgagccacgtctcgccggagacgccgggctcgatcaacgagggcggagagctgggctatgcgctgtcgcatgctttcggagcggccttcgacaacccggacctccttgtcgcctgcgtcatcggcgatggcgaagcggagaccggccccatggccacgagctggcactcgaacaagttcctgaatccggtccatgacggcgccgtgctgccgatcctgcacctgaacggctacaagatcgccggtcccaccgtgctcgcgcgtattccccatgacgaactggaggcgctcttccatggctacggctacaccccccatttcgtcgagggtgacgagcccatggagatgcacgtcctcatggccgccactcttgaccgcgtggtgggcgagatccggcgcatccagcgggacgcccgcgaacaggggttcacggagcggccgcgctggccgatgatcatcctgcgcacgcccaagggctggacctgcccgcgggaagtggatggaaaacccacggaaggcacctggcggtcgcatcaggtgcccatgggcgacatgggccatccaggccatgtgaagcttttggagacgtggatgaagagctaccggccgcaggagctgttcgacaagtccggccggctccgccccgagctggccgggctcgcgccggcaggggagcgccggatgagcgccaacccccacgccaacggcggcctgttcctgcgcgacctgcgcctgccggatttcggcgactacgcggtcaaggtcccgaaacccggcgcggtggacgccgaggccacccgcgtgcagggcgagttcatccgcgacgtgattgcacgcaacccatccaccttccgcgtcttcagcccggacgagacgagctcgaaccgctggggcgcggtgttcgaggtcaccagccgctgctcgatggcggccatcgtccccggcgacgagcacgtcgcgcccgatggccgggtcatggagatgctgagcgagcaccagtgcgagggctggctcgaagggtatctcctgaccggccgccacggcttcttttcctgctatgaagcgttcatccacatcgtggattcgatgttcaaccagcacgccaagtggctggacgtcacgcgcgggattccctggcgccgccccatcgcctccctcaactacctgctctcgtcacatgtctggcggcaggaccacaatggcttcagccatcaggacccaggcttcatcgatgtcgcagccaacaagaagtccgaggtcatccgcgtctatctcccgcccgatgcgaacaccctgctctgcgtgacggatcaatgcctgcgcagccgcaactgcgtgaacgtggtcgtggccggaaagcagcccgggccgcagtggctggacatggacgccgccgtcaagcactgcgccgccggcatcggcatctggccgtgggccagcaatgaccagggctgcgagccggatgtcgtcatggcctgctgcggcgacgtgcccaccctcgaaaccctggcggcagtgcagctcctgcgcgaacatttcccggccttgaaaatccgggtggtgaacgtggtcgatctcatgaagctgcagcatcaccgcgagcacccacacggcttgagcgacggcgatttcgacacgctgttcactaccgacaagccggtcatctttgcctaccacggctacccgtggctgatccaccggctgacctaccgtcgcaccaaccatgggaaccttcacgtgcgcggcttcaaggaggaagggtcgaccacgacgccgttcgacatggtggtcgtgaacgacctcgaccgctttcgcctcatggccgacgtcatcgatcgcgtgccgcaggtcggcgccacggccgcgtatgccaagcaggccatccgcgacaaactcatcgagcaccggcagtacatcgaggagcacggcgaagatctgccggagattcggaactggcgatgggggctgggcgaaaaggaaaaactggcgggcggaaaacgcgagtcttga

SEQ ID NO: 307 - DNA, 2472 bp, bacterium Ellin514
atgacttcgatgagaattaaatcgccgagacttccacgtttgcggaaacgccatctcgtcaaacaaacagccgggatggaaccagccattcaagggcgcatggaaggtgcggaagagacggcgctgcttcgcaagatggatgcctattggcgggcggcaaactacctttcagtggggcagatttacctgatgaagaatccgctgttaaggcgtcccctaaaacgagacgatatcaagccgcgtttactggggcattggggaacaacgccgggattaaacttcatctatgttcatctgaaccgggtcatcaaggagcatgatttgagcatgatttaccttgcgggtccggggcacgggggaccgggagtggtggccaatgcctatctcgaaggaacatatagcgaagtctatcatgaaatttcacagagcgagcgaggcatgcagcggttgttcaagcagttttcctttcctggcgggattcccagtcatgcggcacctgaaacgccgggctccatcaatgaagggggcgagctgggctacgttttgacacatgcctttggtgcggtgtttgataatcccgaactgatcgctgccgcagtgattggcgatggagaggcggagaccgggccgttggcaacgagctggcattcgaacaaatttttaaatccggttcatgacggggcagtgctgccgatattgcatctgaacgggtataaaattgctggtccgacggtgctggcacgattgccgcatcatgaattgagatcgttgctcgaaggatacggttacaaaccgtatttcgttgagggggttgagccgttggccacgcatcgattgatggcttcggtgttggatgtggtgatagctgaaatcacagggattcaacaaaaggcacgggctgaagggttcaagacacggcccatgtggccgatgattgtgctgcgttcgccaaaaggctggaccgggccaaaggtagtggacagcgttcagattgaaggcacttttcgcgcgcaccaggttccgatggccgatatggataaaccggaacacatcaggattctggagcgctggatgaaaagttatcagccggagaaactcttcgatcaaaagggatccttgcgaccggaattggctgagttggcaccgaagggcgatcgacggatgagtgcgaatccgaatgcgaatggcggacaattgttgcgggatttgcaactgcctgatttttacgattacgccgtaaaagttttgcgaccgggggcggcgcaggtgtcagccacgaccgtgcagggacagttcatccgggatgttttgaggctgaatgaggagaggaaaaactttagagtgtttagtccggatgaaacggcatccaaccgctggagcgcggtgttcgaagtcacagaacgttgctcgacagctgaaattctaccgagcgattacaaagtgtcaccggatggccgcgtgatggaagtcttgagcgagcatatgtgccagggctggctcgagggttatttgttgacggggcgacatggtttcttttcctgctacgaagcgtttattcacatcgtcgattccatgttcaatcagcatgcgaaatggttggaggcgacgcgtcacattccgtggcgaaagccggtggcatcgctgaattatcttttgacgtcgcatgtgtggagacaggatcacaatggcttcagtcatcaggacccgggtttcatcgatgtggtggcgaataaacggtccgaggtgatacggatttatctgccgccggatgcgaatacactgttatcagtcacggatcattgtttgcgcagccgtaattatgtgaatgtgattgtcgccggaaaacagctcgcaccgcaatggctcgatatggatgcggccgtgaagcattgcacgttggggatcggcatctgggactgggcaagcaatgataagggatttgaacccgatgtggtaatggcctgcgcgggtgatgttccaacgatggagacgctggccgcagtggatttaatgcgcttgaactttccagatttgaagattcgaatggtgaacgtggtcgatttgatgcgtctgcagccggccagcgagcatccacatggaatgactgataaaaactttgacgttctttttacgaaggacaagccggtcatttttgcatttcatgggtatccgatgttgatccacaaattgacgtatcgccgtgccaaccactccaacatccatgtccgtgggtacaaggagagggggacgactacgacgcccttcgacatggtagttttaaatgaccttgatcgttttcacctggtgatggatgtcattgatcgggtgccaaagctgggttccagggcggcctacgttaaacaggcgctcctgcgcaagttaatcgaccataagcgatatatccgcgagcacggagaggatatgcctgaggtgagaaattggaagtggagcggagagaaatttggtgattga

SEQ ID NO: 308 - DNA, 2394 bp, Oxalobacter formigenes HOxBLS
atgaatgcggaaaagcttgatcagaacgcaaagccactctctcctgacatgctgaagaaaatagatgcctatttcaatgcagccaattatttgtcggtaggccagatttacctgtacaacaatccgttgctgaaggaacccctgactgctgacgatatcaagccgcggcttttggggcactggggaacgacgccgggcctgaattttatttacgtccacatgaaccgggtcatcaaaaaatacgatctggacatgattttcgtaacgggaccggggcatggcggtccggcactggttgccaacacgtatctggaaggaacctatagcgagttttacccgaatatttcggaagatgaagaagggatgaagaaactgtttacgcagttttctttcccgggcggcattcccagccatacggccgcggaaacgccggggtccatcaatgaaggcggtgaactgggctatgcgctttcccatgcgttcggcgcggcgttcgacaatcccgatctgatcgtgacctgtgtcgtgggagatggggaagcggaaacggggccgctggcgacagggtggcattccaacaagtttatcaatcctgtttatgacggcgcggttttgccgattcttcacttgaatgacgcgaaaattgccggcccgacagtattggggcgaattccgccgcaggaactggatgaactgatgcgcggttacggttatgagcctttttatgtggaaggttccgatccactggtcatgcatcagaaaatggccgccactctggacgtggtcgtcgaaaaaatcaggcggattcagtcggacgcacgccagaacggttttacgacgcgcccgcaatggcccatgatcgtgttgcgcagtccgaaaggatggacggggccgaaagtggtggatggccagcagattgagggaacgttccgggctcatcaggtgccggtcaatgaggtcaaaaacaatccggcgcacctgaaggttcttaacgagtggttgctgagttacaaaccgcatgaacttttcgacgaaaacgggaaactgaagcctgaactggctgaactggctccacggggcgaaaggagaatgggcgccaatcctcatgccaatggcgggattctcttgcgcgaactgcgtatgccggatttccgcaagtatgcggttgatgtgccttcgccgggggttgtcgtggctgagagcacccgtgttcagggcaatatgatccgcgatgttttcgtcctgaacgaagaagcgaaaaatttccgggtgttcagtcccgatgaaacctcatccaaccggtggaatgccgttttcgaggtaacggaacgcgcttccatggacgagatcaagtcgacagacgacaaggtgtcgcctaccggccgggtcatggaaatgctgtcggaacatcagtgtgaaggatggctggaagggtatcttctgactggtcgccacggtttcttcccctgttatgaagcgttcattcatgttgtcgattcgatgttcaaccagcacgcgaaatggctggaagtctgtcggcatatcccgtggcgccgtccgattgcgtcgttgaattatctgttgacttcccatgtctggcgtcaggatcacaatggcctgagtcaccagaatccggggttcatcgatctggtcatgaacaagaaagcggatattacccgtgtttatctgccgcccgatgccaactgcctgttgtcggtaaccgatcactgcatgcgcagccgtcaccgtatcaatgtgattgtggcagggaagcagccggccttgcagtatctgaacatggatgaggccatcaagcattgtacggccggtatcggcatctgggaatgggcaagtaatgacaagggggcggaacccgatgttgtcatggcctgttgcggtgacattccgacgctggaaacgctggcggcggtgaaaatcctgcgggagcatatcccggaattgaagatccgggtcatcaacgtcgtcaatctgatgacgctgcagcagccgggcgaacatccgaacggtctttccgacagggaattcgatgtgttgtttaccagggacaagcctgttatcttcgcttatcacggttatccctggctgatccaccggctgacctatcgccgcaccaatcacagaaattttcatgtgcgcggttacaaggaagagggaacgacgacgacgcctttcgatatggtcgtgatgaacgatctggatcgttaccatctggccggcgacgttatcgaccgtttgccgaatctgggttccaaggccgcctacacgaagcagtatctgcgtgaccgcttgctggatcacaaggcgtatgttcataaatatggcgaggatatgccggaaatccgggactggaactgggctgacggcaagtcctga

SEQ ID NO: 309 - DNA, 2397 bp, Oxalobacter formigenes OXCC13
atggctaaagcgggaaagcttgataagagcagtgaacctttgtcggttgacatgctgcataaaatgaatgcctatttcagtgcagccaattatttgtccgtcggacagatttatctgttcaataatcctttgttgcgcgaacctttaaagcctgacgatatcaagccgcgtttgctgggacactggggtacgacaccgggcctgaatttcgtttatgtccatatgaatcgtgtgatcaagaaatacgatctggacatgattttcgttaccggtccgggacatggtggtcctgctctggttgccaatacctaccttgaaggaacgtacagcgaattttatcccaacgtctccgaagacgaggaagggatgaaaaagctgtttacccagttttctttcccgggcggtattccaagccatactgccgccgaaacgccgggctcgatcaatgaaggtggcgagctgggatattccctgtcgcacgctttcggcgcggctttcgacaatcccgatctgatcgtgacctgtgtggtcggtgacggtgaagccgaaaccgggccgttggcgaccggctggcattccaacaaattcatcaatccggttttcgacggtgccgttttgccgattctgcatttgaatgatgcaaagattgcagggccgaccgttttgggtcgcattcctccgaatgagctggacgaactgatgcgtggttacggttatgaaccattttatgtcgaaggttccgatccgctgatcatgcatcagaaaatggccgcgaccatggatacggtcattaccaaaatcaggaaaatccaggacgatgcacgcaaaaacggtttcaaggaacgtccacagtggccaatgatcgttttgcgcagccccaaaggctggactggcccgcatgtcgtggatggacagcagattgagggcactttccgcgcgcatcaggttccggtcagtgaagtcaagacaaacccggcccatctgaaaattctgaatgaatggctcttgagctacaagcctcatgagctgttcgatgaaacgggtcgcctgatacctgaactggctgaactggcgccgaaaggcttgcgcagaatgggtgcgaatccccatgccaacggcggtattctgctgcgtgaattgcgcatgccggacttccggaaatatgctgttgacgtaccgtcaccgggtgttgtcgtcgccgaaagcactcgcgttcagggcaatatgatccgcgatgttttcgttcttaacgaagaagcgaagaacttccgcgtgttcagcccggatgaaacggcatcaaaccgctggggtgccgtttttgaagtcacggaacgttcctcgatggacgaaatcaagccgaccgacgacaaggtatcccataccggccgtgtcatggaaatgctgtccgaacatcagtgcgaaggctggctggaaggctatctgctgactgggcgtcacggtttcttcccttgctatgaagcgttcattcatgttgtcgattcgatgtacaaccagcatgcaaaatggctggaggtcacgcgtcatatcccatggcgtcgtccgatcgcatcgctcaactatctgctgacttcccacgtatggcgtcaggatcacaatggcctctcacaccagaatccgggtttcatcgatctggtgatgaacaagaaagccgacatcagccgtgtttatctcccgcctgatgcaaactgtctgttgtcggtgaccgaccattgtatgcgcagccgccatcgtatcaacgtcatcgtcgccggtaaacagcctgccttgcagtacctgaatatggatgatgcgatcaagcattgttccgccggtatcggtatctgggaatgggcaagtaatgacaagggttccgagccggatgtcgtcatggcatgttgcggtgatgtcccgacgcttgaaacgctggcagctgtcaagattctgcgtgaacgcttgcctgaagtgaagattcgcgtgatcaatgtcgtcaatctgatgacattgcagcagccgagtgaacatcctaatggtttgtcggacaaggaattcgacattctgttcaccaaggacaagccgatcatctttgcctatcatggatatccgtggctgattcatcgtcttacttacagacgaacgaaccatcagaatatgcatgtccggggctacaaggaagaaggtacgacaacgaccccgttcgatatggtcgtattgaacgatctggatcgttatcatcttgccggggacgtcatcgacagactgccgagcctgggttcacgggcggcttacaccaaacagtatttgcgtgacagacttctggaacacaaggagtatgtctacaaatacggtgaagacatgccgaatatccgtgactggaactgggcggatggcaagtcctga

SEQ ID NO: 310 - DNA, 2370 bp, Candidatus Solibacter usitatus Ellin6076
gtgtccgaagttacagttccgttaacgccagaagagttgcgaaaaatggacgcgtggtggcgcgcggccaactatctttcggtaggacagatctacctccacgataatccgctgctcaaactcccactcaccctggaacatatcaaaccccggctgcttgggcattggggcactacgccggggttgaacttcatttacgtacattgcaaccggctgatccgcaaatacgatctggacatgatctacgtgaccggaccggggcatggcggaccggggctcgtggccaatacatatctcgagggcacctatagcgagttctggccgcacatccccgagagcgccgagggcatgaagcggctgttcaagcagttctcgtttccgggcgggattccgagtcacgtggcgccggagacgccgggctcgatccacgaaggcggggagttggggtattcgctgctgcacgcgtacggcgcggctttcgacaatcccgatcttgtggtgtgctgcgtgatcggcgatggcgaagcggagaccggcgcgctagcgacgagctggcactccaacaaattcctcaacgccgagcgcgatggcgccgtgatcccggtgctccacctcaacggctacaagatcgccgggcccaccgtgctggcgcggatgccggagcaggagctgaccgatctgctaaagggttatggctaccggccctacttcgtggagggcgacgatccgccggcgatgcatcagaagatggcggcgacgatggatgccgtgatcgcggagatccggcgcatccagcacgaagcgcgctccgggggcgcggtctcgcaggccgcctggccggtggtggtgctgcgcacgccgaagggctggaccggtccgaaggtggtggacggaatccaggtcgagggcacgttccgcgcgcaccaggttccgctctcggaactcagcgccaagccggagcacattcgaattctcgagaattggatgaagagttaccggcccgaggagttgttcgacgagcacggcaagctggtcggggagattgcggagctcgcacccaaaggcgatcgccgcatgggcgcgaacccgcacgccaacggcggcctgctgctgaaggacctcgatatgcccgagttcggcgactacgcggtagcggtacccagtcccggcacggtcaaggccgaggccacgcgcgtgatgggccggctgctgcgcgatgtgatgaagcgcaatctggaatcgcgcaacttccgcgtggtggggccggacgagaccaactccaaccggctgggcgcgctgttcgaagtgaccgatcgagtctccatggaggcgattctgcccaatgacgatcacgtcactcacagcggccgtgtgatggaggtgctcagcgagcacatgtgcgaaggctggctggagggctatctgttgaccggccgccacggctttttctcctgctacgaagccttcatccacatcatcgattccatgttcaatcagcacgcgaagtggctgaaggtgacgcagcacattccctggcggcggccgatcgcgtcgctgaattatctgctgacgtcccacgtctggcagcaggaccacaacgggttcagccaccaggatccgggctttctggaccacgtggtcaacaagaaggcggacgtggtccgcgtctaccttccgcccgatgcgaacaccttactttccgtcaccgaccactgcctgcggagcaggaattatgtgaacgtgattgtcgcgggcaaagcgcccgcgctgcagtggctggatatggacgcggcgatcacgcactgcaccaacggcatcggaatctggagttgggcgagcaacgaccagggacaggagccggatgtggtgatggcctgctgcggcgatgtcccgacggtcgaaacgctggcggcggtggacctgttgcggcgcaatctgcccgatctgaaaatccgcgtggtgaacgtggtggacctgatgacgctacagcccgcgagcgagcacccgcacggcctttcggaccgcgatttcgattccatcttcaccaccggcaaaccggtggtcttcgcgttccacggctatccctggctgatccaccggctcacgtaccgccgtaccaatcacgtcaaccttcacgtgcgcggatataaggaagagggcaccaccaccacgccattcgatatgacggtgttgaacgacctggaccgcttccaccttgccatggatgtgctggaccgcgtgccgcgcgtacgcgatatcagcgcacatttgaagcaggcgctgcgcaacaagctgatcgaacacaagcactacgtcacgacgttcggtgaagacatgcccgaaatccgcgagtggacgtggaaggggtga

SEQ ID NO: 311 - DNA, 2388 bp, Pelodictyon phaeoclathratiforme BU-1
atggcactctctccactctcttctggcggcccgctatcggttgatgaactgcaacgcatcgatgcctactggcgtgcggcgaactatctctctgtagggcagatttacctgatggacaatccactgctccgggaaccactgaaacctgagcaggtcaagccgcgtttattggggcattggggaacgactccggggctcaattttatttacgctcatctgaatcgtgagatttgccagcgtgacctgaatgtgatctatcttgccggtccagggcatggcggtcctgctattgtagcaaatgtctggcttgaaggcacctacagcgagtattatcccaatatttcggaagatgctgcgggtatgaaaaaaatgttcaggcagttttcttttccaggcggtgttccgagccatgttgcgcccgaaactcccggttccattcatgaagggggggaactcggttatgcgctttcccatgcttttggggcagtttttgataatcctgatctggttgcggcctgtgttgtgggcgatggtgaagctgaaaccggccctctggctacatcatggcattcaaacaagtttctcaatccggcccgtgatggagcggttcttccgattctgcacctgaacgggtataaaattgccaatcccgcttttcttgcccgtctgccgcacgatgagctggagagcttgatgatcgggtatgggtacaaaccctgttttgttgaaggttctgatcctgcaatcatgcaccagaagatggctgccgcactcgataactgtttggacgagattgctgaaattcagcacgaagcacgggcgcatggagcaacggaaaggccgttgtggcccatgattgtgttgcgttctcccaaagggtggactggcccgaaagaggttgatggaaaaaaaactgaagatttctggcgttcccatcaggtgccgttttcagcggtgcgcgaaaatcctgcccaccttgcgctgcttgaagagtggatgaagagctaccacccggaagagctgtttactgccgaaggggcgctgaagccggaactgaaagaacttgcacccaaagggcagaggcggatgggtgataatcctcatgccaacgggggattgcttttgaagtcgctgcatatgcctgattaccgggagtatgcggtctcagtgtcctcacctggctctgtcagggctgaggcaacaagggtcatgggtacctttttacgggatgtcatgaagcagaatgagcatgattccaatttcagggtattcggccctgatgaaactgcatccaaccggcttggatcgctttttgaagttaccgaccgcacctggatggaaagcgttatgccctatgacgaaagtctttcccggaacggcagggttatggagattctttccgagcatacctgccaggggtggcttgagggctatctgctaacgggtcggcatggtttattttcctgctatgaggcctttatccacatcatcgattcgatgttcaatcagcacgcaaagtggctgaagataaccaatgatgaaattccctggcgtcgtcccatcgcctcgctgaactatctcttgacctcccatgtctggcagcaggacaataacggcttttcccatcaggatcccggttttattgatcatgtggtgaacaagaaggctgatgtgattcgggtctatcttccccctgatgccaatacgctgctctcggttaccgaccactgtctgcgttcgcgcaactatatcaatgtgattgttgccggtaaacagcccgcatggcagtggctcgacatggatgctgctgtaaggcactgcacgagcggcattggtatatgggagtgggcttcaaacgatgccgaagatggtgatccggatgtggttatggcctgcgccggggacgttcctacgcttgaaacgctcgcggctgtcgatattttacgggacaaaatccccgatctcaagattcgtgtggtcaatgttgttgatctgatgacccttcagcccagcgaagagcaccctcatggactcaaagaccgggatttcgatgatatttttaccaccgacaagccgatcatttttgcctatcatggttacccctggctgattcaccgtctgacttaccggcgtaccaaccataaaaatctgcatgtcaggggatacaaggaggagggaacaaccaccacgccgtttgatatggtggtgatgaacgatcttgaccgctttcatcttgtagccgacgttgtggagcgggttccccgtctcaggcagcgggcagcttacgtaaagcagcatgtgcgcgacaaactgattgcccacaaggagtatatccgtaaatacggcgaggatatgccggaaatcaggaactggcaatggacgcggtaa

SEQ ID NO: 312 - DNA, 2397 bp, Prosthecochloris aestuarii DSM 271
atgagcgatgcagtctgtgatcaaggttttctgcagcctctttctgctgaacagcttgaacgtatcaatgcatactggagggcggctaattatctttcggttggtcagatctatcttatggataaccctcttcttcgggttccactgcgtgcggagcatgtcaaaccgcgacttctggggcactggggaacgacgcccggcttgaacttcatctatgcgcatctcaatcgtgttatcagggcgcgtgatctcaatctgatttatattgccggccctggccatggtggtccggcgcttgtggccaatgtctggatggaagggacgtacagtcaatattatcctgatgtttctttcgatgaacaggggatgaaacgacttttccgtcagttttcatttcccggcggcataccgagccatgttgccccggaaacgcccggttcaatcaacgagggtggggaacttggctattgtctctctcacgccttcggagctgttttcgacaaccctgatcttgtcgcggcatgcgtcatcggagacggtgaggcagaaacaggccctcttgcagcagcatggcacagcaataaatttctcaatcccaggcgcgacggagcggtgctgccggtgctgcatctcaatggctataaaatcgccaatcctacgattcttgcccgtttaccccgacaagagcttgagcgtcttatgcgcggatatggatataacccctgttttgtcgagggcagtgatcctttcgtcatgcatcaggctatggcggctgccatggacaactgttttgacgagattcgagagattcagaggcaggcaaggcaggaggagggggtcgtcaagcgtcctctttggccgatgatcgtcctgcgctctccaaaaggatggacagggccaaaagaggtcgacggcaagaagactgaggatttctggcgttcccatcaggtgccgtttgctgcggtgagagaaaatccggaccatttgaagctgctcgaatcgtggatgaaaagctacaggcccgaggagctctttacatcggagggggagcttatagctgaacttcgcgagcttgctccgaccgggagacgtcgaatgggagataatcctcatgccaacgggggagtgcttctgcaggggttgcatatgcctgattttcaggactatgccgtcaaggttcccgagccgggttctgtgatcgccgaggcaccgataccgatggcccggtttctgcgcgatgtgatgcggctcaacgaatcagcagcgaatttcagggttttcggtcctgatgaaacggcctcaaaccgccttggcgatctttttgaagagactgatcgcgcctggatggctgagattattgctgatgatgaccatctttcacctgatggccgtgttatggagatcctttcggagcatacctgccagggatggctggagggctatctgctgaccggtcggcacggttttttttcctgttatgaggcgtttattcatatcattgattccatgttcaatcagcatgccaagtggctgaaggtgaccaacgatgaaattccatggagacggccgattgcatcgctcaactattttctgacatcgcacgtctggcgtcaggaccataacggtttttcgcatcaggatccaggttttatcgatcatgttgtcaataaaaaggctgatgtcatccgtgtctatcttccgcccgatgccaatactctgctctccataacggatcactgtcttcgttcgcgcaactatatcaacgtgattgttgccggtaagcagcccgcgttccagtggcttgatatggattcggccgttaaacactgttcaagtggtatcgggatatgggagtgggcgtcgagcgatatcgaagacggagatcctgatgtggttatggcctgcgccggcgatgttcctacgcttgagacgctcgctgcagttgatattctccgttcacaactgcccgatctgaagattcgggtcgtgaatgtgatcgacctgatgaccctgcagccgcaggaggaacatcctcacgggcttccggaccggcattttgatgacatttttaccacggataagcctgtgatttttgcctatcacggctatccctggctgatccaccggctcacctatcgcaggaccaatcatcgaaatctccatgtgcggggatacaaggaagaagggacgactacaacgccattcgatatggtggtgatgaacgatctcgaccgttttcatctggttgccgatgttgtcgacagggtgcctcgactgcgtcagagggcagcgtatgtcaagcagtatgtgcgagaccggctgatcgaacataagcagtatattcgaacgtatggagaggatatgcctgagatccgtgaatggaaatggaactggtga

SEQ ID NO: 313 - DNA, 2376 bp, Chlorobium limicola DSM 245
atgacacataccaatagttcgctgtctgaacgtgaacttgaactgatgcatggttggtggagagcggccaactatctttcggtagggcagatctacctgatgaacaatcctcttctcaaggaacctctttcaaaagaagacatcaagccccgtctgcttgggcactggggtacaactccgggcctcaatttcctctatgtgcatctgaaccgcatcatcaggaaccgcgacctcgacatcgtctatatcgccggaccggggcatggggggcctgcgctggtggcgaacgtctggttggagggcacttacagcgagtattatcccgacgtgtcgttcgacgaggctggcatgaagcgattgttccggcagttttcctttcccggaggcattccgagccatgtagctccggagactcccggttcgatccacgaggggggtgaactcggttatgcgttatcgcacgctttcggggcggtgtttgacaatcccgacctgatcacggcctgtgttgtgggcgacggggaggctgagacggggcctctggctacggcatggcacagcaacaagttcctgaacccaaagcgcgatggtgcggtgctgcctattctgcatctgaatgggtacaaaatcgccaacccgacagtattggccagaatttcgcatgaggagcttgaacagctcatgtttggttacggttacaggccgtatttagtcgagggagacgatccggtgacgatgcacggtaagatggccgccatcatggatagctgtttcgacgagatcgctgcaattcagcgacaggcgagagtggatggcgtgaccgagcgcccccgatggccgatgatcgtgttccgttcgccgaaggggtggacaggaccgaaagtggttgatggcaagcctgccgagggaaactggcgttcgcatcaggtgccattcagtacggtgcgcgacaatccggagcacatggctttgcttgaatcgtggctgaagagctaccgggctgaggagcttttttcgcctgacggggtgcttctgccggagctgcaggcgctggctccgaaaggacagaagcgcatgggcgacaatccgcacgccaatggcggtcttttgctcagggaactgcgtatgcccgatttccgcgactatgcactcgacgtcccgtcgccgggttcggtggaggccgaagcgccgaagccgatggcccgattcctgcgcgacattatgaagctcaacgagaaaacggccaacttccgggttttcgggccggacgagaccgcgtcgaaccgtctcggcgatctgtttgaggagaccgatcgtgcctggatggcccggaccctgccgtccgacgatcatctctctccggatggcagggtgatggagattctctccgagcatacctgtcaggggtggttggaagggtacctgctgaccggtcgccacggctttttttcctgttacgaggcgttcattcatatcatcgattcgatgttcaaccagcacgccaagtggctcaaggttaccgacagcgaaattccgtggcggaggcccatagcatcgctcaactatttcctgacctcccacgtctggcggcaggatcacaatggcttctcgcatcaggatccggggttcatcgaccacgtagtgaacaagaaagccgaggtgatccgtgtctacctgccaccggatgccaacacgttgctctcagtcaccgaccactgcctccggtcgcgcaactacatcaacgtgatcgtggcgggaaagcagccttcttggcagtggctcgacatggagtcctccatcaggcactgtacccgtggtatcggtgtctgggattgggcatcgaacgataccggggaagggcagcccgatgtggtgatggcctgcgccggggatgtgccgacgcttgaaacgcttgctgccgtcaagattcttcgtaacctttcgcccgagctgaagatcagggttgtcaacgttgtggatctgatgactcttcagccaaaggaggagcaccctcatggcctcgacgaccgtgagttcgacgatatgttcacgaccgacaggccaatcatctttgcctatcacggatatccctggctgatacaccgcctcacttaccggcgaaccaatcacggcaacatgcacgtgcgcggctacaaggaggaggggacgaccaccacgcccttcgacatggtggtgatgaacgaccttgaccgcttccacctggcagccgacgtggtcaaccgtgtagagtgcctgaagcctaaagccgcttacatcaggcaatatgttcgcgaccgcctgaccgagcataaggagtacatcacaaagtatggcgaagacatgccggaagtacgtgactggaggtgggtggattga

SEQ ID NO: 314 - DNA, 2514 bp, Chlorobium tepidum TLS
atgacgaaaggagggcggcaccggttcactggtgccaccctctcgtttaacgtgatgcacttgattgtaagatcggaaaatagagttccggatgaactccggactcagcatacaacaactatcaaatcaacaatactgatgactgaaatgacgactccgctttcccctcgcgaactcgatctgatgaacgcttactggcgagcggcgaactacctttccgtcggccagatttatctgatggacaatccactcctgaaagagccgctctccaaagaacatatcaagccccgcctgctcggccactggggcaccactcccggtctcaatttcctttacgtgcacctgaaccgcatcatccgcaaccgcgatcttgacattatctatatcgccgggccgggacatggcgggcctgcgctggtggcgaacgtatggctggagggtacctacagtgagtactatcccgatgtgtcgttcgacgaggcgggcatgaagcggctgttccggcagttctcgtttccgggcggtattccgagccacgtggctcccgcaacgccgggatcgatccatgagggcggagagctgggctatgcgttgtcgcacgcttacggcgcggtgttcgacaatcccgatcttgtcgcagcctgtgtcatcggcgatggcgaggcagagacggggccactggcgacggcgtggcacagcaacaagttcctgaacccgaagcgcgacggggcggtgctgccggttctgcacctgaacggctacaagatcgccaacccaacggtgctggcgcgcatttcgcacgaggagctggagcagctcatgattggctacggctacaaaccgtacttcgttgagggggatgacccggcgacgatgcaccagatgatggcggcgacgatggaccgctgcttcgatgagatcgccgaaatccagcgccgggcgagggtcgatggcgtgaccgagcgaccgatgtggccgatgatcgtgtttcgctctccgaaagggtggacggggccgaaggtggttgacggcaaacccgccgaggggagctggcgttcacaccaggtgccgttcagcacggtgcgagacaatccggagcacatggcgctgctcgaaacgtggctgaaaagctaccgtgccgaagagctgttcacagcggatggcgttcttcttcctgagttgcaggagctggctccgcgtggcaagaagcgcatgggcgatattccacacgccaacggcggcctgttgctcaaggagttgcggatgccggactttcgggaatatggaatcgatgtaccgaagcccggatcggtggaggccgaagcgcctaagccgatggcccgctttctgcgcgacatcatgaagatgaacgagaaggcggccaacttccgcgttttcgggccggacgagaccgcatcaaaccgccttggcgagctgttcgaagagaccgaccgcacgtggatggccgggatgctgccgaccgacgatcatctgtcgcgcgatggccgcgtgatggaaattctctcggagcacacctgccaggggtggcttgaaggataccttttgaccggacgccacggcttcttctcatgctacgaggcgttcatccacatcatcgactcgatgttcaaccagcacgccaagtggctgaaggtgactggtgccgaaattccctggcgccggcccatcgcttcgctgaactatttcctgacttcgcacgtgtggcggcaggatcacaacggcttttcgcatcaggatcccggttttattgaccatgtggtcaacaagaagtcgagcgtgattcgtgtttatctgccgccagacgccaattcgctgctgtcggtcacaaaccattgcctgcgctcccgcaattacatcaatgtgattgtggcgggtaaacagccagcgtggcagtggcttgacatggagtccgccgtgcggcactgtaccagcggcatcggcatctgggagtgggcctcgaatgacgcgaatgagggcgagccggacgtggtgatggcttgtgcgggcgacgtgccgacgcttgaaacgctggccgccgtcaagattctgcgcaaactcgcgccggagttgaagatcagggtggtcaacgtggtcgatctcatgactctccagccgaaagaggagcacccgcacggccttgccgatcgcgatttcgacgacatgtttactacagacaagccgatcatcttcgcctatcacggttacccgtggctgatccaccggctgacctaccgccgcacgaaccaccacaacctgcacgtgcgtggctacaaggaggagggcaccacgacgacgccgttcgacatggtggtgatgaacgagctcgaccgcttccacctggtagccgacgtagccaaccgcgtggagagcctcaggccacaagctgcctacatcaaacaatacgtccgcgaccgcctgatcgagcacaaggagtacatcacgaaatatggcgaggatatgccggaagtgagggattggcgctgggaggattga

SEQ ID NO: 315 - DNA, 2424 bp, Chlorobium ferrooxidans DSM 13031
atgatgagcaaccagacacaggaagaggtttttgcagcaccgctcacccaaaccgggcttcatgccattcacgcctgctggagggcagcgaactatcttgcggtggggcagatctacctgctcgataatccgctgctcctgcagccattgaagcccgaacatatcaagccccgtctgctgggtcactggggcacaacaccgggccagaattttatttacgtgcatctcaatagggcgattcttcagcgcaacctcgatatcatctacatttccgggcctggtcacgggggtcctgctgttgtggccaatgtctggcttgaggggacctacagcgaatactatcccaacatttcgcaggatgaggcaggaatgaaaaacctcttcaggcagttttcatttccaggaggaattccaagccatgttgcgcctgaaacgcccggctccattcatgaagggggtgagctcggctactcgctctcacatgctttcggtgcggtttttgataatcccgaccttgttgcagcctgtgttatcggtgacggagaagctgaaactggccctcttgcagcatcgtggcactccagcaaattcctcaatcccgcccgggatggcgcggtgctgccgattctgcatctgaacggctataaaattgccaacccctcactgctcgcccgcataccgcacgatgagctggaaagcctcctgaccgggtatggttacaaaccctattttgttgaaggatcagaggctgagccgatgcatcagaagatggcttcggtacttgacatctgccttgacgaaatagccgaaattcagtacgctgcccgcaagcagggactgcatgaacggccatgctggcctatgatagtattgcgcacgccgaaaggatggacaggcccgaaagaggttgacggcctgaaagtcgaggatttctggcgctcccatcagcttcccgttacagcggttcgggaaaatcctgcacacctccgcctgcttgaggagtggatgcgcagctaccgtcccgaagagctctttaccccttccggtgctccccagccggaactgatggcgcttgttccgaaagggaagaagcgtatgggtgacaatccccatgcaaacggagggctgctcctgaagtcgctgcggctgccggatttccgtgagtacggtgttgccgtgccctcacccggttcggtcagggccgaagcgaccatggtgatgggtgcctttttgcgtgatatcatgaaactgaatgaatcttccaggaatttccgggtattcggtcctgatgaaaccgcttcaaaccgccttgatgcactttttcaggtcaccgcccgatcatggatggagaatattctgccctatgatgagcatctttcgcccgacggcagggtgatggagattctttcagagcatacctgccagggctggcttgagggctaccttctgaccggcaggcacgggcttttttcatgctatgaagcctttattcatatcatcgactccatgttcaaccagcatgctaaatggcttaaaatcacctcgacgcaaattccctggcgcaggcctgtcgcctcgctgaactacctgctcacctcccacgtctggcgacaggaccataacggattctcccatcaggatcccggctttatcgatcatgtcgtcaacaaaaagtcgagtgtaatccgggtctatctgcctccggatgccaatacgcttctttcggtgaccgatcactgcctgaagtcgcgcaactatatcaatgtcattgttgccggcaagcagcctgaatggcagtggcttgacatggaggcagccgtccgccactgtgccttcggcatcagtatctgggagtgggcctcgaatgattcagccgacggtgagcccgatgtggtcatggcttgcgccggagatgttcccacacttgaaacacttgcagcggttgatattttgcgggaaaagattcccgacatcaaaatccgcgttgtcaatgttgttaatctgatgaccctgcagcctcgtgaagagcatcctcacggattgagtgacagggattttgatgatatttttacaaccgacaagccaataatttttgcctaccacggttacccatggctgattcaccggctggcctaccgccgtacaaaccataaaaacctgcatgtcaggggctacaaggaggagggaacaacgacaacgccatttgatattctggtgatgaacgatcttgaccgcttccatcttgttgccgacgtggtggagcgcgttgaccgtctccgggacagggcggcctatataaagcagtttgtgcgcgatatgcttatcacccacaaggagtatatccatgagcacggtgaggatatgccggagatccgtaactggaagtggaaaggcagaacgggtgcaacctcagcaggagattga

SEQ ID NO: 316 - DNA, 2430 bp, Chlorobium luteolum DSM 273
atgaatgcagaggatcctacgaaggaaagggaagaaacgaagagtgctctcacagcggcagaagccgatggactcaacgcctactggcgggcggcaaactatctttcggtgggacagatctacctgctcgcaaacccgcttctcctggaaccgctcgtcccggagcatgtgaagccgagactgctgggccattgggggacgacaccaggccagaatttcatctatgtgcacctgaatcgggtgatacgcatccgtgacctcaatatgatctacatttccggtcccggtcatgggggcccggcggtacttgccaacgtatggctggaggggacctacagcgagtattacccggcggtatcggaaaacgaggccggcatgaaaacgctgttccatcagttctcctttcctggcggtgtgccgagccatgtggcacccgagaccccgggttccatccatgaaggcggagagctgggctattcgctttcccatgcctacggagccgcgtttgacaatccggatctcatcgttgccgctgtcatcggcgacggggaagctgaaacaggaccgctgtcgacctcctggcactcgaacaagttcctgaacccatgccgtgacggggcggtgctgcccattctccacctgaacggctacaagatcgccaacccggcggtgcttgcccgccttccgcatgaggagcttgagaatctcatgaaaggctacggatacagcccccggttcgtggaggggtcggatcctcttgacatgcaccagaaaatggctgcggccatggacgcctgccttgatgacattaagggtatccagcaagctgccaggaacggcggcgtgagggagcggccggtctggccgatgattgtgctccgttcacccaaagggtggagtgggccgaaagaagtcgatggcaaaaaggtcgaggatttctggcgttcgcaccaggtcccgtttgccgaggtccgtacgaacccggcacacctccagctactggaggattggatgcggagctacaggcctgaagagctttttactccgtcgggtgctctccgggcggaactgaaggcacttgcgccgaagggaaagcggcggatgggtgacaacccgcacgccaacggcgggctgctattgagagatctcatgatgcatgatttccgtgacttcgccgtcatggtgccatctcccggtgctgtcgaggcggaggccacaagggttgcgggggcgttccttcgcgatgtcatgaaggagaatatggcggcggccaatttccgggttttcggccctgacgagacggcctcgaaccgccttggcttcctgttcgaggtgactgacaggacctggatggatgaggtcatggattatgatgaccatctggcgccggacgggcgtgtcatggagatcctctcggaacatacctgccaggggtggctcgaggggtacctcctgacgggtcggcatggattcttttcctgctatgaggcattcatccacatcgtcgattcgatgttcaaccagcatgcaaagtggctgaaagtatgcaagcaggaaatcccctggcggcggcctattgcttcgctcaactatcttctcacctcgcacgtatggcgccaggatcataacggtttttcccatcaggaccccggattcatcgaccatgtggtcaacaagaaggccgatgtgatacgcgtctacctgccgccggatgccaataccctgctttccgtcaccgaccactgcctccgttcgcgcgattacatcaacgtcatcgttgccggcaagcagccatcctggcagtggctggacatggaatcggccgtccgtcactgcacctgcggcatcggaatctgggagtgggcgtccagcgataccctggacggcgaccccgacgtggtgatggcttgtgctggtgacgtcccaacccttgagactcttgcggcggtagacatcctcagggagaaaatcccggatctgaagatcagggtggtcaacatcgtcgatctcatgaccctgcagccgccggaagaacacccccacggcctgaaggacagggacttcgatgacatcttcaccattgaccgtccgatcatctttgcgtatcacggatacccgtggctcatccaccggctgacctaccgccggaccaaccactacaaccttcatgtgcgcggatacaaggaggaggggaccacgagcacccctttcgatatggtcgtacgcaacgatctcgaccggttccatctggtggccgacgtggtggagcgggtgccgcggcttcgtcagaaagcggcctatgtgaagcagtatgtgcgtgacatgctgatcgcccataatgagtatatccgtacccacggtgaagacctgcccgaagtccgcaactggcagtggacccgtaccctgaaaccctcaaccgatggcttatga

SEQ ID NO: 317 - DNA, 2367 bp, Dechloromonas aromatica RCB
atgctgaccacacacacgccgctcgccgccgacgaactggatcgaatgaatgcctggtggcgcgccgccaactatctttcggtcggccagatctacctgctcgacaacccgctgctcaaaacaccactcacgctggcgcacatcaagccgcgtctattgggccactggggtacgacgccgggactgaacttcatctacgtgcatatgaaccgggtgatccggcagcacggtctgaacatgatcttcattgccggccccggccacggaggcccgggcgtggtggcgaatacctggctcgaaggcagctacagcgagttttaccagaatatttcacaggacgaggagggcatgcgccggctgttccgccagttctccttccctggcggcattcccagtcatgcctcgccggatacaccgggatcgatccacgaaggcggcgaactcggttacgcgctgttccatgcctatggtgcggtgttcgacaacccgcacctgatcacctgttgcgtcgttggcgatggcgaagcggaaaccgggccgctggccacctcatggcactccaacaaattcctcaatccgcgcaccgacggcgccgtgctgcccatcctgcatctcaacggctacaagatcgccaacccgaccatcctggcccggatcagccacaccgaactggaatgcctgttcgtgggttatggctaccagccgctctttgtcgagggcgacgatccgcaaaccatgcatcagttgatggcagcagccgtcgacacggcaatcgccagcattgccgccatccagcgccgggcgcgtgaaggcggcgacgaaagccggccgcgctggccgatgatcatcctgcgttcgccaaaaggctggaccgggccgaaaacagtcgacggcaagcagagcgaaggctcctggcgttcgcatcaggtgccgttcagcgacatggacaagccggagcatgtgcaattgctgggcgaatggatggcctcctacaaacccgccgagctgttcgacaaggatggccggctgatgcccgagatcgccgcactggcccccgctgggcaacggcgcatgggcgccaacctgcacgccaacggtggcgccttgctgcgtgacctgcgtctgccggattttcgcgactacgccgtggcggtgccgacgccaggtggctcagtggccgaggcgacgcgcgccatgggcgtcttcctgcgcgatgtgatgcgccagaacccggacaatttccgcgtcttcggtccggatgaaaccgcttccaaccgcctcggcgcgctgttcgaagtcaccaaccggacatggatggccgaacacctggctggtgacgaccatctggcgcccgatggccgggtcatggaagtgctttccgaacacgcctgccagggctggctcgaaggctacctgctgaccggccgtcacggcctgttctcctgctacgaagccttcatccacatcgtcgattcgatgttcaaccagcacgccaagtggctgaagatgtgtggcgagattccctggcggcggccgattgcctcgctcaacatcctgctcacctcgcacgtctggcgccaggatcacaacggtttctcgcatcaggacccgggcttcatcgaccacgtggtcaacaagaaggccgacatcatccgcgtttatctgccgcccgatgccaacaccctgctttacgtcaccgaccgctgcctgaagagccgcaatctggtcaatgtcatcgtcgccggcaagcagccggactggcagtggctggacatggaagccgcgatcaaccatgccagcgccggtatcggcctgtgggaatgggcttgcaacgaccagccgggcgaaccggacatcgtgctcgcctcggccggggatgtaccgacgctggaaatgctggctgccatcgacatcctgcaccgcatggtgccgaccctgaagatccgctatatcaatgttgtcgacctgatgaccctgcagccgcaggaagagcatccgcatggtctgtcgagcgacgaattcaattcgctgttcaccaccgacaagccgatcatctttgcttaccacggctatccgtggctgattcaccgtctgacctatcggcgcaccaacaccaatctgcatgtgcgcggctacaaggaagagggcaccacgacgacgcctttcgacatggtcgtgctcaacaatctggaccgctaccatctggtcatggacgtggccaagcgggtgccgaaactgcacgcccaggcggcgcacatcaagcaggccatgcgtgacaagctcaaccagcacacgcaatacatcctcgaacacggcgaagacatgccggaaatcctcgactggcaatggccgggagcgaagtcatga

SEQ ID NO: 318 - DNA, 2439 bp, Thiobacillus denitrificans ATCC 25259
atgtattcctttgaaccatataccgggcgtccaatcagacttgatctgctcgtgcacaaaggggagaccagcatggacgcgccgacacccgccacggccctgacatcggtggaactcgaacagctggacgcctactggcgcgcggccaattacctctcggtcgggcagatttatctgttcgacaatccgctgctcaaacagccgcttgaccgcgcccacatcaagccgcgcctgctcggccactggggaacgacgccgggcctgaacttcatctatgcccacatgaaccgcgcgatccgcgcccacgatctcgacatgatcttcatcacgggccccggacacggcggcccggctgtcgtcgcgaacacctatctcgaaggcagctacagcgagctctatcccaacatcacccgcgacgaggccggcctgcgccagctgttccgccagttttccttccccggcggcatcccgagccacgcggcgcccgagacgccgggctcgatcaacgaaggcggcgagctcggctattcgctgctgcacgcctacggcgccgtgtttgacaatcccgacctgatcgcctgctgcgtgatcggcgatggggaggccgaaaccggcgcgctcgcgacgtcgtggcattccaacaagtttctcgacccgcgcggcgacggcgcggtgctgccggtcctgcatctgaacggctacaagatcgcgaatcccgcgttcctcgcgcgcatcccgcgccacgaactcgaaagcctgctgacgggctacggctaccggccgattttcgtcgagggcgacgagccaagcgacatgcatcagaagatggccgctgcggtcgaccaggcgcttgccgagattcgcggtatccagcgccgggcgcgcgacggcggggagaccacgcgtccgacatggccgatgatcgtgctcgactcgcccaagggctggaccggaccgaaggaagtcgacggcaagaagaccgaggactactggcgttcgcaccaggtgccgttcggcgacctcgacaatcccgcgcacgtgcgcctgctcgatgactggatgcgcagctaccgtcccgaagaactgttcgacgccggcggcgcgttaaagcccgagctcgccgcgctcgcaccgacgggcgagcggcgcatgggcgccaacccgcacgccaacggcggcaagctcctgcgcgacctgcggctgccggatttccgcgactaccgggtcgagctggacgcgcccggcagcgtcgtcagcgagacgacgcgcacgctcggcgcctatctgcgcgacgtcgtgcgcgacaatcccgacaatttccgtctcttcggtcccgacgagacgcattcgaaccggctttcggcggtcttcgaggtcaccgaccgcacctgggtcgccgaacgctacccctacgacgaccatctcgcggccgacggccgggtcatggagatcctctcggaacacgcctgcgaaggctggctcgagggctatctgctgagcgggcgccacggcctcttctcgtgctacgaggccttcatccacatcatcgggtcgatgttcaaccagcacgccaaatggctcaaggtctgtaacgagattccgtggcgcgtgccggttgcctcgctcaacatcctgctcacctcgcacgtctggcgccaggaccacaacggcttctcgcaccaggacccgggcttcatcgaccacgtcgtcaacaagaaggccgacgtcatccgcgtctatctgccgcccgacgccaacacgctgctcgtcgtcgccgacaagtgcctgaggagccgcaatctcgtcaacgtcatcgtcgccggcaagcagcccgagcagcagtggctcgacatggacgccgcggtcactcacgctggcgtcggcgtcggcatctgggactgggcgtgcaacgaccagggcggcgagcccgacatcgtgctcgcggccgcgggcgacgtgccgaccatggaaatgctcgccgcgatcgacctcctgcgcacgctcgtccccgacctcaaaattcgcttcatcaacgtcgtcgacctgatgacgctgcagcctgcagaggagcacccgcacggcctgccggacgaggaattcgaccttctgttcacgaccgacaagcccatcctcttcggctatcacggctatccgtggctgatccatcgcctcacctaccgccgcaccaaccacgacaacctgcacgtgcgcggctacaaggaggagggcacgacgacgacgcccttcgacatggtcgtgctgaacgagctggatcgcttccatctcgtcatcgacgtcgcgcgccgcgtgccgaagctgcaggcccaggcggcgcacctgcagcagcagatgctcgacaagctcggcgcgcacacgcaatacatccacgcccacggcgaggacatgcccgagatccgggactggaaatgggcgcgctaa

SEQ ID NO: 319 - DNA, 2376 bp, Methylobacillus flagellatus KT
atgcaatcccaagccgcggaccatgtcctgaatgctcaacaattggcgcaattgcatgcctactggcgcgccgccaattatctctcggtcggccagatctacctctatgccaacccgttgctcaagacgcctttgctgccagagcatatcaagccgcgcttgctgggccactggggaacgacaccggggcttaatttcgtctatgtccacgccaaccgggtcattcgcgagcacgacctcaacatgatctacattaccggcccggggcatggcggtccggccgtcgtcgccaatacctacctggaaggcagttataccgagctttacccggaaatcaccgaggacgagaccggcatgctcaagctgttcaagcagttctccttccctggcggcatccccagccatgcctcggcgcagacaccggggtcgatcaacgagggaggcgaactgggctattgcctgctgcatgcgttcggcgcagtgttcgacaacccggacctgatcgcctgctgcgtagtcggcgacggcgaggcggaaaccggcccgctggccacctcctggcacggcaacaaattcctcaatcccaagaccgacggcgtggtattgcctatcctgcacctcaacggctacaagatcgccaaccccaccatcctgtcgcgcattggcgatgaagagctgcagaaactgttcgaaggctacggctacacgccctatttcgtcgaaggcagcgaccctgacttcatgcatcagcgcatggccagcgtcatggaccaggtcatcggggaaatacaacggatcaagcgcgaagccagcctgaaacgcgaagtcagccgtccgcgctggcccatgatcatcctgcgttcgccgaagggctggaccggacctgcggaagtggacggcaaaccgaacactggcacctttcacgcgcaccaagtgccgttcggtgagttagacaagccggagcacatcaagctgttgcaggactggatgcaatcctacgcgccgcacgaactgttcgacgatacaggcaggctcaaggaagagctgcgcgcgcttgcccccaagggcgaacggcgcatgggcgccaacccgcacgccaatggcggcctgctgctcaagcctctggcactgccggatttccgcaagtttgcctatgccgtgacccagccgggcgaacgccagaccagcaccacgggcgagctcggcaagtatctggccgaagtttggcggctcaatccgaacaacttccgcgtattcagcccggatgaaaataactccaatcgcctgcaggcattgttcgaggtcaccaatcggcaatggatggccgaacgtctggaaagcgacgagcatcttgcagcgcatggcggcgtgatggaaatactctcagaacatagctgcgaaggctggctggaaggttacctgctcactggccgccatggattcttttcctgctacgaggcatttatccatatcatcgactccatgttcaaccagcatgccaagtggctcaaggaatgtcgccacattccctggcgcaaaccgattgcctcgctcaacatcctgctgagctcgcatgtctggcgccaggaccataatggcttctcgcatcaggatcccggcttcatcgaccatgtcgccaacaaaaagccggacatcatccgcatctacctgcctgccgacgccaataccctgatcgcaatcaccgatcattgcctgcaaagccgcaacctcatcaatgtcatcgttgcaggcaagcaaccgcaagggcaatggctggacatgcccgccgcgattgaacatgcgcgccgtggcgccagtatttggcactgggccggcaactgcgcagcagacgaggaacccgacttggtcatcgccagcgcgggcgatgtgccggtcatggagtcgcttgccgccgtcatgctgttgcgcgagcatctgcccgcgctcaagatacgctacgtcaacgtggtcgacctcatgaccctagttcctcacgacgtgcatccacacggcctcaccgacgatgccttcgacgaactgttcacccgggataaaccagtgatcttcgctttccatggctatcctgggctgatccaccgcctggcctacaagcggcacaatcatgccaacttccatgtgcacggcttcctggaagaaggcacgaccactacgcctttcgacatgacggtgctgaacaggctggatcgctacaatctggtcaagaataccttgcgctggctaccgcatatcgacaatgctccggttctggatgcgctcatggacgaaaagctcgcgcaacacaagcaatacatctggcagcatggcgaggacatgccggaaatccgggattggaaatggcagcctgcagatcattga

SEQ ID NO: 320 - DNA, 2373 bp, Nitrosomonas europaea ATCC 19718
atgactcaactcccgcaacccctcactccggatgaactgcagaaaatcgacgcctactggcgcgctgccaactatctttcagtcggccagatctatctgcttgataacccactgctgcagaccccgctgacattgcagcatatcaagcctcgtttgctggggcactggggaacgacacccgggctcaatttcatttatgcccatctcaatcgcatcatccggcgtgatgatctgaacatgatctacatcgccggtcccggccacggcggacccgcactggtcgccaatacctacctggaaggcacttactccgaacattaccccgatatctcgcaggatatccagggaatgaaacacctgtttcgccagttctcttttcccggcgggatcggcagtcatgccacaccggaaattcccggttccatccacgaaggaggtgaactcggttatgcactctctcacgcctttggggcagtgttcgacaacccggatttgatcgcagcctgtgtcgtaggtgacggagaagccgaaaccgggccattggcaactgcctggcattccaacaagtttctcaacccggttcatgatggtgccgtgctgccgatcctgcatctgaatggctataaaattgccaaccccaccattctggcgcgtatcagccgtgaagaactggatcagctgttccagggctatggctatcagccctatatcgtcgaaggagaagatcctctgaccatgcaccagctcatggccggtacactggaccaggtactcgctgaaatcagatcgatccagaccagagctcgccttgatggtgtgacgcaataccctcgctggcccatgatcatcctgcgtaccccgaaaggatggaccgggcccgcaacagtcgatggactgaaaacggaaggctcctggcgttcccatcaggtaccgctctcggagctggcaaaaaaaccggaacatatccagcaactcgaagcctggctcagaagttaccgcccggaggaactattcgatactcaaggccggctggtcgaacccctgcagacactggcaccactcggcaatcgtcgaatgggtgccaaccctcatgccaatggtggatcactgatgaagcaattgcgtatgccggatttccggaaatatgcggtcgaaatcgtgcaacctggccagatcgaagccgaatcgacccggatcatgggcagtttcctgcgggatatcatgtgcctgaatctgaaaacctgtaatttccgagtattcggaccggatgaaacagcttccaaccggctgggaagcctgtatgacgtcacacccaaaacctggcttgccgaaacgctgcccgaggatgagcacctggcaccggatggacgggtaatggaaatcctgagtgaacatacctgccagggctggctggagggttacctgctgaccgggcgacacggcctgttttcctgctatgaagccttcattcacatcgtcgattcgatgttcaaccagcatgccaaatggctgaaagtcagcaaggaaattccatggcgcagacccatcgcctcactcaattacctgctgacttcccatgtctggcgtcaggatcataatggtttctctcaccaggaccccggctttatcgatcatgtgatcaacaaaaaagccgataccatccgcatctatctgccacctgatgcgaattgcctgctgtacattacggacaaatgtctgcgcagccgcaatttcgtcaacgtcatcgtcgccggcaaacagccacaactgcaatggctggatatggatgctgcgatcaaacactgcacggccggcattggtatctggggatgggccagcaatgatcaggctggcgaaccggatgtcgtcattgcctgcgccggagatgttcccaccatcgaagtcctggccgctgtcagcatcctgcgggaacatctgcccgacctgcgtatccgtgtgatcaatgtcgtcgatctgatgacgctgcagcatgaccgggaacatccacaaggactttccgacagggaattcgataccctgttcactacagacaaacctatcatctttgcctaccatggctatccctggctgattcaccgcctgacctaccgccgtaccaaccacgccaatctgcatgtgcgcggctataaagaagaaggaaccactactacaccgttcgatatgacggtactcaacgacatggatcgtttccatctggtcgatgatgtcatcgaccgtgttccccatctgggatacaaagcggcctatctcagacaaatcatgcgtgacaaactggtcgagcaccgcgaatacatcaatcgtcacggtgaagatatgccggaaatcagggattggaaatggactgcaccctga

SEQ ID NO: 321 - DNA, 2376 bp, Nitrosomonas eutropha C91
atgactcagactccacaatctctcacgccggatgaactgcaaaaaatagacgcttattggcgtgccgccaactacctttcagtcggccagatctacttgctcgacaaccccttgctgcaagctccgctgacattgcaaaacatcaagccccgtttgctaggacattggggaacgacacctggactcaatttcatctatgctcatctcaatcgcgttatcctacgtgatgatctgaatatgatctacatagctggtcccggccacggcgggcctgcgctggctgccaacacttatttggaaggcacttactctgaatattatcctgatatttcgcaggatatccaggggataaagcatctgttccgccaattttcctttccaggcggaattggcagtcatgccacgccagaaatccctggttccatcaatgaagggggggagctcggttattcactttcccatgccttcggtgcggtgttcgacaatccgggtctgatcgcagcctgtgtcgtaggtgatggagaagcagaaaccgggccattggcagctgcctggcattccaacaaatttcttaacccagctcaagatggtgtagtgctgccgatcttacatctgaacggctataaaattgctaaccccaccattctggcacgtattagccgtgaagaactgaatcagctgttctatggccacggctatcggccatacatcgttgaaggagaagatccactggccatgcatcagctcatggccagtacactagatcaggtattgactgaaatcagatcgatccaggcccaagcccgactcgagggcgtaacccggtatccccgctggcccatgatcatcctgcgcaccccgaagggatggactggacccaaaacagtcgatggcctgaaaatagaaggctcctggcgttcccatcaagtacccctctcagagctggcaaaaaaaccggaacatctccagcaacttgaagcttggctcaaaagctaccgtccagaggagctgttcgatactcacggacggctgattgaaccactccaggcattggcaccgcttggtaatcggagaatgggtgccaacccgcatgctaatggtggattactgaaagaaccactgcatatgccagatttccgggaatacgcggttgaggttgcacaacccggccagattgaagctgaagcgacccgggtcatgggcagcttcctgagagacatcatgcgcctgaatctaagaagctgtaactttcgggtatttgggccggatgaaacagcttccaaccgattgggaaacctgtatgaggtcacacccaaaacatggttggccgaaactttagctgaggatgaacacttggcgccagatggccgagtaatggaaattctcagtgaacacctttgtcaaggatggctggaaggctatctactgactgggcggcatggtcttttttcctgctatgaagcattcattcacatcatcgattcgatgttcaaccagcatgccaaatggctaaaaatcagcaaggaaatcccatggcgcagacctatcgcctcactcaattatttgctgacttcccacgtctggcgtcaggatcataacggattttcccatcaagatcctggtttcattgatcatgtgatcaacaaaaaagccgataccatccgtatttatctaccgcctgatgctaactgtctattgtatgtcacagacaaatgtctgcgcagcagtaatttcgttaatgtcatcgttgccgggaagcagccacaactgcagtggctggatatggatgccgcgatcaagcattgcacggccggtatcggcatatggggatgggccagtaacgaccaggacggcgagcctgatgtcgtcattgcctgcgccggagatgttccaactattgaagccctagctgctgtgagcattctacgtgaacacctgcccgacctgcgtatccgggtgatcaatgtcgttgatctgatgactctgcagcatcacctggaacatccgcaaggtctatctgaccgggaattcgacaccttgttcaccacagacaaacctatcatttttgcctatcacggctacccttggctaattcaccgcctaacctaccgtcgtaccaaccaccataatttgcatgtgcgcggctataaggaagaaggcactactaccacaccattcgatatggtggtacttaacgacatggatcgcttccatctggttgatgacgtcatcgaccgcgtttcccatctgggttataacgcagcctatctcagacaaatcatgcgtgacaaactgatcgagcaccgcgaatatatcaaccgccacggtgaagatatgccggaaatcagagattggaaatggacgacactaccgtga

SEQ ID NO: 322 - DNA, 2424 bp, Nitrosospira multiformis ATCC 25196
atgaaccgtgcttcgcctgcagtaaaaaccgaaagcaatccgctatccacggacgaactgcgcaagatcgatgcatactggcgagcggccaattatctctcggtggggcaaatctatctgctggacaaccccttgctcaaggagccccttaccgtcacgcacatcaagccgcgcctgctgggccattggggtacatgccccggtctcagttttatttacgcgcatctgaaccgcatcataaaaaaatttgatctggatatgttctatgtatgcggacccgggcacggtggaccggcaatggttgccaacacgtggctggaggggagctacagcgagttttatccccgtatctcccgggatgcaacaggcatgaagaggctgtttcggcagttttcctttcccggggggattccgagtcatgttgccccggaaacggcggggtcgataaacgaaggcggggaactgggttactcgctttcacatgctttcggggcggcctttgacaatccggatttgatcgtggcttgcgtggtgggcgatggggaagctgaaaccggaccgcttgccgcctcctggcactcgaacaagtttctcaatccggcccgcgatggagcggtgctgcctattctgcatctcaacggctacaagatcgcaaaccctaccatacttgcgcgcatcagccatgaggaactggaaagcctgtttgctggttatggctaccagccctatttcgtcgaggggtcggaccccgggcccatgcatcagtcgatggctgccgtgctggataccgcgatcgaaagtatacggagaatacagcgtgaggcgcgcagccgtggagtgaattcaggggagaggcaggaagccgtgacctatccccgctggccgctgattatcctgcgcagccctaaaggatggaccggaccggaagaagtggatgggaaaaagctggaagactactggcgctcacaccaggtaccccttgcggaactcggttccaagccggatcacctgaagcagctggaagactggatgaggagctacaaacccgaagagttattcgatgagaacggctgtctcatgccggaactggcggcgcttgcgcccgaaggggatcggcgcatgggtgccaatccccatgccaatggcggtctgcttctgaaagagctggaaatgcccgattttcgcagctatgccgttgacgtacccgtaccggggacggaagtgcgggaagccacgcgggaaacgggtaagtttcttcgcgatatcatgaaactcaatctggatagctccaactttcgggtaatgggaccggatgagaccagctcgaaccggcttgacgccctcttcgatgtaacagctcgagcctgggttgcgcagcagctgcctgaggatgagcacctctctcccgacgggcgggtgatggagatattgtccgaacacatatgccagggctggctggaaggttatctgcttaccggacgtcacggacttttttcctgctatgaggctttcatccacatcgttgattccatgttcaaccagcatgccaaatggctcaaggtcagcaaggaaattccctggcggcgacccatcgcctccctcaattatctcttgacatcgcatgtgtggcgccaggaccacaacggcttttcccatcaggaccccggttttattgaccttgtcgtcaacaagaaggcaagcatcattcgtgtctatcttccgccggatgcgaatacccttctttatattaccgacaagtgccttcgttcccgaaatttcatcaatgtcatcgtcgcgggaaaacagcccgcacttcagtggctggatatggatgcggccatcagacatggcagcgctggtatcgggatatgggggtgggcgagcaacgatcaggaggacgagccggatgtggtcatggcttgcgcgggcgacattcccaccctggagacgctggctgccgtggatctgctgcggcgccatgtcccggagttgaggatccgtgttgtcaatatcgtcgacctgatgaccttgcagcctcgatcggaacatccggacgggctttcagactgggacttcgatacgctgttcacgaccaataagcccatcattttcgcctatcacggctacccctggctgattcatcgcctgacttaccgtcgcaccaatcatcccaacctgcatgtgcgcggttacaaggaagaaggcaccacgactacccctttcgatatgacagtacttaacgatctggaccggtttcatctggtaatggatgtggcggaccgtgtacccaagctgagttccaaaggcgcttacctcaagcaactgatgcgcgacaagctgatcgaccataaacgctatatccggcaatacggtgaggacatgccggagatacgggattggcattggccttcacccggttcgtag

SEQ ID NO: 323 - DNA, 2415 bp, Nitrosococcus oceani ATCC 19707
atggaacaaagactgcaaaccgagcatgccaagagcaggatcgaggcgagtccgctggcagcggacgaactgcgcaacatggactgctactggcgggcggccaattatctgtcagtagggcagatctacctgcgggacaatccgttgcttaccgagccgctcacactggaacacgttaaggcacgattgctcggccactggggaaccaccccaggattgaatttcatctacgtgcatttgaaccgcctaattaaggcgtgtgatctcagtatgatctatgtgacgggacctggccacggcgctccggggctggttgcgaacacttggctggaaggcagttacaccgcagtttatccgaatattccccaggacgcggtgggcatgcagcggctgttcaagcagttctccttcccgggcggcgtgccgagtcacgtcgccccggaaacgccgggttcaatcaacgaaggcggcgaactcggctatggattagcccatgcctacggcgcagtgtttgacaacccggacctaatcgccgcctgtgtggtgggcgacggcgaggccgaaaccggccccctcgccacggcctggcattccaacaagtttctgaaccccgcgcgcgacggcgcagtgttgccgatcctgcatctaaacggctacaaaatcgctaaccccaccgtgctggcgcgcatcagccgcgaggatttggaaagcctgctcattggctacggctaccatccctatgtggttgaaggtgacgaaccggaacggatgcaccagctaatggcggccaccctcgaccaggtggttgccgaaatccatacgattcaacgggccgcacgcagccaaggcgccaccccctgcccgcgctggccaatgatcattctgcggaccccgaagggttggacaggcccgaaggaagtcgatggtaagaagaccgagggctactggcggtcgcaccaggtaccgttggcccaactggctgacaaaccggagcacctgcgactgctagagaaatggatgaagagttaccgtcccgaggaattgtttgacgagcaaggcaccctgcggccggaactggcggcgctggcgccacagggggagcggcgcatgggcgccaatccacacgccaacggcgggctgctactcaaggatctgcggctacccgagttccgggattatgccgttgacgtgaacggtcccggcgcaaagctggcggaggcgacccgggttatgggcggctatttacgcgacgtgatgaaactgaacatggatggccggaatttccgcgtgatgggaccggacgagaccaactctaaccgccttgatgccttgtttgaggcgactgatcgcacctggatggccgaaacgctgccagaggacgagcaccttgcgccggacggccgggtgatggagattctctccgagcacacctgccagggctggctggaaggctacctgctcaccggccgccatggcctattttcctgctacgaggctttcattcacattgtcgattccatgtttaaccaacatgccaagtggctcaaggtcaccggcaaggaaatcccctggcgccgccccatcgcctccctcaactacctgctgacctcccatgtgtggcgccaggaccacaacggtttttcacatcaggatcccggcttcatcgatcacgtggtgaacaagaaggcggacgtgatccgggtttatctgccaccggacgccaatacgctgctatgtgtcaccgaccactgcctacgttcgcgcaacttcattaacgttatcgtcgccggcaagcaaccccagccccagtggctcgacatggatgcggctgtcaagcactgcaccgcaggcatcggtatctgggagtgggccagcaatgaccagggcagcgaaccggacgtggtgatggcctgcgccggtgacgtgccgaccctggagaccttggcagcagtggatatcctgcgccgccatctgcctgaactcaaggtacgggtcatcaacgtggtggatctcatgaccctgcaggacaaagagcagcatcctcatggactctcgcacaaggacttcgatacgatctttaccaccgaccaacccatcatcttcgcctaccatggttacccctggttgatccatcgtctaacctaccggcgtactaatcacaaaaacctgcacgtacgcggttacaaggaagaggggacgaccaccacaccctttgatatggtcgtcctcaacgacatggaccggtttgacctggtggcagacgtcatcgatcgcgtgcccaagctgggatcgacggcggcatatctcaagcaatggctccgcgacaaacatatcgaacataagcaatacatcaccaagcacggggtcgacatgccggaaataacgcaatggcaatggggcaagagcagcgattga

SEQ ID NO: 324 - DNA, 2397 bp, Candidatus Protochlamydia amoebophila UWE25
atgataacaaagttgccccctactagtgaatctaacaatagtttatctgacgaactattagaaaaaataaatgcctattggagagctgctaattatttgtctgtcgggcaaatttatttgctcgataatcccttactaaaaaaacccctctctattaaagatattaaacctcgtttacttgggcactggggaacaacaccaggattaaattttatttatgtgcatctcaatcgaattatcaaaaaatttgatttagatatgatttatttgatcggccctggacatggaggacctgggattgtagcgaatacttatttagaaggaacctatagcgaatattatcctcacatttcccaagatgccgagggaatgcaaaaattgtttaaacaattttcttttcctggaggaattccaagtcatgtagctccggaaactcctggatcaattaatgaggggggagaattaggttattctctttctcatgcatttggtgcggcttttaataatcctgatttaatcgtaggatgtgttattggtgatggagaagctgaaacaggccccttagcaaccgcctggcactctaataaatttctcaatccagcgattgatggagctgtgcttcctattttgcatttgaatggctataaaattgcaaatcccactattttagctcgtatcagtcaagaagaacttaaaagcttgtttgtaggttacggttataaaccctattttgtcgaaggatcagatcctcaattgatgcatcgcctcatggccgaaacgcttgatatgataataaaagaaatccaggaaatacaaacaaacgctagaaaaaatggaatcgtcaaacgtccaatttggccaatgattattttacgcacacctaaaggttggacaggaccaaaagaagtagatggtaaaaaaacggaaaattattggcgatctcaccaagttcctttttcagatatgaaagaagaacatattaagcttttagaagaatggctaaaaagctatcgtccggaagaactttttgatgaaacaggtaaattattcccaattttagccgaattagctccaaaaggcaagcgaaggatgggagacaatttccatgcaaatggaggattattaagaaaaaatttacgacttccagatttccgttcttaccaattagaagttgtcactccaggagtggtcgaagcagagtcgactcgtatcatgggatctttcttaagggatgttttaaagttaaatcctcacaactttcttgtaactggtcctgatgaaacagcttcaaatcgtcttactaatttattcgaagttacgcaaagaaggtggcttgcagaatatttaccagaagacactgatgggggaaatttatctttagaagggcgcgtgttagaaattttaagcgagcatacttgtttgggatggttggaaggatatatcttaacagggcgtcacggctttttttctacctacgaagcatttgctcatattatcgactccatgtttaaccaacatgctaaatggctgcaaacaacactcacaataccttggcgagctcctatcccttcaataaacattttattaagttctcatgtttggagacaggatcacaatggcttttctcatcaggatccaggtttcatagatttagtcatgaataaaaaagctgccgttgtccgcgtttatcttcctcctgattctaacactcttttatcggtaacagatcattgcctaagaagtctaaattatatcaatgtgattgtcgctggaaaacaaccagctttacaatatctaagtatggaagcagcaatcaaacattgtacagcaggcataggaatttgggaatgggctagcaatgataaaggaggggaaccagatgttgttctcgcttgtgcaggagatatcccaaccctagaaattttggccgccgttgatattttacgacaaagcattcccactttgaaaattcgagtgattaatgttgtggatttaatgactttacaacccaaagaagagcatcctcatggtctttctaatacagactttgatgaaatgttcacgaccaataagcccattatttttgcttatcatggttatccttggctcattcaccgtttaacttatcgacgttcaaaccattctaacattcatgtcaggggttataaagaagaaggaacaacgacaactccatttgacatggtcgtattgaatgaagttgacaggtttcatttagtaggcgatgtaattgatcgagtcccaaaacttggatatttagcggcgtatactaaacaagagatgcgtcataaattgatcgaacataaagagtatattcatcaatttggagaagatatgccttcagtaaaaaattggaagtggccttacggcaaagaatga

SEQ ID NO: 325 - DNA, 2376 bp, Sinorhizobium meliloti 1021
atgaccaatacgctgtcgcccgaacttctggagcggatggacgcctattggcgagccgccaactacctttccgtggggcaaatctacctccgcgacaatccgctcctgaaacaaaaactcactttggccgatgttaagccgcgcctgctcggccactggggcaccacgccgggattgaattttctctatgtccacctgaaccggctgatccagacacatgacctgaatatgatctatgtcacaggtccgggtcacggtggcccgggtcttgtcgcaaatacctatcttgaaggaacctattcagaactctacccggaagtcagccaggacgaggccgggatcaagaggctcttcacgcagttttcctatcctgggggcattccgagccatgtggcggcggaggtgccgggttccatcaatgaaggcggcgagctcggctactgccttatgcatgcctacggcgccgtcttcgacaatcctgacctgatcgctgcctgcgtcgtgggagacggagaggccgagacgggcgcgctcgcgacgagctggcactccaacaagtttctcaatccggcacgagacggagcggtcctgccgatcctgcatctcaacggctacaagatcgcaaatccgaccgtgcttgctcgcatcagccacgacgagctggaggcgctgttcatgggctacggctacgagccgcttttcgtcgagggcgcggatccgcgacaaatgcaccagcttatggcgtcagcgctcgacaaggcccacggcaagattgccgaaatccagcggcaagcgcgaagtagaggattttccgaccgtcctgcctggccgatgatcatcttccgctcgccgaaaggctggacgggaccgcgcgaggtcgacggcaagaagacggagggcacgtggcgctcgcatcaagtgccgcttgcgaagcttgcggaagtgccggcacacctcggaattctcgaagagtggctcaagagttatcgcccttgggagctgttcgacgagagtggcagccttcgacctgagcttagggagcttgcgccgaagggcgaacgccgcatgggagcaaatccgcatgctaacggcggacttctcctgaaagacctcaacctgccggatttccgtcaatacgctgtagagatcgggattccgggaaccgtgacggcagaatcgacccgcaccgcgggcctttatctccgggatgtcatgaaactcaatgcgcaagagcgcaacttccggatcttcggaccggatgagacagaatcaaaccggctgtcacccgtcttccaagaaacagaccgcgtcttcaccggcgatattctcgctagcgacatgcagctatctcccgacggccgggtcatggaagtgctcagcgagcaactctgccagggttggctcgagggttacctgctgacagggcggcatgggttcttctcgtgctatgaggccttcatccacatcgtcgattctatgttcaaccaacatgcaaaatggttgaaagtctgccgggaggttccttggcgcaaacccatcgcgtctctcacctacctactgacctcccatgtgtggcgtcaggatcacaacggcttctcgcatcaggatccaggcttcatcgaccacgtggccaacaagaaggccgacatcatccgcgtctaccttccgccggatgcgaatacgcttctctcggtcgttgatcattgcgcgcggagccgtgactacatcaacgtgatcgtcgcaggcaaacagccgcagttgcagtggttggacatgggcgcggcggttgcgcactgccgggccgggcttggtgtctgggagtgggcctccaatgatgaaggcgatcccgatgcggtcgtcgcctgcgccggcgacgtgccgaccatggaagcacttgccgccgtgatgatcgtccgcgaggcgtttccgtcgctccggctgcgcgtcgtcaacgtcgttgacctcatggcgctgcaagcaccaagtcagcatccgcacggaattgcagatgacgcattcgatcggatgttcacgacggacaaaccggtcatcttcgcctatcacggctatcccgggctcattcaccggctgacctatcgacgcaccaaccatgccaacttccacgtccatggctatcaagaggaaggcacgaccacgacgcccttcgacatggccgtcctcaacaagcttgaccgtttccatcttgccaaggcggtggtcgaacgtgtcccctcgctcgcctcgccgagggaaggcttcgcccatttcgtcgaaagcaagctcgcggaacatgacgcctacatccgagagaatggcgaggatttgccggagatacgcaactggcgatggttggcgtccgccgttgacgctcagtga

SEQ ID NO: 326 - DNA, 2352 bp, Sulfurospirillum deleyianum DSM 6946
atgcaaaagcattatctggatgcgcacgaattagcgcaattagatgcctattggcgagcgtcaaattatattagtgtgggtcagatttacctgctagacaatcctctgcttaaaaaatctctgagccttcatgatgtcaaacctagactcttagggcattggggaacgactccggggcttaattttatttatactcatatgaatcgtttgattaatcatgatgacttaaacatgttttttatcgcaggccctgggcacggtggaccttctgtcgtggcacaaacctatttggaaggcgtatacagcgaggtttatcctaagattacgcaagatgaagtagggcttcaaatgttgtttaaacagttttcgttcccaggaggcattcctagccatgccgcacctcaaacgcctggttccattcacgagggaggagaacttgggtacgcactctctcatgcgtatggagcagtgtttgataacaaagatgtgatagcgtgttgtgtggtgggggatggcgaagctgagacgggtccacttgcgacatcatggcactccaataaatttttaaatcctaaaacagatggtgttgttttacccattttgcatctaaatggctataaaatcgccagtccaacgattctttctcgcatttcgcatgaggagttagaagcgctttttcgtggttatgggtatgagcctttttttgtggagggcgatgaaccagaggcaatgcattctaaaatggcagaagttttggatgtgatagtcaaacgtattcaaaccatttggcatgaggctcgagtgttaaacaaagaggaacgtccacgttggccgatgctcattttacgaacgcctaaggggtggagcggtcctaaagaagtggatgggctaaagagtgaggggcattgtaggtcgcatcaagtgccatttgctacgtttgggagtagcccagaacatttaactcttttagagagatggcttaaaagttataaacccgaagagctttttgatgaaaaaggcagactcttttcacacattgcttcttttgcgcctaagggtgaaaaacgcatgggcgcaaatcctcatacaaatggaggagcgttgttaaaacctttagttttgcctgattttaaagcgtatgcggtagatgttcctagtcccgctggagggctggcagaatccacccgtgttttaggtaactacttgcgggatgtgatggctcaaaacaggcagaattttcgtgtctttggccctgatgaaaccgcttcaaatcgcctaaacgcactttttgaagtgaccaatcgtacatggatggcgcaaaaagatagttttgatgagcacttaagtgcggatggacgggtgatggaaattctctcagagcatacctgtcaagggtggcttgaggggtatttactcacaggtcgtcatggctttttctcttgctatgaggcgtttattcatatcgttgattcgatgtttaatcaacacgccaaatggcttaaagtcaccagtcgtgaaatcccatggcgaaagcctatcgcttctttaaactaccttttaacctcgcatgtctggcgacaagaccacaatgggttttcgcatcaagaccctggatttattgatgtggtggtcaataaaaaagcacacattatcaatgtctattttccacccgatgctaacacgcttttatgggtgggagattggtgtttaaaaagcaagaactccattaatgtcattgtggcgggaaaacagcctgaagtgcagtggcttagtatgcctgatgccatagcgcattgcgaacaggggatgggcatttgggagtgggcgagtgatagaggtgagcctgatgtcattttggcatgttgtggtgatgttccaacccttgaaacgttagccgcagtgcgtcttttaagagagctggttcctagcgtgaagattcgagtggtaaatgtggtggatttaatggcgttacaacctcacagtgagcatccgcatggatggagtgatgaagcctacaatgcgctttttcctaaagatgttccgaccatttttgcctatcatggctatccgtggttgattcaccgtttggcatacaaacgagcgcaccatgagcatttacatgtaagaggttataaggaagagggcactaccacaactccttttgatatggtagttttaaacgacaccgatcggtttcatttggtgatggatgtgatgcatcgtgtctctaaaatgaaaccttatgaagaggaaatatgccaaaagatgactgaaaaattggcggagcataaggcgtatattgaaagatatgggattgatatgcctgaaattttagagtggcgatggaaatga

SEQ ID NO: 327 - DNA, 2424 bp, Mesorhizobium loti MAFF303099
atgaacgatcatacgacaatagcagcttccggtggccggctgtccgatcgcgagttgcacgatctcgacgcctattggcgcgccgccaactacctgacgattggccagatctacctgctcgacaatccgctgttgcgcgagccgttgcggctggagcacgtcaagccgcgtctcctcggccactggggaacgtcgcccggcttaagcttcatctatgcgcacctcaatcgcgcgatccggctcagggacgcgaatgtgatctatatctgcggcccgggacacggcggtccggcgatggtggcaaacacctatctggagggcacctacagcgagctcaatcccgacatcgcgatggacgagcaggggatgcgcaagctgttccggcagttttcgtttcccggcggtatcccgagccatgcggcaccagatgtgcccggctcgatccatgagggtggtgagttgggctattcgctgtcgcacgcctatggcgccgcctttgacaatccggatctcgtcgttgcctgcgtcgtcggcgacggtgaagcagaaaccggaccgctggcagccgcttggcattccaacaaattcctcaacccggcgcgcgacggagccgtgctgccgatcctgcacctgaacggctataagatcgcaaatccaaccattctggcccgcattcctgaagacgaattgcgcgcgctgtttgccggctacggctatgagccgctgtttgtggcaggccacgagccggccctgatgcatcagcgaatggcgactgtgctcgatgatgcgttcgatcgcatctcggctatcaagcatgcagcgcgcaatggatctggggcgactgggtcacgaccagaatggccgatgatcgtgttgcgcagccccaagggttggaccggtccgaaagaggtcgacgggctgaagaccgaaggcttctggcgctcgcaccaggttcccttgtcaggccttgctgaaaaccccgcccatctcaagctgctcgaggagtggctgaaaagctaccgaccggaggaactgttcgacgccgccggtgctcctgtcgcttcgatccgcgcgacggcaccccaggcaacgaaacgaatgagtgcaaacccgcacgccaacggcggcctgctgcgcaggtccctcgaactgccgggcttgcatgaccacgccgtttcactcgagcgccccggtgcagtcaaggccgagtcgacacgggtcatgggcagcttcctgcgtgatgtcatgcggttgaacgaggtcgcaaagaacttccgcatcgtcggcccggacgagacggcctcgaaccgtcttcaggacgtgtttgaagtgaccgagcgtggctggatggaaaagattctgcccgaagacgttcacctcgggcgcgagggccgggtgctcgaaatcctctccgagcacacctgccagggctggctggaaggctacctgctcaccgggcgccacggcctgttttcctgctacgaggcgtttatccacatcgtcgattccatgttcaaccagcatgcaaaatggctggatgcctgccgcgagatcccgtggcgccggccgatcgcatcactgaactatctgttgtccagccatgtctggcatcaggaacataacggcttcagccatcaggaccctggtttcatcgacgtcgccctcaacaagaaggccgacatcgtacgggtctacctgccaccggacgccaacaccttgctgtgcgtgaccgaccatgtgctgcagacctggaaccgcatcaacgtcatcgtcgccggcaagccgccgtcatggcagtggctgtcgatggacaaggcgatcgttcactgccgggcagggatcggcgtctgggactgggcatcaacggacgatggggctgagcccgacgtcgtgatggcttgcgctggtgacgtcccgaccctcgaaacgctggccgccgtgcagatcctcaggcagcaggttcctgatctcaggatcagggtggtcaacgtcgttgacctgatgacccttcagcccaaggaatatcatccacacggtctttcggatcgcgagttcgatgcgctgttcacccccgataaaccggtcatctttgcctatcacggctatccctggaccattcaccgcctgacctatcgacgcaccaaccatgacaacatccatgtgcgcggctacaacgaggaagggacgacgacgacacctttcgatatgacggtgctgaacggccttgaccgctttcatatcgtccaaagcgtcctcgactgggttccgcgactgaagggcgtgcgggtcagcctgaagcaggcgatggacagcaagctgcttgaacatcgggcctatatttgctcccatgggcaggatatgccggagattcttgattggaagtggggacaggatcccgatgcggcgccgaagcgtccggattga

SEQ ID NO: 328 - DNA, 2394 bp, Oligotropha carboxidovorans OM5
atggtagcggacacatccctgacggatcacgagcttggtctcattgatgcctggtggcgggcggccaattatctttctgtcggtcaggtttacctgctcgacaatccgctcttgaaaattccgctcgctatcgagcacgtcaagccgcgtctccttggccactggggaacggtgccggggcttaacttcatctacgcgcatctcaatcgtctcatcaaggcgcgagacctgaacattctgtttgtgactgggcccggtcatggcgctccgggaattattgcgaacgcttatctcgagggcacctacagcgaactctgtcctgcaatcacgcaggatattgaaggcatcaagcgcctgttccgccaattttcgtttcccggtggtgtgccaagccacaccgcacctgaaacgccgggctctatccatgaaggtggtgagctcggctactcgctatcccatgcttttggagcggcgttcgacaatccggaattgattattgcttgcgtggtcggcgacggggaggccgagaccgggccgcttgctgccgcctggcacagcaacaagtttctcaacccggcgtccgatggtgccgtgctgccgatccttcatctcaacggctacaagatcgccaacccaaccgttcttgcgcgcattccttcggaggaaattcgcgccttgtttgaaggttacggatatgcgccgatcttcgtagaggggcacgatcatttccagatgcatcggaagatggcgttggcgctctcaactgccttctccgatatcgcaaaaatccaaaaaacagcccgaagcgaacgtaatcctgagcggccgcgttggccgatgattgttctgcgaaccccaaagggatggtccgggccgaagacggtggatggccagaagaccgaaggatcatggcgatcgcatcaggtccctttcagtaacatacgagcccccggtcacctgcagcttctggagaactggcttcgaagctaccttccggagcggctgttcgatgatcttggccggctttgccccgagatcgcggccctcgcgccggaaggggcaaagcggatgagcgccaaccctcatgcgaatgggggcaccaaaaggcggccgctctgccttcctgacttcacgtcattcgcggttgatgtggaagctccaggacaggtcgacgcggaggcaacgcgcgtgctgggtggcttcctccgcgacaccatggcggcgaacaaagccaaccgcaatttccgcgtattcggtccggacgagacagcttcaaatcgactacaggctctgttcgacgttaccgaccggtcatggaatgccgaaataatcccggacgatgatgaccttggtcccgatggccgcgtcatggagattctgagcgaacacacctgccagggatggctcgaaggctatctgctgaccggccgccacggcttcttctcttgctatgaggccttcattcacattgtagattcgatgttcaaccagcatgccaagtggctgaaaaccgctcgggaggtgccatggcgccagccgattgcctcgttgaattatttgctcacttcgcacgtctggcagcaggaccacaatggtttcagccatcaggatcccgggttcatcgatcacgtcatcaacaagaaggccgatatcgtccgcgtttatctgccgcccgacgcaaacactctgctgtatgtggccgatcactgcctgcggagctgggatcgcgtcaatgtcatcattgctggtaaggcgccgagcccgcagtggctctcgatggatgctgcgatcaaacactgcacggaaggaatcggaatttgggaatgggccagcaacgatcgcggcagcgagccggacgtcgtcatggcgtgcgcgggtgacgtgccgacgctggagacgcttgctgctgtcgatttgctggagcagcagattccggaattgaaaattcgggtcgtgaatgtcgttgatctgatgacgctgcaatcaaaagaacagcatccgcacgggctggccgacaacgatttcgatgcgctgttcaccacggacaagccggtgatctttgcttatcacggctatccgacgttaattcatcggctgacctacaaacgtacaaatcaccacaatatccatgtgcggggctatgaagaggagggctccacgacgacctcctttgatatggctgttcggaacaggatcgatcgatttcatctgattgcggctgtcattgactgggtgccgcagcttggcgcggccgccgtctacaccaaacaggctattcgcgacaaactggttgagcacgagcgtttcatccgtactcacggcgtcgatctgcctgaggtgagaaactggcgatggaaaggtgcacagagacccgccacagacgcctttcgttga

SEQ ID NO: 329 - DNA, 2388 bp, Beijerinckia indica subsp. indica ATCC 9039
atggatgatcgcgcgcacggtccggccggaatcagtcagcctctctcgccggatctgttgcagcgtctcaatgcctggtggcgcgccgccaattatctctcggtggcgcagctctaccttctcgacaatccgctgttgcggcaaaagctcaccctggatcatatcaagccgcgcctgctcggccattggggcacgacaccggggctcaatttcatctatgtgcatctcaacaggatcatcaaggaacgcgatctcgatattctgttcattgctggccccgggcatggcgcgccggggctcattgccaatagctggctggaaaagacctatagcgaggtctatcccgctgtttcgcaagatatcgaaggcatgacccggctatgccgccaattttcattccctgtcggcatcccgagccatgcggcgccggaaacacccggctccatccatgaaggcggcgagcttggctattcgctctcccatgcctttggcgcggtctttgacaaccccgacctgatcgcggcctgcgtgatcggagacggcgaggcggaaaccggcccactcgccacgtcatggcatgccaataaatttctcgatgccgcgcgtgatggcgccgtgctgccgatccttcatctcaacggctataaaatcgccaatcccaccgtgctcgggcgcatcccgtccgatgaattggaaaatctgctgcaaggctatggctatgcgccccttttcgtcgaaggcgacgacccggacattatgcatcggcacatggccgaagcactaaatgtcgcttttgcgggtattgccaaaatccagcgagccgcacgtgtcgagggccatatcgagcggccacgctggcccatgctggtgctccgcagccccaagggctggaccggccccaaaacggttgacgggttgaagacggaaggattttggcgtgcccatcaggtcccattcaccatcgccgacaagcctgaacatctctcgcttctcgaaagctggctgaaaagctaccgaccggaggagcttttcgaggaaagcggcgccctcaagccggagattgcttccctggcccccagcggggagcgccgaatgagcgccaatccgcaggccaatggcggcaacttgccacggccgttgcaaataccggattttaccctgcatgccgtcgatgtcgattaccccggcgcacgaacggcagaggcgactttcgttatggggcaatttctgcgcgacatcatgcgcgccaatgagacaaacaagaatttccgcgtcttcgggccggatgaaaccgcctccaaccgtttgcaggcgctctacgacgtcacggacaagacctggaatgccgccttcatcgcggaggatgaacatctcgacccgacgggccgcgtcatggaaatcctcagcgaacatacatgccaaggctggcttgaaggctatctgctcacggggcgccatggcctcatgtcttgttatgaggccttcattcatattgttgattccatggtcaatcagcacgccaaatggctcaagacggcgcgtggtgtcccatggcgtcggcccatcgcctcgctcaattatcttctaacgtctcatgtctggcgccaggatcataatggctttagccatcaggatcccggtttcatcgatcatatcgccaacaagaaatccgatatcgcgcgcgtttatctaccgccggatgccaattgccttctctatatcaccgatcattgtctgcgcagctggaacaggatcaatgtcattgtcgccggcaaacagccggaaccgcaatggctcgacatggaggaagcgatcagccattgccgcgccggtctcggcatctggagtttcgctagcaatgatcaagatagcgagcccgatgtggtcctcgcctgcgccggcgacgtgccaacgctcgaaaccctcgccgcagccgatttcttgcatacacatctgccggaggtgaaagtccgtgtcgtcaatatcgttgatctgtttgcgctagagccgcaaacacgccatccgcatggctggagcgataaggattttgatacgctgttcaccaaggacaaaccggtgatcttcgcctatcatggttatccttccctcatccatcggctgatctacaagcggaccaaccattccaatttccacgtccacggctatcaggaagagggttcaacgacgacacccttcgatatggtggtgcgcaaccggctcgatcgttttcatctcgtcggcgacgttgtcgatcatctaccgaagctcggcgccaaggcggcctatgtcaaacaatggctgcgtgacaagttcgccgagcacgaacgctatatcgtggcgcatggcgaggatttgccggagatccgtcattggcgctggccagaatga

SEQ ID NO: 330 - protein, 810 aa, Gluconacetobacter diazotrophicus PAl 5
MTSAPRMSVSEGTKMNEMSPLSTAPLTATPLSAAELGLFNRWWHAANYLSVGQIYLLANPLLREPLKLEHTKPRLLGHWGTTPGLNFLYLHLNRIIRARDANILFIAGPGHGAPGVVANTYLEGTYSEYFPEVSQDENGLGRLLKQFSFPGGIPSHAAATTPGSIHEGGELGYSLSHAYGAVFDNPDLIVACVIGDGEAETGPLATSWHSNKFLDPQTDGAVLPILHLNGYKIANPTILARIPQPELEALLRGYGYDPIFVEGHDPDPMHQKMATAMDLAFDRIAAIQKAAREGGQTERPTWPMIVMRSPKGWTGPKEIDGLRTEGYWRSHQVPFSDLTKPGHLQALETWLRSYKPEDLFDESGRLFADIAALAPSGARRMSDNPHANGGQLRHPLKLPDIANYAVPVTTPGSVTGEGTRVLGTWLRDVMKENLPSRNFRVLAPDENNSNRLNAVLDVTNRAWNAETVDYDDHLARDGHVMEILSEHTCQGWLEGYLLTGRHGFMSCYEAFIHIVDSMVNQHAKWLKTSAEVPWRRSISSLNYLLTSHVWRQDHNGFSHQDPGFIDHVINKKADIVRVYLPPDANTLLCTAAHCLHSWDRINVIVAGKQPEPQWLSMEDAIRHCSAGIGIWEWASNDKGSEPDVVMACAGDVPTIETLAAVKLLREHAPDLKIRVINVVDLMTLESASQHPHGLTDSAFDALFTLDKPVIFAFHGYPQLIHKLIYRRANARNFHVHGFREEGSTTTPFDMVVRNHLDRFHIVSNVIDRVPGLATRAAYAKQAIRDKLVDHTRYIAEYGRDMPEIEDWRWS

SEQ ID NO: 331 - protein, 788 aa, Shewanella loihica PV-4
MSQQQEITALKKFVRATNFLATSQIYLKQNVLHKRPLEHSDIKPRLLGHWGTCPGINFVYANVNRLIKKTNRPFLYLVGPGHGFPAVQANLFMEGSLSHFYPETIPYNETGIEDICKKFSAAYGYPSHANPEAPGQILEGGELGYSLSVAWGAVLDNPNLIATVLIGDGESETGPLAASWYANRLVSPANNGAVLPIVHINGYKISGPTRMGRMSHEELELEFKGLGYHPIIVDSDLEEDVYVQMTKAMDESYAMIEAIQTKARSGEDVVKPRWPVILMRTAKGWTGVAEDNGKKLEGNCESHQVIVNKCAKDKQHLEALDQWLASYKFNELYSINEQNQIVFDKDIQSLLPPKELCCGRQHLSYGGEVVRSLNNPKLEDLAYGAETPRGQRGYSMLKMGQWMRDAFKLNRDQRNLRIFSPDETYSNQLQAVFEETDRAWQWPIESWDEDMSRDGRVLELLSENLLFGMLHGYTVTGRHGMFPTYESFSQVVSSMADQYCKYVYASQGVHFRKPVPACNVVLSSLLERQDHNGYSHQNPSFLGAMLEKHPEIISAYLPADANSTLVYTERAFADRDKLNIIAAGKKELPQWLTLDEARQQAKDGVMVWDFASDENPDVVLAGCGDYVTQECMASLVILRELLPRVRVRFVSVTELTSSGLGSRKFQSKPWMMDEIFTADKGVVFNYHGYPNTIKKLVFDYKGSHRFRIKGYEEEGSTTTPFDMGVRNGTSRYHLVIDMAYKLFQQGVIDETQHVAITTDMLQRLVDHRNYIKANGVDPENIENWIWTR

SEQ ID NO: 332 - protein, 788 aa, Shewanella amazonensis SB2B
MTQQHEITALKKFVRATNFLATSQIYLKQNVLHKRPLVHGDIKPRLLGHWGTCPGINFVYANVNRLIVKHKRPFLYLVGPGHGFPAVQANLFIEGSLSHFYPETIPYNETGIEDICKKFSAAYGYPSHANPEAPGQILEGGELGYSLSVGFGAVLDNPDLIATVLVGDGESETGPLAASWYANRLVNPATCGAVLPIVHINGYKISGPTRMGRMSHEELDLEFRGLGYHPIIVDDQLEEDVYEQMVKAMDLSYEMINDIQTRARNGEDVCKPRWPVILMRTAKGWTGVAEDKGKKLEGNCESHQVIVNKCATDKGHLEALDNWLASYGFAELCSVTEQGELQFDPDIKSLIPPKELCCGRQRLSYGGEVVRALTNPDLTKLAYGAEVPRGHRGYSMNKMGEWMREAFKLNRDQRNLRIFSPDETYSNQLQAVFEETDRAWQWPIESWDQDMSRDGRVLELLSENLLFGMMHGYTVTGRHGMFPTYEAFSQVVSSMADQYCKYVYASQGVHFRKPLPSCNVVLSSLLERQDHNGYSHQNPSFLGAMLEKHPEIISAYLPADANSTLVYTERAYADRDKLNIIVAGKKELPQWLTLDEARRQAKDGLMIWDFASDDNPDVVLAGCGDYATQECMASLVLIRELLPRVRLRFVSVSELNSNGLGSRKFQQKPWMMDEIFTKDKGVVFNYHGYPNTIKKLVFDYKGSHRFRIKGYEEEGSTTTPFDMGVRNGTSRYHLVIDMAYKLFQQGIIDETQHVAITTDMLQRLVDHKNYIKANGVDPIHIENWVWTR

SEQ ID NO: 333 - protein, 788 aa, Shewanella sp. MR-4
MTTTHEINALKKYVRATNFLATSQIYLKQNVLHKRPLAHSDIKPRLLGHWGTCPGINFVYANVNRLIVKHNRPFIYLVGPGHGFPAVQANLFIEGSLSHFYPETIPYNETGIEDICKKFSAAYGYPSHANPEAPGQILEGGELGYSLSVGWGAVLDNPDLIATVLVGDGESETGPLAASWYANRLVSPATNGAVLPIVHINGYKISGPTRMGRMSHEELDLEFRGLGYHPIIVDSEAEEDIYIQMATAMDTAYSMINDIQTRARKGEDIVKPRWPVILMRTAKGWTGVSEYNGTKLEGNCESHQVIVNKCATDKGHLAALDSWLASYQFQELYQINGQGELIFDADISSLIPPKHLACGRQHLTYGGEVVRALSNPDLEKLSYGPEVPRGHRGYSMLKMGQWMRDAFKLNRDQRNLRIFSPDETYSNQLQAVFEETDRAWQWPIESWDEDMSRDGRVLELLSENLLFGMLHGYTVTGRHGMFPTYESFSQVVSSMADQYCKYVYASQGVHFRKPLPACNVVLSSLLERQDHNGYSHQNPSFLGAMLEKHPKIISAYLPADANSTLVYTERAFADRDKLNILVAGKKELPQWLSLEEARKQAKDGVMVWDFASDENPDIVLAGCGDYVTQECMASLVIIRELLPRVRIRFVSVTELSSDGLGSRKFKEKPWMMDEIFTQDKGVVFNYHGYPNTIKKLIFDYKGSRRFRIKGYEEEGSTTTPFDMGVRNGTSRYHLVIDMAYKLFQQGVIDETKHVSITTDMLQRLVDHRNYIKANGVDPVEIENWIWTR

SEQ ID NO: 334 - protein, 788 aa, Shewanella baltica OS155
MTQIHEINALKKYVRATNFLATSQIYLKQNVLHKRPLAHTDIKPRLLGHWGTCPGINFVYANINRLIVKHNRSFIYLVGPGHGFPAVQANLFMEGSLSHFYPETIPYNETGIEDICKKFSAAYGYPSHANPEAPGQILEGGELGYSLSVGWGAVLDNPDLIATVLIGDGEAETGPLAASWYANRLVSPATSGAVLPIVHINGYKISGPTRMGRMSHEELDLEFRGLGYFPIIVDNELEEDIYVQMTNAMDTAYAMINDIQRRARSSEDVVKPKWPVILMRTAKGWTGVSEYKGKKLEGNCESHQVIVNKCATDKGHLDALDNWLASYNFQELYQMNDKGELIFDADICSLIPPKQLACGRQHLTYGGEVVRALTNPDLEKLSYGPEVPRGHRGYSMLKMGEWMRDAFKLNRDQRNLRIFSPDETYSNQLQAVFEETDRAWQWPIESWDEDMSREGRVIELLSENLLFGMLHGYTVTGRHGMFPTYESFSQVISSMADQYCKYVYASQGVHFRKPLPSCNVVLSSLLERQDHNGYSHQNPSFLGAMLEKHPKIISAYLPADANSTLVYTERAYADRDKLNILVAGKKELPQWLSLEEARKQAKDGVMVWDFASDENPDIVLAGCGDYVTQECMASLVLIRELLPRVKIRFVSVTELSSDGLGSRKFKEKPWLMDEIFTQDKGVVFNYHGYPNTIKKLIFDYKGSRRFRIKGYEEEGSTTTPFDMGVRNGTSRYHLVIDMAYKLFQQGVIDETMHVSITTDMLQRLVDHRNYIKANGVDPIEIENWIWTR

SEQ ID NO: 335 - protein, 792 aa, Shewanella benthica KT99
MGLFMSQQQEIGALKKFVRATNFLATSQIYLKKNVLHKRALEHTDIKPRLLGHWGTCPGINFVYANINRLIVKNNRSFVYLVGPGHGFPAVQANLFMEGSLSHYYPETIPYSEEGITDICQKFSAAYGYPSHANPEAPGQILEGGELGYSLSVAWGAVLDNPDLIAACLIGDGESETGPLAASWYANRLVDPATNGAVLPIVHINGYKISGPTRMGRMSHEELDLEFRGLGYFPIIVDDQNEEDVYVQMINAMDKSYEMITDIQKRARSGEDVVKPRWPVILMRTAKGWTGTAQYDGKKLEGNCESHQVIVNKCATDKGHLDALNTWLGSYKFSELYSINDKGELIFDEEIQSLLPPKQLTCGQQHLSYGGEVVRALTNPDLSKLAYGPETPRGTRGHSMYKMGEWMRDAMKLNRDQRNLRIFSPDETYSNQLQAVFEETNRSWQWPIEEWDTDMARDGRVIELLSENLLFGMMHGYTVTGRHAMFPTYEAFSQVISSMADQYCKYVYASQGVHFRKPVPACNVVLSSLLERQDHNGYSHQNPSFLGAMLEKHPKIISAYLPADGNTTLVYTERAFADRDKLNIIVAGKKDLPQWLSLDEARAQVKDGVMVWDFASDENPDVVLVGCGDYVTQEAMASLVLIREILPRVRIRFVSVTELTSSGLGSLDFQSKPWLMDEVFTADKGVIFNYHGYPNTIKKLVFDYKGNNRFRIKGYEEEGSTTTPFDMGVRNGTSRYHLVIDMAYKLFQQGVIDETQHVTITTDMLQRLVEHRNYIKENGVDPISLDNWVWTR

SEQ ID NO: 336 - protein, 788 aa, Shewanella sediminis HAW-EB3
MSQQQEISALKKLVRATNFLATSQIYLKKNVLHKRALAHTDIKPRLLGHWGTCPGINFVYANINRLIVKNSRSFVYLVGPGHGFPAVQANLFMEGSLSHYYPEIIPYNEEGITDICQKFSAAYGYPSHANPEAPGQILEGGELGYSLSVAWGAVLDNPDLIAACLIGDGESETGPLAASWYANRLVDPATNGAVLPIVHINGYKISGPTRMGRMSHEELDLEFRGLGYHPIIVDDELEEDVYVQMANAMDTSYEMINDIQKRARSGEDVVKPRWPVILMRTAKGWTGTAEYNGKKLEGNCESHQVIVNKCATDKGHLEALNTWLSSYKFDELYTINDKGELIFDKEIQSLLPPKQLTCGQQHLSYGGEVVRALANPDLSKLAYGAETPRGTRGLSMYKMGEWMRDAMKLNRDQRNLRIFSPDETYSNQLQAVFEETDRAWMWPIEEWDDDMARDGRVIELLSENLLFGMMHGYTVTGRHAMFPTYESFSQVVSSMADQYCKYVYASQGVHFRKPVPACNVVLSSLLERQDHNGYSHQNPSFLGAMLEKHPKIISAYLPADGNSTLVYTERAYADRDKLNIIVAGKKDLPQWLSLDEARQQAKDGVMVWDFASDENPDVVLVGCGDYVTQEAMAALVLIRELLPRVRIRFVSVSELTSSGLGSLDFQSKPWLMDEVFTADKGVVFNYHGYPNTIKKLVFDYKGSERFRIKGYEEEGSTTTPFDMGVRNGTSRYHLVIDMAYKLFQQGVIDETQHVAITTDMLQRLVDHRNYIKANGVDPISLDNWVWTR

SEQ ID NO: 337 - protein, 788 aa, Shewanella woodyi ATCC 51908
MSQQQEISALKKFVRATNFLATSQIYLKQNVLHKRSLTHSDIKPRLLGHWGTCPGINFVYANVNRLIVKNQRSFVYLVGPGHGFPAVQANLFMEGSLSHFYPENIPYNETGIEDICKKFSAAYGYPSHANPEAPGQILEGGELGYSLSVAWGAVLDNPDLIAACLVGDGESETGPLAASWYANRLVDPATNGAVLPIVHINGYKISGPTRMGRMSHEELDLEFRGLGYHPIIVDDELDEDVYVQMTKAMDTSYEMITAIQTRARSGEDVVKPRWPVILMRTAKGWTGTSQYNGKKLEGNCESHQVIVNKCATDKGHLDALDTWLASYNFNELYSINEQGQLIFDKEIQSLIPPAELCCGRQHLSYGGEVVRALSKPDLEKLSYGPETPRGQRGLSMYKMGEWMRDAFKLNRDQRNLRIFSPDETYSNQLQAVFEETDRAWQWPIEEWDEDMARDGRVIELLSENLLFGMMHGYTVTGRHAMFPTYESFSQVVSSMADQYCKYVYASQGVHFRKPVPACNVVLSSLLERQDHNGYSHQNPSFLGAMLEKHPKIISAYLPADGNSTLVYTERAYEDRDKLNILVAGKKDLPQWLTLDEARQQAKDGVMVWDFASDENPDVVLVGCGDYVTQEAMASLVLIRELLPRVRIRFVSVTELTSSGLGSLDFQSKPWLMDEVFTADKGVVFNYHGYPNTIKKLVFDYKGSDRFRIKGYEEEGSTTTPFDMGVRNGTSRYHLVIDMAYKLFQQGVIDETQHVAITTDMLQRLVDHRNYIKANGVDPISLENWVWTR

SEQ ID NO: 338 - protein, 788 aa, Shewanella halifaxensis HAW-EB4
MAHQQEIVALKKFVRATNFLATSQIYLKKNVLHKRALEHSDIKPRLLGHWGTCPGINFVYANVNRLITKHNRSFVYLVGPGHGFPAVQANLFMEGSLSHFYPDTIPYNEDGITDICQKFSAAYGYPSHANPEAPGQILEGGELGYSLSVAWGAVLDNPDLIAACLIGDGESETGPLAASWYANRLVSAKNNGAVLPIVHINGYKISGPTRMGRMSHEELDLEFRGLGYHPIIVDDQLEEDVYLQMAAAMDKSYEMINDIQTRARAGEDIVKPRWPVILMRTAKGWTGTAEFDGKKLEGNCESHQVIVNKCASNKGHLDALNTWLASYKFNELYSINEKGELIFDEDIQSLLPPKELTCGRQHLSYGGEVVRALAKPDLEKLAYGPETPRGHRGLSMYKMGEWMRDAFKLNRDQRNLRIFCPDETYSNQLQAVFEETSRAWQWPIESWDEDMSRDGRVIELLSENLLFGMLHGYTVTGRHAMFPTYEAFSQVVSSMADQYCKYVYASQGVHFRKPVPACNVVLSSLLERQDHNGYSHQNPSFLGAMLEKHPKIISAYLPADGNSTLVYTERAYADRDKLNILVAGKKDLPQWLTLDEARQQAKDGVMVWDFASDENPDVVLVGCGDYVTQEAMAALVLIRELLPRVRIRFVSVTELTSSGLGSLEFQAKPWLMDEVFTADKGVVFNYHGYPNTIKKLVFDYKGSKRFRIKGYEEEGSTTTPFDMGVRNGTSRYHLVIDMAYKLFQSSVIDESQHVAITTDMLQRLVDHRNYIKANGVDPESIENWVWTR

SEQ ID NO: 339 - protein, 788 aa, Shewanella denitrificans OS217
MTQANEIKALKKYVRATNFLATSQIYLKQNVLYKRQLEHTDIKPRLLGHWGTCPGINFVYANINRLIVKHNREFIYLVGPGHGFPAVQANLFMEGSLSHFYPETIPFTETGIEDICKKFSAAYGYPSHANPEAPGQILEGGELGYSLSVAWGSVLDNPNLIAACLIGDGEAETGPLAASWYANRLVSPANNGAVLPIVHINGYKISGPTRMGRMSHEELDLEFRGLGYHPIIVDDEQDTDIYEQMTAAMDLSYEMITDIQRRARSGEDVVKPRWPVILMRTAKGWTGTSEYAGKKLEGNCESHQVIVNNCATDKGHLNALDQWLASYKFDELVQTTETGELVFDKDILLLIPPKDLCCGRQRLSYGGEVVRALANPDLAKLGYGAETPRGQRGYSMLKMGQWMRDAFKLNRDQRNLRIFSPDETYSNQLQAVFEETDRAWQWPIESWDQDMSRDGRVIELLSENLLFGMLHGYTVTGRHGMFPTYEAFSQVVSSMADQYCKYVHASQGIHFRKPIPACNVVLSSLLERQDHNGYSHQNPSFLGAMLEKHPNIISAYLPADANSTLVYTERAYGDRDKLNIIVAGKKSLPQWLSLDEARKQAKDGIMVWDFASDENPDVVLAGCGDYATQECMASLVLIREILPRVRIRFVSVSELHSSGLGSLKFQSKPWMMDEVFTEDKGVVFNYHGYPNTIKKLVFDYKGNRRFRIKGYEEEGSTTTPFDMGVRNGTSRYHLVIDMAYKLFQQGVIDETQHVRITTDMLQRLVDHKNYIKANGVDPVEIENWVWTR

SEQ ID NO: 340 - protein, 749 aa, Legionella drancourtii LLAP12
MINNFLLKKTLDFQDIKPRLLGHWGTCPGINFIYAHLNFLIKKHRVPTIFILGPGHGFAALQANLFMEGTLKTYYPQATHDYVGIEYLIKNFSWPYGFPSHSNPGAPGVILEGGELGYSLATAYGAVLDNPGTLIACVVGDGEAETGPSATAWHLNKFIDPTKNGVVLPILHLNGYKISGPTIFGRMTNKELKSLFYGYGYEPFIVEGGAIYKKMLITLETCYQHIDALRKNDKNIRPPMIILKTPKGWTGIKKLHGQKIEGNCLAHQVVVTHAKTDRSELQALENWLHSYQFNTLFDEKKGFIDDITSLIPENTLCMGANKHTYADPELVNKLLLPNLNGMTEDIIHPGSMGASSMRFAGAYLAELIKLNQTNRNFRMFSPDETYSNKLDKVFEETTRANLQAQKAWDKDISVDGRVIEMLSEHSLQGLMQGYVLTGRHALFASYEAFIQIVSSMVDQYMKFLHVSRQFPWRGELPSLNYILTSSGWRQEHNGFSHQNPGFISNILQKNGDYGRVYFPPDANSTLFVLEKCFQSRNKVNVIVAGKTFEPCWLTPEQAKIELEQGLMIWDFASDPHPDIVLAGVGDYVSLEALAAIRLIRQETPAVKIRFVNIIELSALGLGYSHSLTEEQFDTFFTGDKPIIFNFHGYPAVLQQLLFPYGNTKRFYIHGYVENGSTTTPFDMHIRNRTSRWHLALEVFSLMAQRGVIETKVVMRLNKKYKKKFMEHTRYIKQYGVDPDEIAKWQWSGE

SEQ ID NO: 341 - protein, 728 aa, Ajellomyces dermatitidis ER-3
MPGEIIKKANPKALPSHLPGAIDQLADNAYLKRELKFDDIKPRLLGHWGTCPGLTFVYSHLNYLICKHDLDMIYVVGPGHGAPAILTALWMEGSLERFYPDYSRDTKGLTKLITTFSTTGGFSSHINAETPGAIHEGGELGYALSVSFGAVMDKPDLIVACIIGDGEAESGPTATARTIFGCMDDRELIALFVGYGYQPRIIDDMKHIDADFNAALEWALAEIREIQKAARSGNPIMKPRWPVLILRTPKGWTGPKQIHGQIVEGSFNAHQVPLPAAKKDQEELKTLNEWLSSYKPQELFTEGGGLTDDINAIIPRNDLKKLGQRSEVYESYKAPKLPNWKKFGIEKGKQESSMKAIAEFIDQVFVDNPHSVRLFSPDELESNKLGGTLAHTGRNCQWDQDRQRPGVHIDGRVGIFPSYESFLGIIHTMMVQFCKFTNKMGLETSWRRDIASNNYIETSTWTRQEHNGFSHQNPSFISAVLNLKPNADRVYLPLDANTSLSTLNHRLKSKNYINLMVGSKQPTPVFLSPDKAERHCRGGGSVWKFASTDEGRDPDVVLIGIGTELTFEVIRAAALLRERVPELRVRVVNVMDLMILSRETSHPHALSDEAFSALFTRERPIHFNYHGYETEMKGLLFGRPNMERVTIASYMEEGSTTTPFDMMLANRVSRFHVAQAAVRGGAIRVEDVTIRRQELLSEFDHDVNEARKYILQHHKDPDDMYDMPKFSN

SEQ ID NO: 342 - protein, 677 aa, Ajellomyces dermatitidis SLH14081
MIFLQDNAYLKRELKFDDIKPRLLGHWGTCPGLTFVYSHLNYLICKHDLDMIYVVGPGHGAPAILTALWMEGAIHEGGELGYALSVSFGAVMDKPDLIVTCIIGDGEAESGPTATARTIFGCMDDRELIALFVGYGYQPRIIDDMKHIDADFNAALEWALAEIREIQKAARSGNPIMKPRWPVLILRTPKGWTGPKQIHGQIVEGSFNAHQVPLPAAKKDQEGLKTLNEWLSSYKPQELFTEGGGLTDDINAIIPRNDLKKLGQRSEVYESYKAPKLPNWKKFGIEKGKQESSMKAIAEFIDQVFVDNPHSVRLFSPDELESNKLGGALAHTGRNCQWDQIANAQGYTLTGRVGIFPSYESFLGIIHTMMVQFCKFTNKMGLETSWRRDIASNNYIETSTWTRQEHNGFSHQNPSFISAVLNLKPNAARVYLPPDANTFLSTLNHRLKSKNYINLMVGSKQPTPVFLSPDEAERHCRGGGSVWKFASTDEGRDPDVVLVGIGTELTFEVIRVAALLRERVPELRVRVVNVMDLMILSRETSHPHALSDEAFSALFTRERPIHFNYHGYETEMKGLLFGRPNMERVTIASYMEEGSTTTPFDMMLANRVSRFHVAQAVVRGGAIRVEDVMIRRQELLSEFDHDVNEAREYILQHHKEQLQANKMVDPDDMYDMPKIFN

SEQ ID NO: 343 - protein, 806 aa, Ajellomyces capsulatus NAm1
MPGEIIDKPNPKPLPSHLPEVIDQLAVQLARTSLDQNVIDSLQRFQRAANYIAAAMIFLQDNACLKRELKFDDIKPRLLGHWGTCPGLTFVYSHLNYLICKHDLDMIYVVGPGHGAPGILAALWMEGSLEKFYPGYSRDTKGLTKLITTFSTTGGFPSHINAETPGAIHEGGELGYALSVSFGAVMDKPDLIVTCIIGDGEAESGPTAASWHGFKYIDPAESGAVLPILHLNGFKISERTIFGCMDDRELIALFVGYGYQPRIIDDLEHVDIDFHGALEWALEEIRKIQQAARSGNPIMKPRWPVLILRTPKGWTGPKQIRGQIIEGSFKAHQVPLPGVKKDKEELNVLNEWLSSYKPHELFTEGGDVIDDIKAIIPRNDLKKLGQRSDVYESYRTLKLRDWKGFHIEKGKQESSMEIIAEFIDQVFVDNPHSVRLFSPDELESNKLGGALAHTGRNFQWDQFANAQGGRVIEVLSEHMCQGFLQGYTLTGRVGIFPSYESFLGIIHTMMVQFSKFTKMGRETVWRRDIASINYIETSTWTRQEHNGFSHQNPSFISAVLNLKPNAARVYLPPDANTFLSTLNHCLKSKNYINLMVGSKQPTPVFLGPDEAECHCRAGGSVWKFASTDEGKDPDVVLVGVGTELTFEVVRAAALLRERVPELRVRVVNITDLMILSRETSHPHALSDEAFDALFTSERTIHFNYHGYETELRGLLFGRSQMERVTIASYMEEGSTTTPFDMMLINRVSRFHVAQAAVRGGAIRNEDVMIRRCELLSEFDHNMNETRKYILQHHKDPDDMYDTPKFS

SEQ ID NO: 344 - protein, 803 aa, Ajellomyces capsulatus G186AR
MPGEIIDKPNPKPLPSHLPEVIDQLAVRLARTSLDQNVVDSLQRFQRAANYIAAGHWGTCPGLTFVYSHLNYLICKHDLDMIYVVGPGHGAPGILAALWMEGSLEKFYPGYSRDTKGLTKLITTFSTTGGFPSHINAETPGAIHEGGELGYALSVSFGAVMDKSDLIVICIIGDGEAESGPTAASWHGFKYIDPAESGAVLPILHLNGFKISERTIFGCMDDRELIALFVGYGYQPRIIDDLEHVNVDFHGALEWALEEIRKIQQAARSGNPIMKPRWPILILRTPKVSAQMAIHYVLSMLTYMVQGWTGPKQIHGQTIEGSFKAHQVPLPAAKKDKEELKVLSEWLMSYKPHELFTEGGDVIDDIKAIIPRNDLKKLGQRSDVYESYRTLKLPDWKGFHIEKGKQESSMEIIAEFIDQVFVDNPHSVRLFSPDELESNKLGGALAHTGRNFQWDQFANAQGGRVIEVLSEHMCQGFLQGYTLTGRVGIFPSYESFLGIIHTMMVQFSKFTKMGRETVWRRDIASINYIETSTWTRQEHNGFSHQNPSFISAVLNLKPNAARVYLPPDANTFLSTLNHCLKSKNYINLMVGSKQPTPVFLGPDEAESHCRAGGSVWKFASTDEGKDPDVVLVGVGTELTFEVVQAAALLRERVPELRVRVVNVTDLMILSRETSHPHALSDEAFDALFTSERPIHFNYHGYETELRGLLFGRPQMERVTIASYMEEGSTTTPFDMMLINRVSRFHVAQAAVCGGAIRNEDVMIRRCELLSEFDHNMNETRKYIMQHHKGKFTPVPFLNDQALD

SEQ ID NO: 345 - protein, 776 aa, Paracoccidioides brasiliensis Pb03
MPGEVIDIANPKSLPSHLPPLIDQLAVQLSRTSLDENVFRSLQKFQRAANYIAAAMIFLQDNAYLKRELKFDDIKPRLLGHWGTCPGLTFVYSHLNYLISQHDLDMIYVVGPGHGAPGILAALWLEGSLERFYPDYARNAKGLTKLVTSFSTPGGFPSHINAETPGAIHEGGELGYALSVAFGAVMDKPDLIATCIIGDGEAETGPTAASWHGFKFLDPAESGAVLPILHLNGFKISERTIFGCMDDRELVALFAGYGYHPQIIDDLEHIDADFNTALEWTLGEIRKIQKAARSGNPVTKPRWPILILRTPKGWTSPKQIHGQIIEGSFKAHQVPLPAAKTDEKELKELNAWLFSYKPAELFTEDGGVSDDINSIIPRNDKKKLGQRDEVYESYKPFKLADWRKFGVEKGTQESSMKAIAELIDQVFVDNPHSIRLFSPDELESNKLGGVLAHTGRNFQWDQFSNAKGGRVIEVLSEHLCQGFLQGYTLTGRVGIFPSYESFLGIIHTMMVQFCKFTKMGRDTSWRRDIASINYIETSTWTRQEHNGFSHQNPSFISANYINLMIGSKQPTPVILSPEEAESHCRAGGSVWKFASIDEGRDPDVVLAGIGTELTFEVIQAAALLRKRVPELRVRVVNVTDLMILGAETGHPHALSDEAFNALFTADRPIHFNYHGYETEMKGLLFGRQQIERVTIASYMEEGSTTTPFDMMLANRVSRFHVAQAAVRGGAVRNEGVRIRRQGLLSEFDFDMNETLKYISEHHKDPDDMYDMPKFSD

SEQ ID NO: 346 - protein, 771 aa, Paracoccidioides brasiliensis Pb18
MPGEVIDKANPKSLPSHLPPLIDQLAVQLSRTSLDENVFRSLQKFQRAANYIAAGHWGTCPGLTFVYSHLNYLISQHDLDMIYVVGPGHGAPGILAALWLEGSLERFYPDYARNAKGLTKLVTSFSTPGGFPSHINAETPGAIHEGGELGYALSVAFGAVMDKPDLIATCIIGDGEAETGPTAASWHGFKFLDPAESGAVLPILHLNGFKISERTIFGCMDDRELVALFAGYGYHPQIIDDLEHIDANFNAALEWALGEIRKIQKAARSGNPVTKPRWPILILRTPKIIEGSFKAHQVPLPAAKTDEKELKELNAWLFSYKPAELFTEDGGVSDDINSIIPRNDKRKLGQRDEVYESYKPLKLADWRKFGVEKGTQESSMKAIAELIDQVFIDNPHSIRLFSPDELESNKLGGVLAHTGRNFQWDQFSNAKGGRVIEVLSEHLCQGFLQGYTLTGRVGIFPSYESFLGIIHTMMVQFCKFTKMGRDTSWRRDIASINYIETSTWTRQEHNGFSHQNPSFISAVLNLKPNAARVYLPPDANTFLCTLCHCLKPKNYINLMIGSKQPTPVILSPEEAESHCRAGGSVWKFASIDEGRDPDVVLAGIGTELTFEVIQAAALLRKRVPELRVRVVNVTDLMILGAETGHPHALSDEAFNALFTADRPIHFNYHGYETEMKGLLFGRQQIERVTIASYMEEGSTTTPFDMMLANRVSRFHVAQAAVRGGAVRNEGVRIRRQGLLSEFDFDMNETLKYISEHHKDPDDMYDMPKFSD

SEQ ID NO: 347 - protein, 806 aa, Uncinocarpus reesii 1704
MPGEVIDKPNPKPLPSHLPESLDELGIQLDVRPLDKNAIDSLAKFRRAANYIAAAMIFLRDNAYLKRKLTFDDIKPRLLGHWGTCPGINFVYSHLSYLICEYDLDMLAVIGPGHGAPAILASLWLERSLEKFYPDYSRDTSGLTKLITTFSTTGGFPSHINAETPGAIHEGGELGYALAVSFGAVMDKPDMIVTCIVGDGEAESGPCTASWHSYKFIDPAESGAVIPILHLNGFKISERTIYGCMDDKELLALFSGFGYQPVIVGDLDNIDSEFNSALRWTVTEIRKIQKAARSGNPIVKPRWPMIILRTPKGWTGPKKIHGKIVEGSFHAHQVPLPAAKKDDEELNALQDWLSSYRPNELFQENGDMIEEIKTILPKEHSKRMGQRPEAYKELATVNLPDWKQFAAEKGSNESSMKTIGGLIDKLFVDNPHSARLFSPDELESNKLDQALAHTNRNFQCDQFSNAKGGRVIEVLSEHMCQGFLQGYTLTGRLGIFPSYESFLGIIHTMMVQYSKFNKMARETTWHRDLYSLNYIETSTWTRQEHNGFSHQNPSFIGAVMNLKPDYARVYLPPDANTFLSTLSHCLKSKNYVNLMIGSKQPTPVYLSPEEAENHCRAGGSVWKFASTDDGLDPDVTIVGIGTELTFEVIQAASILRKRVPELRVRVVNVTDLMILGVENRHPHSLSDEAFDALFTPDLPVHFNYHGYETELKGLLFGRPKLQRVSIASYKEEGSTTTPFNMMLVNGVSRFHVAKAAVRGGSVRNERVRLRQQELVTAFDHEIHATSKYILENQKDPDDMYDMPKFD

SEQ ID NO: 348 - protein, 806 aa, Coccidioides posadasii C735 delta SOWgp
MPGEVIDKPDPKALPSHLPSSLDELIVRLQVSPLSKDALDSLVKFRRTADYIAAAMIFLRDNAYLKRKLTFDDVKPRLLGHWGTCPGLNFIYSHLNYLICEHNLDILAVIGPGHGAPALLACLWMEGSLEKFYPDYSRDTSGLTKLITTFSTTGGFPSHINAETPGAIHEGGELGYALAVSFGAVMDKPDMIVACIVGDGEAESGPCTASWHSYKYIDPAESGAVIPILHLNGFKISERTIYGCMDDRELLALFSGFGYQAVIVGNLDNIDAEFSTALNWTLSEIRIIQNAARSGKPIMKPRWPMIILRTPKGWTGPKKIHGKIVEGSFHAHQVPLPAAKKDGEELNALQEWLLSYKPNELFQENGDVIDEINFILPKEHSQRMGQRPEAYKSLQKIAIPDWKQFAVDTGSHGSSMKTIGRLIDQLFLDNPHSARLFSPDELESNKLDQALAHTIRNFQWDQFSNARGGRVIEVLSEHMCQGFLQGYTLTGRLGIFPSYESFLGIIHTMMVQYAKFNKMARETTWHRDLYSLNYIETSTWTRQEHNGFSHQNPSFIGAVLNLKPDYARVYLPPDANTFLSTLAHCLKSKNYVNLMIGSKQPTPVYLSAEEAESHCRAGGSVWKFASTDDGLDPDVVIVGIGTELTFEVIQAATMLRKRVPELRVRMVNVTDLMILGVENRHPHSLSEEAFEALFTPNVPVHFNYHGYETELKGLLFGRPKLHRVSIASYKEEGSTTTPFNMMLVNGVSRFHVAKAAVKGGSLRNERVKLKYQELLTEFDHEINSLSQYILENQKDPDDMYDMLKFE

SEQ ID NO: 349 - protein, 805 aa, Microsporum canis CBS 113480
MPGEVIDRPNPGPPPSHLPDSVDELMVRLQTVKLDDNVRRSLEKFRRVTDYIAAAMIFLRSNAYLKRPVKREDIKPRLLGHWGTCPGLNLVYSHLNYLIRCHDLDMLFVTGPGHGAPAILASLWVEGSLGKFYPKYANDTSGLTRLITQFSTTGGFPSHINAETPGAIHEGGELGYALAVSFGSVMDNPHLITAVVVGDGEAESGPCTASWNGIKYIDPAESGAVLPILHLNGFKISERTIYGCMDDRELVSLFSGFGYQTRIVEGLDDIDTNLNNSLEWALAGIRRIQKAARSGSPIMKPRWPMLILRTPKGWTGPKSIHGKIIEGSFAAHQVPLPEAGEDDDELQALQAWLSSYNPEELFNEHGDVIDDIKSILPREDSKRMGQRKEVCDSFDKLKMPDWRCYTVSKGSQESSMKTISHFLGQILVDNPHSMRIFSPDELESNKLGAVLEKTGRNFQWDQYSNAQGGRVIEVLSEHMCQGFLQGYTLTGRTGIFPSYESFLGIIHTMMVQYSKFNKMTSTWARQEHNGFSHQNPSFISAVLNLKPNAARVYLPPDANTFLSTLSHCLQSKNYVNLMIGSKQPTQIYLSAEEAESHCRAGGSIWGFASTDDGLDPDVVLVGIGTEVTFEVIHAASILKKLIPDLRVRVINVTDLMILGSERSHPHSLSDETFDSLFTAERPIHFNYHGYETELKGLLFGRPRVDRISIACYMEEGSTTTPFDMMLLNRVSRFHVAQAAVRGGSLRNEKVRVRQHELLTTLDHEIRSVRKYIMENHNDLKQSTDKVCMADPSDLYDMPSFNLLSI

SEQ ID NO: 350 - protein, 818 aa, Aspergillus oryzae RIB40
MPGEIIDRPNPKAEPSHIPDVVEQLQVQLDQASLDQSTSDAFLKFRRAAAYIAADIRSCSLAMIFLQDNVLLKRDLQHDDIKPRLLGHWGTCPGLILVYSHLNYIVRKQNLDMLYVVGPGHGAPGLLASLWLEGSLGRFYPQYSRDMEGLKNLISTFSTSGGLPRLDAPHHINAETPGAIHEGGELGYALAVSFGAVMDNPDLIVTCVVGDGEAETGPTATSWHAIKYIDPAESGAVLPILHVNGFKISERTIFGCMDNKELISLFTGYGYQVRIVENLDDIDTDLHCSMNWAVGEIHKIQQAARSGKPIMKPRWPMIVLRTPKGWSGPKELHGQFIEGSFHSHQVPLPNAKKDKEELQALQTWLSSYNPHELFTETGDVIDEVKSIIPSDDSKKLGQRFEAYKAYEPPNLPDWRTFCVEKGAQESSMKTIGKFIDKVFTQNPHSVRLFSPDELESNKLDAALAHTGRNFQWDQYSNAKGGRVIEVLSEHMCQGFLQGYTLTGRVGLFPSYESFLGIVHTMMVQYAKFMKMARETGWHKDVASINYIETSTWTRQEHNGFSHQNPSFIGNVLKLKPNAARVYLPPDANTFLTTVHHCLKSKNYINLMVGSKQPTPVYLSPEEAESHCRAGASIWKFCSTNDGLDPDVVLVGVGVEVMFEVIYAAAILRQRCPELRVRVINVTDLMILENEGAHPHALTTESFDNLFTSDKPIHFNYHGYVTELQGLLFGRPRLERVSIAGYIEEGSTTTPFDMMLVNKTSRFHVAQAAIKGAAKRNEKVQLREQELSTELNHNIVETRKYIHANRKDPDDMYEMPQFR

SEQ ID NO: 351 - protein, 806 aa, Aspergillus niger
MPGEVIDRPNPKAEPSHIPDLVNQLQVKLQETRLEETDYNALLKFRRAAAYIAAAMIFLQDNVLLKQNLRHEDIKPRLLGHWGTCPGLILVYSHLNYIIRKQNLDMLYVVGPGHGAPAILASLWLEGSLEKFYPHYSRDMDGLHELISTFSTSAGLPSHINAETPGAIHEGGELGYALAVSFGAVMDNPDMIVTCVVGDGEAETGPTATSWHAIKYIDPAESGAVLPILHVNGFKISERTIYGCMDNKELVSLFTGYGYQVRIVENLDDIDADLHSSMMWAVEEIHKIQKAARSGKPIMKPRWPMIVLRTPKGWSGPKELHGSFIEGSFHSHQVPLPNAKKDKEELQALQKWLSSYNPHELFTETGDIIDDIKSVIPLEDTKKLGQRAEAYKGYRAPDLPDWRKFGVEKGSQQSAMKTIGKFIDQVFTQNPHGVRVFSPDELESNKLDAALAHTGRNFQWDQFSNAKGGRVIEVLSEHLCQGFMQGYTLTGRVGIFPSYESFLGIIHTMMVQYAKFNKMAQETTWHKPVSSINYIETSTWARQEHNGFSHQNPSFIGAVLRLKPTAARVYLPPDANTFLTTLHHCLKSKNYVNLMVGSKQPTPVYLSPEEAESHCRAGASIWRFCSTDNGLNPDVVLVGIGVEVMFEVIYAAAILRKRCPELRVRVVNVTDLMILEKEGLHPHALTTEAFDSLFGSDRPIHFNYHGYPGELKGLLFGRPRLDRVSVEGYMEEGSTTTPFDMMLLNRVSRYHVAQAAVIGASRRNEKVQVRQHELVSEFGHNIVETRKYILANRKDPDDTYDMPSFE

SEQ ID NO: 352 - protein, 806 aa, Neosartorya fischeri NRRL 181
MPGEVIDTPNPQALPSHIPDVVEQLQVKLDLASLEQPACDALFKFRRAASYIAAAMIFLQDNVLLKRNLTHDDIKPRLLGHWGTCPGLILVYSHLNYLIKTRDLDMLYVVGPGHGAPAILASLWLEGSLEKFYPDYSRNAEGLRNLISTFSTTAGLPSHINAETPGAIHEGGELGYALAVSFGAVMDNPDLIVACVVGDGEAESGPTATSWHAIKYIDPAESGAVLPILHLNGFKISERTIFGCMDDRELISLFTGYGYQVRIVQDLNDIDTDLHRSMTWAVDEIHKIQQAARSGKPILKPRWPLLILRTPKGWSGPKKLHGQFIEGSFHSHQVPLPKAKKDKEELQALHEWLSSYGPNELFKENGDIIDEIKSIIPSEDSKKLGQRVEAYKAYAPPNLPDWRNFAVDKGSQESAMKVTGKLIDEVFQLNPHRVRLFSPDELESNKLSAALDRTGRNFQWDQFSNARGGRVIEVLSEHMCQGFLQGYTLTGRTGIFPSYESFLGIIHTMMVQYAKFIKMALETMWHRDVASINYIETSTWTRQEHNGFSHQNPSFIGAVLKLKPTAARVYLPPDANTFLTTLHHCLKSKNYINLMVGSKQPTPVYLTPEEAESHCRAGASIWRFCSTDNGLDPDVVLVGIGVEVMFEVISAAAILRKRCPELRVRVINVTDLMILENEGAHPHALTTEAFDNLFTYDKPIHFNYHGYATELQGLLFGRPRLDRVTINGYMEEGSTTTPFDMMLVNKTSRFHVAQAALRGAARRNESVRIRQQELYTELNHNIAETKKYIIENRKDPDDMYEMPTFD

SEQ ID NO: 353 - protein, 806 aa, Aspergillus clavatus NRRL 1
MPGEVIDRPNPQALPSHIPDVVEQLQVKLDLTSLEQPACDALFKFRRAASYIAAAMIFLQDNVLLKRSLTHDDIKPRLLGHWGTCPGLILVYSHLNYLITKRNLNMLYVVGPGHGAPAILASLWLEGSLEKFYPEYSRNAEGLANLISTFSTTAGLPSHINAETPGAIHEGGELGYALAVSFGAVMDNPNLIVPCIVGDGEAETGPTAASWHGIKYIDPAESGAVLPILHLNGFKISERTIFGCMDDKELTSLFTGYGYQVRIVQDLNDIDTDLHRSMTWALEEIHKIQQAARSGKPIMKPRWPMLILRTPKGWSGPKEIHGQFIEGSFHSHQVPLPNAKKDKEELQALEKWLSSYGPRELFTENGDVIDEIKSIIPTDDAMKLGQRVEAYKAYLPPKLPDWRKFAVDKGSQQSPMKTTGKLIDEVFQLNPHTVRLFSPDELESNKLSAALDHTGRNFQWDQFSSAKGGRVIEVLSEHMCQGFIQGYTLTGRTGIFPSYESFLGIVHTMMVQYSKFIKMAQETTWHRSIASINYIETSTWTRQEHNGFSHQNPSFIGAVLKLKPTAARVYLPPDANTFLITLHHCLKSTNYINLMVSSKQPTPVYLTPEEAESHCRAGASVWKFCSTDDGLDPDVVLVGIGVEVMFEVIAAAAILRKRCPELRVRVVNVTDLMILENEGAHPHALTTDAFDSLFTSDRPIHFNYHGYPTELQGLLFGRPRLERATIGGYMEEGSTTTPFDMMLVNRVSRFHVAQAAICGASKRNERVQIRQQELYTELDHNMVETKKYILKNRKDPDDMYDMPKFE

SEQ ID NO: 354 - protein, 799 aa, Aspergillus terreus NIH2624
MPGEVIDRPNPQAPPSHIPDVVQQLQVQLQRTSLDQSACDALMKFRRAASYIAAAMIFLQDNVLLKRDLIHDDIKPRLLGHWGTCPGLILVYSHMNYLIRQHNLDMLYVVGPGHGAPGILAALWLEGSLGKFYPHYSRDGEGLKRLISTFSTPAGLPSHINAETPGAIHEGGELGYALSVSFGAAMDNPDLIVTCVVGDGEAETGPTATSWHGIKYLDPAESGAVLPILHVNGFKISERTIYGCMDNKELVTLFTGFGYQVRIVEDLEDIDTDLHCSMMWAVEEIRKIQQAARSGKPIMKPRWPMIVLRTPKLHGQFIEGSFHSHQVPLPGAKKDKDELQELQKWLSSYKPHELFTESGDVIDEVKSIIPSDESKRLGLRAESYKGYVPPKLPDWRKFAVEKHSDESSMKAIGDLIDEVFTMNPHSVRLFSPDELESNKLAAALKHTSRNFQWDQFSNAKGGRVIEVLSEHMCQGFMQGYTLTGRVGIFPSYESFLGIVHTMMVQYAKFMKMARETKWHQDVASINYIETSTWTRQEHNGFSHQNPSFIGNVLKLKPTAARVYLPPDANTFLTTLHHCLKSKNYVNLMVGSKQPTPVYLSAEEAENHCRAGASIWNFCSTDGGLDPDVVLVGIGVEVMFEVIYAAAILRQRCPELRLRVINVTDLMILENEGTHPHALTTESFDNLFTPDRPIHFNYHGYPNELQGLLFGRPRLDRVSIAGYMEEGSTTTPFDMMLANKTSRFDVARAAVKGASKRNERVRIREQELTMELAQNMADTRKYILANRKDPDDMYTTPRFE

SEQ ID NO: 355 - protein, 780 aa, Aspergillus nidulans FGSC A4
MPGEVIERPNPAPKPSHVPDLVEKLIIPAQKTKLEKSDCDALHKYRRAAAYIAAGHWGTCPGLILVYSHLNYLIKKQNLDMLYVVGPGHGAPGLLASLWLEGSLGKFYPQYTKDKEGLHNLISTFSTSAGLPSHINAETPGAIHEGGELGYALSVSFGAVMDNPDLIVTCVVGDGEAETGPTATSWHAIKYIDPAESGAVLPILHVNGFKISERTIFGCMDNREIVCLFTGYGYQVRIVEDLEDIDNDLHSAMSWAVEEIRNIQKAARSGKPIMKPQWPMIVLRTPKGWSGPKELHGQFIEGSFHSHQVPLPNAKKDDEELQALQKWLSSYKPDELFTESGDVIDEILSIIPSDDKKLGMRPEAYKTHLPPDLPDWRQFCVKKGDQFSAMKAIGSFIDQVFVKNPHTVRLFSPDELESNKLSAALSHTGRNFQWDEFSNAKGGRVIEVLSEHLCQGFMQGYTLTGRTGIFPSYESFLGIIHTMMVQYAKFAKMAKETAWHHDVSSINYIETSTWARQEHNGFSHQNPSFIGAVLKLKPYAARVYLPPDANTFLTTLHHCLKSKNYINLMVGSKQPTPVYLSPEEAESHCRAGASIFKFCSTDGGLRPDVVLVGIGVEVMFEVIKAAAILRERCPELRVRVVNVTDLFILENEGAHPHALKHEAFDNLFTEDRSIHFNYHGYVNELQGLLFGRPRLDRATIKGYKEEGSTTTPFDMMLVNEVSRYHVAKAAVTGGARFNEKVKLRHQELCSEFDHNIAETRKYIMNNHQDPEDTYNMPSFN

SEQ ID NO: 356 - protein, 822 aa, Penicillium chrysogenum Wisconsin 54-1255
MPAEVISEPNPQALPSHLPDYLEKLSVSLEREKLDEKTYDALIKFRRAACYIAAAMIFLQENTLLKSELTFQHVKPRLLGHWGTCPGLIFVYSHLNYLIRTMNLDMLYVVGPGHGAPAILAALWLEGSLEKFYPHYSRDEKGLHRLISTFSTTGGFPSHINSETPGAIHEGGELGYALAVSFGAVMDNPDLIVTCIVGDGEAESGPTATSWHAIKYIDPKESGAVLPILHLNGFKISERTIFGCMDHKELLTLFSGYGYQVRFVEDNNDIDADLHTSMIWAVNEIQKIQKAARSGKPIMKPRWPMLILRTSKGWTGPKQLHGKFLEGSYHSHQVPLPKAKTDKEQLDLLQNWLSSYKPEELFTSNGDVIDEIKSVIPTEDKKKLGQRIEVYNSYTPPNLPDWKPFCADKGSQESAMKAAGTFINQTFKDNPNSVRLFSPDELESNKLDAVFEYTNRNFQWDEFANARGGRVIEVLSEHMCQGFMQGYTLTGRIGIFPSYESFLGIIHTMMVQYAKFIKMGLETTWHSGVSSVNYIESSTWARQEHNGFSHQNPSFIGAVLKLKPSAARVYLPPDANTFLTTIHHCLKSKNYINLMVGSKQPTPVYLTPKEAESHCRAGASIWKFCSTDDGINPDVVLVGIGVEVMFEVIAAAALLRKLIPELRVCVINVTDLMILDNEGAHPHALSTEAFDGLFTSDRPIHFNYHGYPTELQGLLFGRPRLDRVSVAGYIEEGSTTTPFDMMLVNRVSRFHVAQHAIRGAAKVNEKVRVYQQELNAQLEASMVSTRKYIVENRDDPDGIYDMPQFHSFHKPAESETFWNIAQ

SEQ ID NO: 357 - protein, 806 aa, Talaromyces stipitatus ATCC 10500
MPGEVIDQPNPPPLPSDLPEELDKFAVQLQKISLDQKDYDDLAKFRRAACYIAAAMIFLQDNVYLKREIKPEDIKPRLLGHWGTCPGLILVYSHLNYLITKYDYDMLYVVGPGHGAPAILASVWLEGSLEKFFPQYSRDTKGLSNLITRFSTTSGLPSHINAETPGAIHEGGELGYALAVSFGAVMDNPDLIVTCVIGDGEAESGPTATSWHAAKYIDPKESGAVLPIVHVNGFKISERTVYGCMDNRELTALFLGYGYQPRFVENLDDIDTDMHTSMVWAVGEIRRIQKAAREGKPLSKPRWPVLILRTPKGWSGPKKIHGEFIEGSFHSHQVPLPKAKKDKEELQALQDWLTSYKPEDLFNEQGGPIDAITSIIPKTDSKKLGQRIESYGNYKPLEMPNWKHFVVSKGSYESSMKTIGKFIDEVFVKNPQTARLFSPDELESNKLDAALAHTGRNFQWDQFSRNKGGRVIEVLSEHMCQGFMQGYTLTGRTAIFPTYESFLGIVHTMMVQYSKFNKMARETRWHSDIASINYIETSTWTRQEHNGFSHQNPSFIGAVLKLKPYAARVYLPPDANTFLSALDHCLRSRNYVNLMVGSKQPTPVFLSPEEAAIHCRAGASIWKFCSTDDGLDPDIVLVGIGSELMFEVIYAASILRKRVPELRVRVVNVIDLMILENQGAHPHALSTDGFDALFTPDLPIHFNYHGYNTELQGLLFGRPNLDRVSIAGYIEEGSTTTPFNMMLVNKVSRFHVARAAVEGAAKRNEKIRLRLQELISELDTNIRETTKYIVEHGTDPEDMYGMPKFG

SEQ ID NO: 358 - protein, 806 aa, Penicillium marneffei ATCC 18224
MPGEVIDQPNPPPLPSGLPEELDRFVVQLQNISLGQKDYDDLAKFRRAACYIAAAMIFLQDNVYLKREIKPEDIKPRLLGHWGTCPGLILVYSHLNYLITKHEYDMLYVVGPGHGAPAILASVWLEGSLEKFFPEYSRDTKGLSNLITRFSTTAGLPSHINAETPGAIHEGGELGYALAVSFGAVMDNPDLIVTCIIGDGEAESGPTATSWHAAKYIDPKESGAVLPIVHVNGFKISERAVYGCMDNRELTALFLGYGYQPRFVENLDDIDTDMHTSMVWAVEEIRRIQKAAREGKPLSKPRWPVLILRTPKGWSGPKKIHGEFIEGSFHSHQVPLPKAKKDKEELQALQDWLASYGPEDLFNDKGGPIDAITSIIPKTDSKKLGQRIESYGNYQPLEMPNWKHFVVSKGSYESSMKVIGKFIDQVFVKNPHTARLFSPDELESNKLDAALAHSGRNFQWDQFSRNQGGRVIEVLSEHMCQGFMQGYTLTGRTAIFPTYESFLGIVHTMMVQYSKFNKMARETRWHSDIASINYIETSTWTRQEHNGFSHQNPSFIGAVLKLKPYAARVYLPPDANTFLSTLDHCLRSRNYVNLMVGSKQPTPVFLSPEEAAVHCRAGASIWQFCSTNEGLNPDVVLVGVGSELMFEVIYAAAILRRRMPELRVRVINVTDLMILENQGAHPHALSIDGFDALFTPDIPIHFNYHGYNTEIQGLLFGRPNLDRVSIAGYIEEGSTTTPFNMMLVNKVSRFHIAKAAVQGAAKRNEKVRLRCQELLSELDMDIGETSKYIVENGNDPEDMYDMPKFE

SEQ ID NO: 359 - protein, 714 aa, Aspergillus fumigatus Af293
MIFLQDNVLLKRNLTHDDIKPRLLGPGHGAPAILASLWLEGSLEKFYPDYSRNAEGLRNLISTFSTTAGLPSHINAETPGAIHEGGELGYALAVSFGAVMDNPDLIVACVVGDGEAESGPTATSWHAIKYIDPAESGAVLPILHLNGFKISERTIFGCMDDRELISLFTGYGYQVRIVQDLNDIDTDLHRSMTWAVDEIHKIQQAARSGKPILKPRWPLLILRTPKGWTGPKKLHGKFIEGSFHSHQVPLPKAKKDKEELQALHEWLSSYGPNELFKENGDIIDEIKSIIPSEDSKKLGQRVEAYKAYAPPNLPDWRHFAIDKGSQESAMRVTGKLIDEVFQLNPHRVRLFSPDELESNKLSAALDRTGRNFQWDQFSNARGGRVIEVLSEHMCQGFLQGYTLTGRTGIFPSYESFLGIIHTMMVQYAKFIKMALETMWHRDVASINYIETSTWTRQEHNGFSHQNPSFIGAVLKLKPSAARVYLPPDANTFLTTLHHCLKSKNYINLMVGSKQPTPVYLTPEEAESHCRAGASIWRFCSTDNGLDPDVVLVGIGVEVMFEVITAAAILRKRCPELRVRVINVTDLMILENEGAHPHALTTEAFDNLFTYDKPIHFNYHGYATELQGLLSGRPRLDRVTINGYMEEGSTTTPFDMMLVNKTSRFHVAQAALRGAARRNESVRIRQQELYTELNHNIAETKKYIIENRKGKFACA

SEQ ID NO: 360 - protein, 686 aa, Botryotinia fuckeliana B05.10
MKITTPPANIFIAMIFLSDNAYLERDLTFDDIKPRLLGHWGTCPGLTLVYAHLNYLTKKNDLDMIYVVGPGHGAPAILSSLWLEGTLAKFYPKYSNNKQGLHNLITGFSTPSGFPSHISAEVPGSIHEGGELGYALSVAFGAVMDNPDLVVACVVGDGEAESGPTATAWHAAKYIDPAESGAVIPIVHVNGFKISERTIYGCMDDKEMASLFTGYGYQCRFVEDLEDIDRDMATSMQWALDEIRKIQKAARSGKPIMKPRWPVIIMRTPKGWSGPKIVDGEYVEGSFHAHQVPLMAVKSNKDQLADLQKWLLSYGPAKLFTESGDVVDSVKAIIPPEHKKLGQRPETYKNHEVLKVPDWKNYGVEKGTEVSCMKAIGDLIDQTLVDNPKSLRLFSPDELVSNKLDAVFKNTGRDFQWDEFSHAQGGRVIEILSEHTCQGFLQGYTLTGRTGIFPSYESFLGIIHTMMVQYSKFNKMARETRFRADLSSLNYIETSTWTRQEHNGFSHQNPSFIGAVLNLKPTAARVYLPPDANTFLSTISHCLQSTNYINLMVGSKQPQPVFLSPEEANKHCQAGASIWKFCSTDDGLDPDVVLVGIGSELMFEVVVAAALLRKKCPELRIRVVNVTDLMILEAETLHPHSLTQEEFDSLFTPDKPIHFNYHVYSNEIKGLLFGRPHLQRMSIACL

SEQ ID NO: 361 - protein, 809 aa, Sclerotinia sclerotiorum 1980
MPGEIIDRPNPQALASNISGSTTIDELAVKLEKLQIPDDDLRGLEEFRRASNYIAAEIFTFDDIKPRLLGHWGTCPGLTLVYAHLNYLTKKNDLDMIYVVGPGHGAPAILSSLWLEGTLEKFYPKYSNNKQGLHNLITGFSTPSGFPSHISAEVPGSIHEGGELGYALSVAFGAVMDNPDLVVACVVGDGEAESGPTATAWHAAKYIDPAESGAVIPIVHVNGFKISERTIYGCMDDKEMASLFTGYGYQCRFVEDLEDIDRDMATSMQWALDEIRKIQKAARSVIIMRTPKGWSGPKIVNGGFVEGSFHAHQVPLMAAKSNKDQLTDLQKWLLSYGPAKLFTESGDVIDSVKKILPPEHKKLGQRPETYKNHEVLKIPDWKKYGVEKGTEVSCMKAIGDLLDQALVDNPKSLRLFSPDELVSNKLDAVFKHTGRDFQWDEFSNAQGGRVIEILSEHTCQGFLQGYTLTGRTGIFPSYESFLGIIHTMMIQYSKFNKMARETRFRADLSSLNYIETSTWTRQEHNGFSHQNPSFIGAVLNLKPTAARVYLPPDANTFLSTIAHCLKSTNYINLMVGSKQPQPVFLSPEEANKHCQAGASVWKFCSTDEGIDPDVVLVGIGSELMFEVVVAAALLRKKCPDLRVRVVNVTDLMILEAETLHPHSLTRDEFNSLFTADKPIHFNYHGYSNEIKGLLFGRPNLERMSIACYKEEGSTTTPFDMMLRNEVSRYHVMEWAIKGAARVNKRVALEMTGWLGEVRGSRSRVAEFILRNGKDPEGTFDTPMFEGSVFGREKEGKGGEGEKEDGFFVN

SEQ ID NO: 362 - protein, 805 aa, Gibberella zeae PH-1
MPGEVIDRPNPAPLDSSLPGAVLDLAAKAPKKQLDKKIAQSLNDFQHAACYIAGSMIFLRDNVLLEREIKTEDIKPRLLGHWGTCPGIILVWSHLNLLIRNHDLEMIFVIGPGHGAPGALASLWLEGSLERFFPQKYGVNKDGLRNLITGFSVPGGFPSHINSETPGSIHEGGELGYSLAVSFGAVMDNPDLIVTCLVGDGEAESGPTAAAWHSIKYIDPAESGAVIPILHVNGFKISERTIFGCMDNKELVSLFSGYGYQPIIVETIEEIDAELSGVLEWAVSEIKKIQNAARDGKPIVKPRWPMIVLRTPKGWTGPKKVDGEFIEGSFRSHQIPVPGAGQDGEHVKILQDWLKTYGTDRLLKDGKPAESITDIIPQKDEKRLGQLKKTYNPHQQLQLPDWKSFGVEKLSENSCMKQVGNFLNQVIKENPKSFRIFSPDELESNKLSAVFENTGRNFQWDEFSRAQGGRVIEILSEHCCQGWMQGYTLTGRTALFPSYESFLGIIHTMMVQYSKFNKIARETNWRGDLSSINYIETSTWARQEHNGFSHQNPSFIGSVLNLKAEAARVYLPPDANCFLSTIHHCLGSKNYVNLMIGSKQPTAVFLSPDEAADHCRKGASVWEFASTDSGKQPDVVIAGIGVEVTFEVVKAAELLRALIPDLRVRVVNVTDLMVLAAESRHPHALSRADFLDMFTEDKAICFNYHGYAAELQGLLFGRPGLHRMTVEGYKEEGSTTTPFDMMLLNWVSRFDVAKRALKGAAETNDKIKAKLDKTLKKIDDRVEEVRRYIAENGKDPEDLYDMPKF

SEQ ID NO: 363 - protein, 800 aa, Nectria haematococca mpVI 77-13-4
MPGEVIDRPNPAPLESRLPYETLNLAARPPKKVLDKSVAQSLKDFQQAACYLAGSMIFLRDNILLERDLRLEDIKPRLLGHWGTCPGLILVWSHLNLLIRNHDLDMIYVIGPGHGAPAALASLWLEGSLERFFPQKYGVNKDGLRNLITGFSVPGGFPSHINSETPGSIHEGGELGYALAVSFGAVMDNPDLIVTCVIGDGEAESGPTAAQYIDPAESGAVIPILHANGFKISERTIFGCMDNKELVSLFSGYGYQPAIVETLDEIDVELGSALEWAISEIKSIQRAAREGKPIAKPRWPMIILRTPKGWTGPKKVDNDIIEGSFHAHQIPIPNANKDEKHLKILQDWLQTYDAGRLLKGGKPTESILEIMPRKDEKRLGQLKQTYDPYKALKLPDWKPFSVEASRQRSCMEQTGKFLDKVITENPKSFRIFSPDELESNKLSAVLEHTGRNFQWDEYSRAQGGRVIEILSEHCCQGWMQGYTLTGRTALFPSYESFLGIIHTMMVQYSKFNKVAREVEWRGPLSSINYIESSTWARQEHNGFSHQNPSFIGAVLNLKAEAARVYLPPDANCFLSTIHHCLGSKNYVNLMIGSKQPTAVYLSPDDAAEHCRKGAGVWKFASTDGGKDPDVVLVGVGVEVTFEVVKAAEMLRQLLPDLRVRVINVTDLMVLASESRHPHALSRVEFLDMFTEDKAVCFNYHGYAAELQGLIFGRPGLHRMTVEGYKEEGTTTTPFDMMLVNGVSRFDVAKRALGGAAKYKDEVKKKLDGMLEKIDTRVEEVKAYIRDEGTDPDELYNMPDF

SEQ ID NO: 364 - protein, 787 aa, Verticillium albo-atrum VaMs.102
MPGEVIDRPNPSALPSQLPDEVLNLAVKLQRKPLDKDVAQSLEDFQNAACYIAAAMIFLQDNALLESDLTFDHVKPRLLGHWGTCPGLILVWSHLNLLIRNHDLEMIYVIGPGHGAPAALASLWLEGSLERFYPKQYPVNRKGLSNLISGFSVPGGFPSHINSETPGSIHEGGELGYALGVSFGAVMDNPDLIVTCVVGDGEAESGPTAAAWHAIKYIDPKESGAVIPILHVNGFKISERTIFGCMDDKEIVSLFSGYGYQVCIVQDLANINEDLANALEWALSEIKKIQKAARFGEPISKPRWPMLVMRTPKGWSGPKKVDGKIVEGSFNSHQVPLKKAKTDESHLRNLKEWLSYYKINDLLTDGKPNNTILDILPKTDAKKLGQFKPTHEPYIGLDLPDWKSFSVERGHQNSEMEATAKFLDRVIQDNPHTFRMFSPDELESNKFGAVLEHTGRNFQWDEFSRNKGGRVIEILSEHCCQGFMQGYTLTGRVALFPSYESFLGIVHTMMVQYAKFSKIAQSLEWRGDLASINYIETSTWARQEHNGFSHQNPSFIGAVLNIKAEAARASPIKIPSIGTQPTTTFLSPEDADEHCQAGASIWPFASTPLAEGDQPDVVLVGIGVEVTFEVVKAAELLRTLAPSLKIRVVNVTDLMVLVAESRHPHSLTRDEFIAMFTADRPVCFNYHGYATELQGLLFGRPNMDRISIEGYREEGSTTTPFDMMLVNCVSRFDVAARALRGGAAFNDKVRTELDRLLKEIDGRVETIRDFINNEGKGQLSSPCTRTL

SEQ ID NO: 365 - protein, 815 aa, Neurospora crassa OR74A
MGGTQITIPNPPPLPSHLPDNVLDLAVQIERKNLPDNVRESLRAFQRAGCYIAASMIFLRDNVLLQDKLQVSHIKPRLLGHWGTCPGLILVWSHLNVLIRNHDLNMIYVIGPGHGAPAALASLWLEGSLERFYPGEYDRNATGLRNLITRFSVPGGFPSHINAETPGAIHEGGELGYALSVSFGAVMDNPDLIVTCVVGDGEAETGPTATAWHAIKYIDPKESGAVIPILHVNGFKISERTIFGCMDDKEIACLFSGYGYQVRIVEDLENIDDDLQSSLEWALVEIKKIQKAAREDNKPIVKPRWPMIVLRTPKGWTGPKEVEGQIIEGSFHSHQVPLPKAGSDEKQLQALDEWLSSYRISELLDDEGKPTEAITRVLPKAEKRLGQLKITYDPYIPLKLIDWKQFGVQKGVDESCMKSAGKFLDKLFQENPKTLRLFSPDELESNKLNAILDHTQRDFQWDEFSRAHGGRVIEVLSEHNCQGFMQGYTLTGRTALFPSYESFLGIVHTMMVQYSKFVKIAREVPWRGDLASINYIETSTWARQEHNGFSHQNPSFIGAVLNLKAEAARVYLPPDANCFLSTVHHVMDSKNKTNLIIGSKQPTAVYLSPAEAADHCRQGASIWHFASSSDPNSSAGESVQDPDVVLVGIGVEVTFEVIKAAELLRSIAPALKIRVVNVTDLMILIEESKHPHALAKAKFIEMFTADRPVLFNYHGYPTELQGLLFGREKAERMDVEGYQEEGSTTTPFDMMLRNRVSRFDVASWALKRGAERNAEVKNDLEGLLGDVDRRVKEVREFIGNEGKDPDDIYQLPKFE

SEQ ID NO: 366 - protein, 813 aa, Magnaporthe grisea 70-15
MPAPEITEPNPPPLPSNIPDSASELAVRKHLPVSKLSEDDLAGVKEFRRAACYIAAAMIFLRDNVLLADDLTVDHIKPRLLGHWGTCPGLVLVWAHLNLLVRDHDLHMIHVIGPGHGAPAALAALWLEGSLERFYPGEYDRSSEGLKNLITRFSVPGGFPSHINAETPGAIHEGGELGYALSVSFGAVMDKPDLVVACVIGDGEAESGPTATAWHSIKYLDPAESGAVLPILHVNGFKISERTIFGCMDDKELVTLFTGYGYQVRIVEELDDIDNDLHQALEWGLSEIRNIQKAARSGEKKPIVKPRWPMIIMRTPKGWSGPKEVDGKVVEGSFRSHQVPLPKAGNDETQLELLRDWLASYKIGDLLEDGGKPIRRITDTMPRKDEQKLGQVKETYAPEPGLEAVDWKPYGVEKKTTASCMATTGSFLDAVFQANPNRIRLFSPDELESNKLHAILDHTQRNFQWDAYSRGNGGRVIETLSEHQCQGFMQGYTLTGRTAIFPSYESFLGIVHTMMVQYSKFVKIAKEVKWRGDLSSINYIETSTWARQEHNGFSHQNPSFIGAVLNIKPDSARVYLPPDANCFLSTAHHCVKSKNYVNLMIGSKQPTRVYLSPDEAAEHCKAGAGIFHFASTPAENGGDKTKSTADPDVVLVGIGVEVTAEAVAAAELLLDLCPELKVRMINVTDLMILIPESRHPHSLSDDKFEELFTADKPVLFNYHGYATELQGLLFGRPRTERMTVEGYREEGSTTTPFDMMLANCVSRFHLARRAIRAASSSSAVDKNKLDQVLKEIQAREDRVRKYIDENGKDPEEM

SEQ ID NO: 367 - protein, 771 aa, Podospora anserina
MPRSEIPIPNPPALPSSLPDSILHDLSVTLPPKPLPPTDLASLKAFQRAANYLAASMIFLRSNTLLQNPLSHNDIKPRLLGHWGTCPGLVLVYSHLNLLLRNNPDLEMIFVIGPGHGAPAALAALWLEGSLERFYPGEYDLTESGFHNLVTRFSVPGGFPSHINAETPGAIHEGGELGYALGAAFGAVMDKPDLVVTVVVGDGEAETGPTATAWHAIKFLDPKESGAVIPILHVNGFKISERTIFGCMDDKEIVALFSGYGYQVLVVEDLERVDEELQGGLDWALGEIRKIQKAAREGRAVVKPRWPMIVLRTPKGWTGPKEVDGKIIEGSFHSHQVPLPKAGEEDGQLGDLGKWLESYRIGELVKDGRPTEEVTRILPRERERRLGQNRLTYDAYEGLKRVDWREFTVEKGTDQSCMKVTGKFLDRVFRENPKSIRLFSPDELESNKLDAILDHTQRNFQWDEYSRGNGGRVIEVLSEHDCQAFMQGYTLTGRTAIFPSYESFLGIVHTMMVQYSKFVKIAREVPWRGDLASINYIETSTWARQEHNGFSHQNPSFIGAVLNLKAEAARVYLPPDANCFLSTVHHCLGSRNYTNLIIGSKQPTAVYLSAEEAAEHCRRGASIWQFASTPLGPNEEPDVVLVGIGVEVTFEVIKAAELLREICPALKVRVVNVTDLMILAPVSRHPHALSKERFLELFTRERPVLFNYHGMRLEGYREEGTTTTPIDMKLLNGVNREEVLGEIEKRVGEVRGFVEREGKDPDDMYEVARFE

SEQ ID NO: 368 - protein, 805 aa, Coprinopsis cinerea okayama7#130
MPGQQLSEPNPPPGPSHLPDSTLDYVVRLDTKNYLPEDELKGLQLFRRAADYIAAAMIFLKNNVLLEEKLSQENIKPRLLGHWGTCPGLTLIYAHLNRIIRNTGQDTLFVVGPGHGAPGILSSLWLEDSLSVFEPSMTRDRPGLTKLISRFSAPGGFPSHINAETPGAIHEGGELGYALSVSFGAAMDNPDLVVACVVGDGEAETGPTAAAWHGTKFLDPAESGAVLPILHLNGFKISERTIFGVMDDKEINSLFSGYGYQVRIVSELDNLDNDLAASMDWAISEIHKIQKAARSGKPIPKPRWPLLVVRTPKGLGAPHSIHGSFIEGSFHSHQVPLPNAAKDKEELKALEAWLESYKPGELFDENGAPRPEVLTIIPQANAKKLGQRKESYGAYIPLKIPDWRQFTVDKGSEESCMKSVGRFLKQVIVDNPKTFRIFSPDELSSNKLDVVLDETRRNFQWDIGGKGGRVIEILSEHTCQGMLQGYTLTGRTGLFPSYEAFLGIIQTMMVQYSKFIKMGSETKWRQPHGSLNYIETSTWARQEHNGFSHQNPAFIGAVLNLKPKFARVYLPPDANCFLSTVAHCLRAKNYVNLMVGSKQPTPVWLSREEADRHCIAGASIWKFASVDEGLDPDVVLVGIGVEVTFEVIAAAALLRKHVPELRVRVVNVTDLMILGATGTHPHSLNDEAFDTLFTKDRPVHFNYHGYPIELRGLLWGRPNMERITIEGYREEGTTTSPFDMMLCNHTSRYDVAVAALRGGAKNNPKVALVAHEMSSYFEHMARKEKDYILAEGKDRDDMFEVPKFD

SEQ ID NO: 369 - protein, 825 aa, Schizosaccharomyces pombe
MATQNDIPNSTPEDLAKQVEIAEKHPDPPAMPSRLPDSLKTLEAKIDTSKITDEEVANVHRFQRACDYLAASLIFLSNGLYTGGDLEEKDIKTRLLGHWGTCPGLSIVYSHCNRIINKYDLNMLFVVGPGHGAPAILSALFLEDSLGPFYPRYQFTKEGLNNLINTFSLPGGFPSHVNAEVPGAIHEGGELGYALSVSYGAVLDRPDLIVTCVVGDGEAETGPTATSWHAHKFLDPAESGAVIPVLELNGYKISERTIYGCMDDSELLSLFSGFGYEVAIVNDTPDQNRVMAATMDWAVERIHDIQHRARVNREEIKPRWPMIILRTPKGKGCPKYLNGKFLEGTFRAHQVPLKLARTDTNQRNLLKDWLNSYNCQDFLDEHGLPTKGITEHLPPREKRMGQRHETYNSYLPLKVPDWKKYGVKKGETTSATSVVGQYLDELLVTNDSTLRIFSPDELESNKLDGALKHSYRTMQTDPELMAKRGRVTEVLSEHLCQGFMQGYTLTGRTAIFPSYEAFMTIVVSMLVQYSKFLKMGLETGWHGKFGSLNYVTSSTWARQEHNGFSHQSPRFITTMLSLKPGVSRVYFPPDANCFLATVARCMKSENTINLMVSSKNPQPAYLSVEEAEHHCKAGASVWKFASTDNGENPDVVIAGVGNEIMFEVVKAAEMLQNDIPELRVRVINVTDLMVLSSLHPHGMNPAEFDSLFTKDRHVHFNYHGYVMDLKALLFDRIQGTRVTMEGYREEGTTTTPFNMMMCNNTSRYHVARMALQHALHNPTVAVNCNMLCAKYAWKLEEIENYIMENKDDPPEIYAAPVFKNKTSTL

SEQ ID NO: 370 - protein, 822 aa, Schizosaccharomyces japonicus yFS275
MKFEATKEFMNESRTEAAKADPSPLQSHLPATLDTLQVHLLKDYVPEDDLVTLKNFQRVCNYIAAAMIFLCDNVLLENKLTSDHIKPRLLGHWGTCPALALAYSHCNRIISKYNLDMLFVTGPGHGAPAILAALYIEGSLQAYYPQYGHNMQGLHRLITKFSVTGGFPSHVNAEVPGAIHEGGELGYALSVSYGAVLDRPNLIVACVVGDGEAETGPTAASWHCHKFIDPAESGAVIPILNLNGFKISERTVYGCMDRRELSALFSGFGYQVVFVDYRTADDVNRDMAAAMDWCVEIIHEIQDAARAGTPIIKPRWPMIILHTPKGWGCPKTLHGKPLEGTFRAHQVPLKNAKTDAEELGQLENWLKSYHIEDFIDKSNGLPLKGLIEHLPPRVKRMGQKTDANNDFQPLCVPDWNDFSIDRGILESATSIVGKYLDRVLQANPKTLRLFSPDELASNKLDGVLEHSNRTLQTDAISAWSRGRVTEVLSEHMCQGFMQGYTLTGRTAIFPSYEAFLPIITSMTVQYTKFLKMALETKWHGRVGSLNYVTTSTWARQEHNGFSHQSPRFITTMLSFKPTLTRVYFPPDTNCFLSTIAHCLSSDNGVNLMVSSKNPGPSWLSREEAEEHCVAGASVWKFASTDGGLDPDVVLVGIGNEIMFEVIAAASILAHDLPKLRIRVVNITDLMILADNHPHSMSEIEFNALFTPNRHVHFNYHGYVMDLQSLLFSRIDASRVSMEGYCEEGTTTTPFNMMIANRTSRYHVAMAAVAGATCNPEVAMNCHKLISNYKHRLTQIKHYIYENGVDPEGTFDIPDNLTKGQVI

SEQ ID NO: 371 - protein, 851 aa, Cryptococcus neoformans var. neoformans JEC21
MPTLDAVTPPKPSSLPPDIVTQLLINLDGKVDQLKSSKGGLDIEGLIAFQRVANYLAAAQIFLQHNGLLTQPLETKHIKSRLLGHWGTCPGLNFVYAHTNNLITNHETDPDVPEFMFLTGPGHGAPALLSTLFMEGSITRFYPEYPMSREGLEHFIRSFSLPGGFPSHVNAETPGALHEGGELGYCLAVAYGSIMDKPNHITVAVIGDGESETGPTATAWHAHKFIDPAESGAVIPILHVNGYKIGERTIPGTMDDLELACLYTGYGYQVHIVEYGSKSPEKASDHEHDIAVQYDMAAAIEWAYQEIKNIQQCARSGRPITKPRWPMIIMRTPKGWTGPKKAEGHLIEGNWRAHQVPLPKAGDEGEEFELLKKWLHSYGPEELFHVEVDSNTSQAHEAVNKAKGIIDSRALRIIPKDQQRRMGMVNATYRGFIPLKTPEWKEYGHDMEEEVSNMKAVGDYVAKVIEMNPSTFRIFSPDEITSNKLDAVLDVTQRNFQWDPETANKGGRVIEMLSEHTLQGWMQGYTLTGRHALFPSYESFLGIVQTMIEQYAKFLKMALETKWRSDVSGLTYIETSTLWRQEHNGYSHQNPGLIGSFISLPRHLARIYLPPDANSSIATIDHCLRSKNNINLVIGSKNPTKGFLTIEEAERHCIAGASVWEKFSSNRGIDPDVVLVGCGVEVTFEVIAAAAILRNQGVKVRVVNVTDLLILGRDGVHPHALDQDAFDSLFTVDKPVVFNFHGYPKDVEALLFSRRAHVGRSRFDILGYIEEGSTTTAYSMLRLNNTSRYSLADIAVRRVGRNQPNHPINVRSHELSSCWRHQLVLHDKFTKEYGKDPQWCAEIPELEKNAA

SEQ ID NO: 372 - protein, 893 aa, Ustilago maydis 521
MSAPLGFHLIPSRIDANQPLRDQETYLVLPDVDRRSERYDLESIQAFQKAANYLAVAQIYLQDNVLLEEPLDYKAHVKKRLLGHFGTVPGLVFVYAHVSALLARIERNTATDSYGRHRAIFITGPGHGAPAILSCLYLEGSISKFYPEESVSHQGLHAFVRNFSWPNTVRPSHVTATTPGAIHEGGELGYALSVAHGAVMDKPDLIAFAVIGDGEAETGPTATAWHSHKFIDPCESGAVLPILHLNRFKISEKTIFGTMDRTELLALFVGYGYQVRFVDYYQHLGTKHTIPGDHEATAFDVDMAASLDWALSEIDNIQKAARQAEAQKKPRWPMIILTSPKGWGAPVQVDGQQIEGSFRSHQVPVKLGAWSGADEHLSILESWLESYKPRSWLQSDSGQLRLNPLVTRMLPSDELRLGRIREIYEKSADLQDVSTSAYMVSSESSDNSRGNTRSKASAMEQCGKYLAALLPKNPDRLLIFSPDELVSNKLDATLKVQGLKARKFEHDSESIVTPQERQQGIRSGRVIEMLSEHTLQGFAQGYALTGRIGLFPSYESFLGIVTTMMAQFAKFVKVAKTTDYRSPVPSITYVMSSTLWRQEHNGASHQQPGLINSVLDLPHNVARVYLPPDANCAVSTLSHCLRSHNYVNLVVGSKHQTRVYLSEDEANAHCKAGASIWHAYSTDGGQEPDVVIVGIGTETTAEAIAATELLRGAQLDDSAKSDGSARQAPEDVLRVRFINVTDLMILSENSVHPHALSQELFDGLFTRDVPILFNFHGYTTAIKGLLGDRLSGEMGRRPMAVHGFIEEGSTTTPWNMLKLNGVDRFTVACRAVELIQRDLELKKHRRAKVNERLQKMAQSQRFDMLARKWKQRREEWQQYINRNGRDPDEVDAE

SEQ ID NO: 373 - protein, 813 aa, Microcoleus chthonoplastes PCC 7420
MTITTSTPQASFSQPDIPVTQVRQNQGAELDAIAKYRRAANYLAATQIYLKDNVLLREPLKPEHIKDRLLGHWGTCPGINLVYAHLNRLIRRYDANMFLVTGPGHGAPANLANLYLEGSLRDYYPDLSFDEAGVYRLVKQFSWPGGFPSHLYPGIPGTIHEGGELGYALATAFGAVMDNPDLVVACIVGDGESETGPTATAWHGTKFIDPAESGAVLPILHLNGYKIASPSIFGTMSDEELLHLFTGYGYQVRIVEDEDLDADMYASMDWAYQEICRIQQAARSGNRISKPRWPLIILRSPKGWTGIKEADGVPIEGNFRSHQVPLKEVKSNPEHLELLENWFRSYRPEELFDEQGQPFPDILDQCPQGERRMGSNPHTFGGRMRQPLELPDLFNYAVPVEHPEAAQGCQRGESSVSNTYEVGKYLRDVIQQNPNNFRIFCPDELESNRLYKVLDVTQRNYQWPTGPFDGEIGPDGGRIIELLSEHTCQAFLQGYLLTGRHGLFPSYEAFLGIVTTMMDQYAKFLKYSKEFPWRPPVSSLNYLETSTLWRQEHNGFSHQNPGFINSVLDQQADYARVYLPPDANCLLSTIDHCLQSTGYVNLVIANKNPLPQWLSMEDAIAHCRAGGSVWQWASTDDGVDPDVVMVGIGDCPMLEVMAAAQILRNELPELRIRVVNVTDLLILEQNSTHPHGLDDDMFAALFTPDKPVIINFHGYPSLIKQMLFGRPTIERFQINGYQEEGTTTTPFDMQVRNGTSRYHLIMQAIRLAAQKNSRVSARANDRVRHYEYVLAAHGQYICETGEDPDEITNWQWC

SEQ ID NO: 374 - protein, 782 aa, Actinosynnema mirum DSM 43827
MTTTQTSGTEAVQRYRRACDYAAAAMIYLRDNTLLREPLRREHLKPRLLGHWGTCPGITFLHAGLNGLVRRTGQRTLLVTGPGHGAPAVHANLWLEGTHAELDPALSRDGAGLAELVRRFSWPGGFPSHLSPEVPGVIHEGGELGYALATAFGAAMDKPDLLVACLVGDGEAETGPTAGSWHASKYLSPRTDGVVLPVLHANGYKISSPTVYGCMDDEELTAYFSGAGWSPRVVDVTRADDPDALMAEALDRAHAEIAELRERWRPGERAVRPMLVLRSPKGWGVPERDAGGDPLEGTFRAHQVPLGAVHEDDDELALLERWLRSYRPEELFDADGRPHEDLLAQLPPEHLRLGRVPEANGGRLRRDLPLPDVADFAARVPAPGTGSTSPTEVAGRWLAELVRATEDRRDFRVLCPDELESNKLGALLEATDRGFTWPLPDTAEHVAPGGRVLEVLSEHLCQGWAQGYLLTGRHALFPCYEAFASIVDSMVDQHAKFLKISGEVPWREPVASLNYLLTSEGWRQEHNGYSHQGPGFLNNLLTKKAATARVYLPPDANTLLVTLRDCLASTGRINLVVAGKNAGAQWLDLEAAERHCAAGAGVWDWACHGDGDPDVVLACAGGVPTVEALAAAAILRERAPEVTVRVVNVVDLLALAPADRHPHGLPDDVFAACFPQDVPVVFAFHGYPSAVREAVHGRPGADRFHVHGYLEEGTTTTPYDLLVANRMSRHDLAADALRRAGRGVDRDTDLAERLLAERDDLVAAAHRDGVDPEEIAEWRWGA

SEQ ID NO: 375 - protein, 824 aa, Atopobium rimae ATCC 49626
MAQPVIGTPWQRLNQPVSEDELSGVDKYWRTANYLSIGQIYLRSNPLMKEGFNREDVKHRLVGHWGTTPGLNFLFGHVNRFIHDHNQNTIFLMGPGHGGPAGTAQSLLDGTYRETYPFITNDEAGLQKFFRRFSYPGGIPSHYAPETPGSIHEGGELGYTLSHAYGAVLDNPSLLAVAVVGDGESETGPLATSWQTNKFMDPLTDGIVLPILHLNGYKIANPTILSRISDGERDEFFRGMGYHPYTFVAGFDNEDHASIHRRFAALFEAVFDEICSIKSRAAAGDASRPYYPMIIFRTPKGWTCPPYIDGKKTEGSWRAHQVPLASARDTEAHFQILRDWLESYRPEQLFDEDGAIRPEVTSFMPAGELRLGANPNANGGLLRQSLDLPDAREYEIPVGEKGHGFGATEATRVLGEYTADLINKNRSDFRIFGPDETASNRLQPSFQVTDKQWFGGFNDDFENDEHISPVGNVIEQLSEHQCEGLLEGYVLTGRYGIWSSYESFVHIVDSMINQHAKWLEATVRHIPWRKPISAVNVLLSSHVWRQDHNGFSHQDPGFVDVLLNKCYNNDHVVNIYYPADANLLLAVGEKAYTSTNCINAIFAGKQPAPTWVTLDEAREELKRGAVEWKWASNVSEGEDYDIVLASCGDVPTMELLAALDMLSKLGIKARFVNVLELLKIQNAEENDQALSDEEFTKLFSADKPVLFAFHAYAGTIHRLIWNRPNHDNFKVHGYEEQGSTTTPYDMLRLNHMDRWALAADALRMIDADKWSEQIVEWEQFRTDAFNFAVEKGYDHPAFTDWVWPDASDAGESLSATKATGGDNE

SEQ ID NO: 376 - protein, 823 aa, Atopobium parvulum DSM 20469
MAQPVYGTPWQTLNQPVSEEELAGVDRYWRAANYLSVGQIYLRSNPLMKDGFSREDVKHRLVGHWGTTPGLNFLFGHVNRFIRDHNQNTIFLMGPGHGGPAGTAQSLLDGTYRETYPFITDDEEGLQKFFRRFSYPGGIPSHYAPETPGSIHEGGELGYTLSHAYGAVLDNPSLLAVAVVGDGEAETGPLATSWQTNKFMDPLTDGIVLPILHLNGYKIANPTILARISDGERDEFFRGMGYHPYNFVAGFDDEDHASIHRRFAALLEAVFNEICAIKTRAAAGDASRPYYPMIIFRTPKGWTCPPYIDGKKTEGSWRAHQVPLASARDTEAHFQVLRDWMSSYNPETLFTEKGAIRPEVTSFMPKGDLRLGANPNANGGTIRRNLVLPDAKKYEIPVAEKGHGFGATEATRVLGEYTAELINSNRSEFRIFGPDETASNRLQPSFQVTDKQWFGGFNDDFENDEHISPVGNVIEQLSEHQCEGLLEGYTLTGRHGIWSSYESFVHIIDSMINQHAKWLEATVRHIPWRKPISALNLVLSSHVWRQDHNGFSHQDPGFVDIMLNKSFNNDHITNIYFPADANLLLAVGEKCYTSTNCINAIFAGKQPAPTWVTLDEAREELSVGAKEWKWASNAEAGEEDIVLASCGDVPTQELLAALDMLGKLGIKARFVNVVDLLKIQNASENNEALSDEEFTKLFSADKPVLFAFHAYAGSVRRLIWNRPNHDNFNVHGYEEQGSTTTPYDMLRLNNMDRWALAADALRMIDAQKWADQIDEWEKFRTEAFEFAVEKGYDHPAFTDWSWPDASDADQSISATQATAGDNE

SEQ ID NO: 377 - protein, 824 aa, Atopobium vaginae DSM 15829
MGQPVLGTPWHKLGKSVSEEELEAVDKYWRCANYLSIGQIYLRSNPLMKGDFNRDDIKYRLVGHWGTTPGLNFLFGHVNRLIHDHNQNTVFLMGPGHGGPAGTAQSLLDGTYTETYPRITKDEAGLQKFFRQFSYPGGIPSHYAPETPGSIHEGGELGYVLSHAYGAVLDNPSLLAVAVVGDGESETGPLATSWQTNKFLDPLTDGIVLPILHLNGYKIANPSILSRISGEERDEFFRGMGYHPYVFTAGFDDEDHSSIHRRFAALLETVFDEICNIKTRAQAGEEARPAYPMIVFRTPKGWTCPAYIDGKKTEGSWRAHQVPLASARDTEAHFEVLKNWMKSYKPEELFDENGAIKSDVVAAMPQGDLRLGANPNANGGKLRHNLDLPDAKDFAIDVEKGGHGCGAVEATRVLGDFTAEVINKNRDSFRIFGPDETASNRLQPSYRVTDKQWFGEINADPQNDEHMAPVGNVIEQLSEHQCEGLLEGYVLTGRNGIWSSYESFVHVVDSMINQHCKWLEACVRHIPWRRPISGINLLISSHVWRQDHNGFSHQDPGFVDIMLNKSFNNDHVTNIYFPADANLLLAVAERAFTSTNCFNAIFAGKQPAPTWVTLDDAREELKRGVVEWKWASTVQKGEEPDLVIASCGDVPTQEALAAVELLDKLGVHVRFVNVVDLLKIQNAQENDQAISDEEFVKLFSADKPVLFAFHAYAGSIRRLIWNRPNHDNFCVHGYEEQGSTTTPYDMVRQNHMDRWALAQDALRLVDADKWKDQIDAWEKFRADAFQFAVDKGYDHPAFTDWRWHDAKDSAEVLSATKATGGDNE

SEQ ID NO: 378 - protein, 839 aa, Collinsella stercoris DSM 13279
MTQPVIGTPWTKLENPVSADALAAVDKYWRCANYLSVGQIYLRSNPLMREDWTDAKTGKKRDFGRVDVKHRLVGHWGTTPGINFLFGHVNHLIADHGQSTIFLMGPGHGGPAGTAQSLLDGTYREIRPDITDDEAGLEKFFRQFSYPGGIPSHFAPETPGSIHEGGELGYTLSHAYGAVMDNPSLLAVAVVGDGEAETAALATSWQSNKLVNPKTDGIVLPILHLNGYKIANPTILARISDEELTKFFEGMGYKPHFFVAGFDNESHASIHARFAAQLEVVFGEICDIKANAELGDETRPVYPMIVFRTPKGWTCPKHIDGKKTEDSWRAHQVPLADARDTHEHFRVLRSWLRSYGPEELFTSEGQVREDVTAFMPKGDLRIGANPNANGGKIRRELELPDIHAHEVPVAEKGHGWGATEAARVFGAYTADVLAKNDNFRIFGPDETASNRLQDCYAATSKQWLAGHYADADNDDLLAPSGRVIEQLSEHQCEGFLEAYVLTGRHGVWSSYESFVHVVDSMVNQHCKWLEATKREIPWRAPISGLNILLSSHVWRQDHNGFSHQDPGFIDVLLNKANDTHVVNAYYPCDANMALAVAERVYQSTDCVNAIFCGKQPAPTFVTVDDARAELAEGLAAWEWASTASSLEEADLVIATCGDVPTLEALAAVDLLREHGVKVWFVNVVDLLKIQNACENDQAISDERFAEFFGAGDKPVLFCFHAYAGTIRRLVWARPGHDAWCVHGYEEKGSTTTPFDMLRLNNMDRWALAAEALRLVDSASCDPAHAGQIEAWEAFRLEAFEFAVEEGYDHPAFTDWVWPDAASNMESALSATQMTAGDNE

SEQ ID NO: 379 - protein, 825 aa, Bifidobacterium longum
  misc_feature (575)..(575): Xaa can be any naturally occurring amino acid
MTSPVIGTPWKKLNAPVSEEALEGVDKYWRVANYLSIGQIYLRSNPLMKEPFTREDVKHRLVGHWGTTPGLNFLIGHINRFIADHGQNTVIIMGPGHGGPAGTSQSYLDGTYTETFPKITKDEAGLQKFFRQFSYPGGIPSHFAPETPGSIHEGGELGYALSHAYGAIMDNPSLFVPAIVGDGEAETGPLATGWQSNKLVNPRTDGIVLPILHLNGYKIANPTILSRISDEELHEFFHGMGYEPYEFVAGFDDEDHMSIHRRFAELWETIWDEICDIKATAQTDNVHRPFYPMLIFRTPKGWTCPKYIDGKKTEGSWRSHQVPLASARDTEAHFEVLKNWLESYKPEELFDANGAVKDDVLAFMPKGELRIGANPNANGGVIRNDLKLPNLEDYEVKEVAEYGHGWGQLEATRTLGAYTRDIIKNNPRDFRIFGPDETASNRLQASYEVTNKQWDAGYISDEVDEHMHVSGQVVEQLSEHQMEGFLEAYLLTGRHGIWSSYESFVHVIDSMLNQHAKWLEATVREIPWRKPIASMNLLVSSHVWRQDHNGFSHQDPGVTSVLLNKCFHNDHVIGXYFATDANMLLAIAEKCYKSTNKINAIIAGKQPAATWLTLDEARAELEKGAAAWDWASTAKNNDEAEVVLAAAGDVPTQEIMAASDKLKELGVKFKVVNVADLLSLQSAKENDEALTDEEFADIFTADKPVLFAYHSYAHDVRGLIYDRPNHDNFNVHGYEEEGSTTTPYDMVRVNRIDRYELTAEALRMIDADKYADKIDELEKFRDEAFQFAVDNGYDHPDYTDWVYSGVNTDKKGAVTATAATAGDNE

SEQ ID NO: 380 - protein, 861 aa, Bifidobacterium breve DSM 20213
MTIDWERESLAPQGTKARDLTEIINRTITCRSTGVHMTSPVIGTPWKKLNAPVSEESLEGVDKYWRVANYLSIGQIYLRSNPLMKAPFTREDVKHRLVGHWGTTPGLNFLIGHINRFIADHGQNTVIIMGPGHGGPAGTSQSYLDGTYTETFPKITKDEAGLQKFFRQFSYPGGIPSHFAPETPGSIHEGGELGYALSHAYGAIMDNPSLFVPAIVGDGEAETGPLATGWQSNKLVNPRTDGIVLPILHLNGYKIANPTILSRISDEELHEFFHGMGYEPYEFVAGFDDEDHMSIHRRFAELWETIWDEICDIKAAAQTDNVHRPFYPMLIFRTPKGWTCPKYIDGKKTEGSWRAHQVPLASARDTEAHFEVLKNWLESYKPEELFDANGAVKDDVLAFMPKGELRIGANPNANGGVIRDDLKLPNLEDYEVKEVAEYGHGWGQLEATRTLGAYTRDIIRNNPRDFRIFGPDETASNRLQASYEVTNKQWDAGYISDEVDEHMHVSGQVVEQLSEHQMEGFLEAYLLTGRHGIWSSYESFVHVIDSMLNQHAKWLEATVREIPWRKPIASMNLLVSSHVWRQDHNGFSHQDPGVTSVLLNKCFHNDHVIGIYFATDANMLLAIAEKCYKSTNKINAIIAGKQPAATWLTLDEARAELAKGAAAWDWASTAKNNDEAEVVLAAAGDVPTQEIMAASDKLKELGVKFKVVNVADLLSLQSAKENDEALSDEEFADIFTADKPVLFAYHSYAHDVRGLIYDRPNHDNFNVHGYEEEGSTTTPYDMVRVNRIDRYELTAETLRMIDADKYADKIDELEKFRDEAFQFAVDKGYDHPDYTDWVYSGVNTDKKGAVTATAATAGDNE

SEQ ID NO: 381 - protein, 801 aa, Bifidobacterium bifidum NCIMB 41171
MDKYWRVANYLSIGQIYLRSNPLMKEPFTREDVKHRLVGHWGTTPGLNFLIGHINRFIADHGQNTVFIMGPGHGGPAGTSQSYLDGTYTETYPNITKDEAGLQKFFRQFSYPGGIPSHFAPETPGSIHEGGELGYALSHAYGAIMDNPSLFVPCIVGDGEAETGPLATGWQSNKLVNPRTDGIVLPILHLNGYKIANPTILSRISDEELHEFFHGMGYEPYEFVAGFDDEDHMSIHRRFAELFESVWDEICDIKAAANTDNMHRPFYPMIIFRTPKGWTCPKYIDGKKTEGSWRAHQVPLASARDTEAHFEVLKNWLESYKPEELFDANGAVKDDVLAFMPKGELRIGANPNANGGVIRRDLVLPALEDYEVKEVKEFGHGWGQLEATRRLGVYTRDIIKNNMHDFRIFGPDETASNRLQASYEVTNKQWDAGYISDEVDEHMHVSGQVVEQLSEHQMEGFLEAYLLTGRHGIWSSYESFVHVIDSMLNQHAKWLEATVREIPWRKPIASMNLLVSSHVWRQDHNGFSHQDPGVTSVLLNKCFHNDHVIGIYFATDANMLLAIAEKCYKSTNKINAIIAGKQPAATWLTLDEARAELAKGAAAWDWASTAKTNDEAQVVLAAAGDVPTQEIMAASDKLKALGIKFKVVNVADLLSLQSAKENDEALTDEEFADIFTADKPVLFAYHSYAHDVRGLIYDRPNHDNFNVHGYEEEGSTTTPYDMVRVNELDRYELTAEALRMIDADKYADEIQKLEDFRQEAFQFAVDKGYDHPDYTDWVYSGVKTDKKGAVTATAATAGDNE

SEQ ID NO: 382 - protein, 825 aa, Bifidobacterium angulatum DSM 20098
MTNPVIGTPWKKLDAPVSEEALEGVDKYWRTANYLSIGQIYLRSNPLMKAPFTREDVKHRLVGHWGTTPGLNFLIGHINRFIADHQQNTVIIMGPGHGGPAGTAQSYLDGTYTETFPKITKDEAGLQKFFRQFSYPGGIPSHYAPETPGSIHEGGELGYALSHAYGAVMNNPSLFVPAIVGDGEAETGPLATGWQSNKLINPRTDGIVLPILHLNGYKIANPTILSRISDEELHEFFHGMGYEPYEFVAGFDDEDHMSIHRRFAELFESIFDEICEIKATAQTDDVHRPFYPMIIFRTPKGWTCPKFIDGKKTEGSWRSHQVPLASARDTEAHFEVLKNWLESYKPEELFDENGAVKADVTAFMPEGELRIGANPNANGGVIRKDLKLPKLEDYEVKEVQEYGHGWGQLEATRRLGVYTRDIIKNNPDDFRIFGPDETASNRLQAAYEVTNKQWDAGYLSEQVDEHMAVTGQVTEQLSEHQMEGFLEGYLLTGRHGIWSSYESFVHVIDSMLNQHAKWLEATVREIPWRKPISSMNLLVSSHVWRQDHNGFSHQDPGVTSVLLNKCFNNDHVIGIYFPVDSNMLLAVAEKCYKSTNKINAIIAGKQPAATWLTLDEARAELEKGAAEWEWASTAKSNDEAQIVLAATGDVPTQEIMAAADKLDAMGIKFKVVNVVDLVKLQSAKENNEALSDEEFAELFTEDKPVLFAYHSYARDVRGLIYDRPNHDNFNVHGYEEQGSTTTPYDMVRVNNIDRYELVAEALRMIDADKYADKINELEAFRTEAFQFAVDNGYDHPDYTDWVYSGVNTNKQGAVSATAATAGDNE

SEQ ID NO: 383 - protein, 825 aa, Bifidobacterium catenulatum DSM 16992
MTSPVIGTPWKKLNAPVSEEAIEGVDKYWRAANYLSIGQIYLRSNPLMKEPFTREDVKHRLVGHWGTTPGLNFLIGHINRLIADHQQNTVIIMGPGHGGPAGTAQSYLDGTYTETFPKITKDEAGLQKFFRQFSYPGGIPSHYAPETPGSIHEGGELGYALSHAYGAVMNNPSLFVPAIVGDGEAETGPLATGWQSNKLVNPRTDGIVLPILHLNGYKIANPTILSRISDEELHEFFHGMGYEPYEFVAGFDNEDHLSIHRRFAELFETVFDEICDIKAAAQTDDMTRPFYPMIIFRTPKGWTCPKFIDGKKTEGSWRSHQVPLASARDTEAHFEVLKNWLESYNPEELFDENGAVKPEVTAFMPTGELRIGANPNANGGVIREELNLPALEDYEVKEVAEYGHGWGQLEATRRLGVYTRDIIKNNPDSFRIFGPDETASNRLQAAYDVTNKQWDAGYLSSQVDEHMAVTGQVTEQLSEHQMEGFLEAYLLTGRHGIWSSYESFVHVIDSMLNQHAKWLEATVREIPWRKPISSMNLLVSSHVWRQDHNGFSHQDPGVTSVLLNKCFNNDHVIGIYFPVDSNMLLAVAEKCYKSTNMINAIIAGKQPAATWLTLDEARAELEKGAAEWEWASTAKSNDEAQIVLASAGDVPAQEIMAAADKLNELGIKFKVVNVVDLVKLQSTKENDQAISDADFAELFTEDKPVLFAYHSYARDVRGLIYDRPNHDNFNVHGYEEQGSTTTPYDMVRVNNIDRYELVAEALRMIDADKYAEKIDELEAFRQEAFQFAVDNGYDHPDYTDWVYSGVNTTKQGAVSATAATAGDNE

SEQ ID NO: 384 - protein, 825 aa, Bifidobacterium sp. CFAR 172
MTNPVIGTPWKKLDAPVSEEALEGVDKYWRTANYLSIGQIYLRSNPLMKEPFTREDVKHRLVGHWGTTPGLNFLIGHINRPIADHQQNTVIIMGPGHGGPAGTAQSYLDGTYTEYFPNITKDEAGLQKFFRQFSYPGGIPSHYAPETPGSIHEGGELGYALSHAYGAVMNNPSLFVPAIVGDGEAETGPLATGWQSNKLINPRTDGIVLPILHLNGYKIANPTILSRISDEELHEFFHGMGYEPYEFVAGFDDEDHMSIHRRFADLFESVFDEICDIKAAAQTDDMTRPFYPMIIFRTPKGWTCPKFIDGKKTEGSWRAHQVPLASARDTEEHFQVLKNWLESYKPEELFDDKGAVRPEVTAFMPKGELRIGQNPNANGGRIREELNLPKLEDYEVKEVSEYGHGWGQLEATRRLGVYCRDIIKNNPDSFRIFGPDETASNRLAAAYEVTNKQWDAGYLSAQVDEHMAVTGQVTEQLSEHQMEGFLEGYLLTGRHGIWSSYESFVHVIDSMLNQHAKWLEATVREIPWRKPISSMNLLVSSHVWRQDHNGFSHQDPGVTSVLLNKCFNNDHVIGIYFPVDSNMLLAVAEKCFKSTNMINAIIAGKQPAATWLSLDEARAELEKGAAEWKWASNVKSNDEADIVLASVGDVPTQEIMAAADKLNKLGIKFKVVNVVDLIKLQSAKENNEALTDEEFADLFTTDKPVLFAYHSYARDVRGLIYDRPNHDNFNVHGYEEQGSTTTPYDMVRVNNIDRYELTAEALRMVDADKYAAEIDKLEAFRDEAFQFAVDKGYDHPDYTDWVWPGVNTAKQGAVTATAATAGDNE

SEQ ID NO: 385 - protein, 825 aa, Bifidobacterium pullorum
MTSPVIGTPWKKLDAPVSEEALEGVDKYWRASNYLSIGQIYLRSNPLMKEPFTRNDVKHRLVGHWGTTPGLNFLIGHINRLIADHQQNTVIIMGPGHGGPAGTSQSYLDGTYTEYFPNITKDEAGLQKFFRQFSYPGGIPSHYAPETPGSIHEGGELGYALSHAYGAVMNNPSLFVPAIVGDGEAETGPLATGWQSNKLINPRTDGIVLPILHLNGYKIANPTILARISDEELHEFFHGMGYQPYEFVAGFDDEDHMSIHRRFADLFETVFDEICDIKAAAQTDDMTRPFYPMIIFRTPKGWTCPKYIDGKKTEGSWRSHQVPLASARDTEEHFQVLKNWLESYKPEELFDENGAVKPEVTAFMPTGELRIGENPNANGGRIREDLVLPPLDNYEVKEVAKFGHGWGQLEATRRLGVYTRDIIKLNPDSFRIFGPDETASNRLQAAYEVTNKQWDAGYLSELTDEHMAVTGQVTEQLSEHQMEGFIEGYLLTGRHGIWSSYESFVHVIDSMLNQHAKWLEATVREIPWRKPISSMNLLVSSHVWRQDHNGFSHQDPGVTSVLLNKTFNNDHVVNIYFPCDSNMLLAVAEKCYKSTNQINAIIAGKQPAATWMTLDEARAELEKGAAEWKWASTAASNDEAQIVLACAGDVPTQEIMAAADKLNEMGIKFKVVNVVDLIKLQSAKENDEALTDEEFAEIFTADKPVLFAYHSYAHDVRGLIFDRPNHDNFNVHGYKEQGSTTTPFDMVRVNDIDRYELVAEALRMIDADKYADKIDELEAFRTEAFQFAVDNGYDHPDYTDWVYSDVKTDVQGAVTATAATAGDNE

SEQ ID NO: 386 - protein, 825 aa, Gardnerella vaginalis ATCC 14019
MTSPVIGTPWKKLNAPVSEAAIEGVDKYWRVANYLAIGQIYLRSNPLMKEPFTREDVKHRLVGHWGTTPGLNFLIGHINRFIADHQQNTVIIMGPGHGGPAGTAQSYLDGTYTEYYPKITKDEAGLQKFFRQFSYPGGIPSHFAPETPGSIHEGGELGYALSHAYGAVMNNPSLFVPAIVGDGEAETGPLATGWQSNKLVNPRTDGIVLPILHLNGYKIANPTILSRISDEELHEFFHGMGYEPYEFVAGFDDEDHLSIHRRFADMFETIFDEICDIKAEAQTNDVTRPYYPMIIFRTPKGWTCPKFIDGKKTEGSWRAHQVPLASARDTEAHFEVLKNWMKSYKPEELFDEKGAVKEDVLSFMPKGELRIGENPNANGGRIREDLKLPKLEDYEVKEVKEFGHGWGQLEATRRLGVYTRDIIKNNPDSFRIFGPDETASNRLQAAYEVTNKQWDAGYLSGLVDEHMAVTGQVTEQLSEHQMEGFLEGYLLTGRHGIWSSYESFVHVIDSMLNQHAKWLEATVREIPWRKPISSVNLLVSSHVWRQDHNGFSHQDPGVTSVLLNKTFNNDHVIGIYFPVDSNMLLAVAEKAYKSTNMINAIFAGKQPAATWLTLDEAREELEKGAAEWKWASNAKNNDEVQVVLAGVGDVPQQELMAAADKLNKLGVKFKVVNVVDLLKLQSAKENNEALTDEEFTDLFTADKPVLFAYHSYAHDVRGLIYDRPNHDNFNVHGYKEQGSTTTPYDMVRVNDMDRYELTAEALRMVDAAKYADEIKKLEDFRLEAFQYAVDKGLDHPDYTDWVWPGVKTDKPGAVTATAATAGDNE

SEQ ID NO: 387 - protein, 826 aa, Bifidobacterium gallicum DSM 20093
MTSPVIGTPWQKLNRPVSEEAIEGMDKYWRASNYMSIGQIYLRSNPLMKEPFTRDDVKYRLVGHWGTTPGLNFLLAHINRLIADHQQNTVFIMGPGHGGPAGTAQSYLDGTYTEYYPNITKDEEGLQKFFRQFSYPGGIPSHFAPETPGSIHEGGELGYALSHAYGAVMNNPSLFVPCIVGDGEAETGPLATGWQSNKLVNPRTDGIVLPILHLNGYKIANPTILARVSDEELHDFFRGLGYHPYEFVAGFDNEDHLSIHRRFAELFETIFDEICDIKAAANTDDMTRPFYPMLIFRTPKGWTCPKFIDGKKTEGSWRAHQVPLASARDTEAHFEVLKNWMASYKPEELFDDKGAIKDDVVDFMPKGDLRIGANPNANGGVIREELDLPALENYEVKEVKEFGHGWGQLEATRKLGEYTRDIIKNNPDSFRIFGPDETASNRLQASYEVTNKQWDNGYLSKDLVDEHMAVTGQVTEQLSEHQCEGFLEAYLLTGRHGIWSSYESFVHVIDSMLNQHAKWLEATVREIPWRKPISSMNLLVSSHVWRQDHNGFSHQDPGVTSVLLNKTFNNDHVIGLYFATDANVLLAIAEKCYKSTNMINAIVAGKQPAATWTTLDEARELVAKGAGEFEWASNVKTNDEAEIVLASAGDVPTQELMAAADRLNKLGVKFKVVNVVDLIKLQSAKENDQALSDAEFAELFTEDKPVLFAYHSYAHDVRGLIFDRPNHDNFNVVGYKEQGSTTTPYDMVRVNDIDRYELTATALRMIDADKYADEIKKLEDFRIEAYQFAVDNGYDIPDYTDWVWPGVKTDLPGAVSATAATAGDNE

SEQ ID NO: 388 - protein, 825 aa, Bifidobacterium animalis subsp. lactis HN019
MTNPVIGTPWQKLDRPVSEEAIEGMDKYWRVANYMSIGQIYLRSNPLMKEPFTRDDVKHRLVGHWGTTPGLNFLLAHINRLIADHQQNTVFIMGPGHGGPAGTAQSYIDGTYTEYYPNITKDEAGLQKFFRQFSYPGGIPSHFAPETPGSIHEGGELGYALSHAYGAIMDNPSLFVPCIIGDGEAETGPLATGWQSNKLVNPRTDGIVLPILHLNGYKIANPTILARISDEELHDFFRGMGYHPYEFVAGFDNEDHLSIHRRFAELFETIFDEICDIKAAAQTDDMTRPFYPMLIFRTPKGWTCPKFIDGKKTEGSWRAHQVPLASARDTEAHFEVLKGWMESYKPEELFNADGSIKEDVTAFMPKGELRIGANPNANGGRIREDLKLPELDQYEITGVKEYGHGWGQVEAPRSLGAYCRDIIKNNPDSFRVFGPDETASNRLNATYEVTKKQWDNGYLSALVDENMAVTGQVVEQLSEHQCEGFLEAYLLTGRHGIWSSYESFVHVIDSMLNQHAKWLEATVREIPWRKPISSVNLLVSSHVWRQDHNGFSHQDPGVTSVLLNKTFNNDHVTNIYFATDANMLLAIAEKCFKSTNKINAIFAGKQPAATWITLDEARAELEAGAAEWKWASNAKSNDEVQVVLAAAGDVPTQEIMAASDALNKMGIKFKVVNVVDLIKLQSSKENDEAMSDEDFADLFTADKPVLFAYHSYAQDVRGLIYDRPNHDNFTVVGYKEQGSTTTPFDMVRVNDMDRYALQAKALELIDADKYADKINELNEFRKTAFQFAVDNGYDIPEFTDWVYPDVKVDETSMLSATAATAGDNE

SEQ ID NO: 389 - protein, 825 aa, Bifidobacterium pseudolongum subsp. globosum
MTNPVIGTPWQKLDRPVSEEAIEGMDKYWRVTNYMSIGQIYLRSNPLMKEPFTRDDVKHRLVGHWGTTPGLNFLLAHINRLIADHQQNTVFIMGPGHGGPAGTSQSYVDGTYTEYYPNITKDEAGLQKFFRQFSYPGGIPSHFAPETPGSIHEGGELGYALSHAYGAVMNNPSLFVPCIIGDGEAETGPLATGWQSNKLVNPRTDGIVLPILHLNGYKIANPTILARISDEELHDFFRGMGYHPYEFVAGFDNEDHMSIHRRFAELFETIFDEICDIKAAAQTDDMTRPFYPMLIFRTPKGWTCPKFIDGKKTEGSWRAHQVPLASARDTEEHFEVLKGWLESYKPEELFNADGSIKDDVTAFMPKGDLRIGANPNANGGVIREDLKLPELDQYEVTGVKEYGHGWGQVEAPRSLGAYCRDIIKNNPDSFRIFGPDETASNRLNATYEVTDKQWDNGYLSSLVDEHMAVTGQVTEQLSEHQCEGFLEAYLLTGRHGIWSSYESFVHVIDSMLNQHAKWLEATVREIPWRKPISSVNLLVSSHVWRQDHNGFSHQDPGVTSVLINKTFNNDHVTNIYFATDANMLLAISEKCFKSTNKINAIFAGKQPAPTWITLDEARAELEAGAAEWKWASNAENNDEVQVVLAAAGDVPTQEIMAASDALNKMGIKFKVVNVVDLLKLQSRENNDEALTDEEFTDLFTADKPVLFAYHSYAQDVRGLIYDRPNHDNFNVVGYKEQGSTTTPFDMVRVNDMDRYALQAAALKMIDADKYADKIDELNAFRQKAFQFAVDNGYDIPEFTDWVYPDVKVDETQMLSATAATAGDNE

SEQ ID NO: 390 - protein, 822 aa, Atopobium vaginae DSM 15829
MAQPVLGTPWYKPLGIRKQECSSAQTLASLDAYWRCANYISAGQIYLFSNPLMKGGLSPRDIKHRLMGHWGTIPGLNFLYAHINRFIRDHGQNTVVLMGPGHGGPAGNAEAFIDGSLSEVYPDIPQNEQGLERLCRAYSFPLGFPSNHGPHTPGSIHEGGELGYVLSHAFGAVLDNPSLLAIPIIGDGECETGPLAASWQTNKFINPQTDGLVLPIVHLNGYKISNPSILARVSLQERDDYFKGMGYRPYTFVAGFDEEDALSIHKRFVALFEEIFAELCSIKEHAKQGFHERPSYPVLIFKTPKGWTCPTYIDGQKFEDSWRSHQVPFAAADETLTHFDDFCAWMASYRPQEIFEKDGTLSKQVTRILPQGDLRIGSNPCADAGRVRCALTLPSLDLYKLAPDTSQRGALCASPTYVLGLYTAKLLQNNPQMFRVFGPDEIASNRFQSIYRATHKQWYVDIDKDLENDGELSQTGSVIEQLSEHQCEGLLEGYVLTGRHGIWVSYEAFAQITASMISQHIKWLEALRREVSWRKPISSLNILLTSHVWRQEHNGFTHQDPGIVDTLLNKSCNNEHVIHIYYPCDANLLLAVAQQAYTATDCVNVIFAGKQQIPVWLTLDEARLELARGVLEWTWASHTDAHGNFDLVLATCGDVPTIETLAAADILRRQGVHFKFVNVLNLCALQRHEENDTALTDEEFTELFSADKPVLFAFHAYVGTIYRLIWGRPHSSNFYVHGYQDLGSTTTFFDMLHMNQMDRFALAAHALQILNAQRALVHSCAKPLWKTARQEILAYREQLYRFTLEHGYDDPAATSYPSVAKD

SEQ ID NO: 391 - protein, 811 aa, Frankia sp. EAN1pec
MTAPAVHDQEQGDQEQGGLEHGLDEAQLDGLIAYWNAANYLTAAQIYLMDNPLLRRPLRRDDIKPRLLGHWGTSPALNLVYAHLNRLVRRTGQDVLYVAGPGHGGPALVANTYLEGTYSEIYPSVSRDVAGLTQLVRRFSTPGGIPSHVSVPTPGSIHEGGELGYALVHAFGAVFDHPDLLVAAVVGDGEAETGPLEGSWKGVDFLNPSRDGAVLPILNLNEYKIANPTVLGRLSRERLNHLFAGHGYDVLWVEGDDVRAVHRAFSAALTTAHSRIRDIQRTARRPGATVTEAPIWPMIVLRTPKGWTGPHEVDGVLVEGTFRAHQVPLSGVRDNPEHLAQLEAWLRSYQPERLFDADGRLVPELAALAPDGPARLGATSYANGGVRTEPLRLRDWRAHALDVDPARRGSLVHETTRPLGELLADVYRDNPTTFRVFSPDELASNRLGAILDVTDRCLVAPIDPRDDRVSPAGRAMEVLSEHLCEGWLEGYTLTGRHGLFATYEAFAMVSASMVIQHTKWLQEASRLAWRAPVPSLNVLLTSTCWRNDHNGFSHQGPGLIDTVVPLSPGVARIWLPPDANSLLSVADHCLRSRDHVNLLVADKQPHLQYLTADEAAEHAARGGSVWDWAGTETDLDREPDVVLAGIGDVPTLEILAAADLLRRYVPSLAVRVVNIIDLMALLRSDLHPHGFSTPMFRALFTDSTDVVVGFHGYSRAVHQLLHGRANPQRFHVRGFTEQGTTTTPFDMVVRNGLSRYHLAQLAVEFTRTTRPGTDRLVSHCQDQLTRHDAHVTEHFEDLPEIREWTWPGRDT

SEQ ID NO: 392 - protein, 822 aa, Frankia alni ACN14a
MVGGTGGSLGSMTATVDVEELDSPVPELDEPSLDRLIAYWNAANYLTVAQIYLRANPLLREPLRPEHIKPRLLGHWGTSPALNLVYAHLNRLVGLTGQDVLYVAGPGHGGPALVANTYLEGTYSEIYPAVSADTAGLTRLVEQFSTPGGIPSHVSVPTPGSIHEGGELGYALVHAFGAAFDHPDLLVAAVVGDGEAETGPLEGSWKGITFLNPARDGAVLPILNLNQYKIANPTVLGRRSRDQVTAYLAGHGYEVLWVEGSDVRQVHRDFAAALATAHQAIRRLQHAARRPGGTVTDTPVWPMIVLRTPKGWTGPHEVDGVQVEGTFRAHQVPLATVRENPEHLAQLDAWLRSYQPERLFDADGRLAAELAALAPAGDKRLGATSYANGGRRTEPLRLPDWRTHALDIDPLHRGRDSYETTRPLGELLRDVYRDNPTTFRVFSPDELTSNRLGAILEVTDRCLVAPIDPHDDRVSPSGRVMEVLSEHLCQGWLEAYTLTGRHGLFATYEAFAMVSASMLIQHTKWLQEAARLGWREPVPSLNVLLTSTCWRNDHNGFSHQGPGLIDTVVPLSPGVVRVWLPPDANSLLSVADHCLRSRDHVNLLVADKQPHLQYLTAAEADEHAARGGSVWDWAGTETPLGRDPDIVLLGIGDVPTMEILAAAQLLRRFVPSLSVRVVNVIDLMALLRSDLHPHGFSNPMFRALFTDETDVVVGFHGYSRGVHQLLHGRHNPQRFHVRGFIEQGTTTTPFDMLVRNEVSRYHLARLAIEFARTTRPGTDRLVTHCETQLSRHHGYIRDHLEDLPEIRTWTWDDPPPAAEPSA

SEQ ID NO: 393 - protein, 800 aa, Rhodococcus opacus B4
MTEVRQPGSQDSDGHYSDADLESDLRWWAAANYLTVAQIYLQDNTLLREPLRPEHIKPRLLGHWGTSPGLSMIYALLNRLIRRTDTDCLYVTGPGHGGPALVAATYLEGTYSEVYPGVSRDAAGIHRLCRQFSTPGGIPSHVSVQTPGSIHEGGELGYALAHAAGAAFDHPNLLVACVIGDGEAETGPLSASWKLPAFLNPERDGAVLPILHVNGAKIAGPTVHGRSSDADVEAFLGGQGWAPVVVSGDDPRQVFPALHRALTDAHTAISDLQREARADRRSAAKWPAIVLRTPKGWTGPRTVDGVLVEGTHRAHQVPLSGVRTNEAHLRQLEEWMRSYGPDQLFDSSGALVPDLVRLAPQGDKRMGSSPYANGGRLRADLPVPPLEKYALPIEKPGTTHHETTRVLGELLRDLYAATTTQDGGGYFRLFCPDETSSNRLGAVFEVTDRCWQLPVTDYDDGLAARGRVMEVLSEHLCEGWLEGYLLSGRHGLFASYEAFAMVSVSMLVQHTKWLQHAVDLPWRAPVASLNVLLTSTCWRNDHNGFSHQGPGMIDAVIPLAPDVVRVWLPPDSNTLLSIADHCLRSTDHVNLVVVDKQPHLQYLSLAEAHAHCAAGASVWEWAGTESSAGTEPDVVLAAAGDVPTQEILAAAQLLREHTPELVTRVVNVVDLMGLLTPTEHPHGFDARTFLDLFTADTDVVFAFHGYSRAVHELLHGRPAPDRFHVRGFSEQGTTTTPFDMVVLNRMSRYHLALAALRRTRREPAGATELADHCLRQLERHGEYVVAHLEDMPEVRDWTWS

SEQ ID NO: 394 - protein, 850 aa, Rhodococcus jostii RHA1
MPIGLANRSAWVVGSTKSVPLLRGLAPVAARTRLVSGGRGRSRTPGEASRMTDGPQLGSQDPDGHYSDSDLELDLRWWAAANYLTVAQIYLQDNALLREPLRPEHIKPRLLGHWGTSPGLSMIYALLNRLIRRTDTDCLYVTGPGHGGPALVAATYLEGTYSEVYPGVSRDAAGIHRLCRQFSTPGGIPSHVSVQTPGSIHEGGELGYALAHAAGAAFDHPNLLVACVIGDGEAETGPLSGSWKLPAFLNPERDGAVLPILHVNGAKIAGPTVYGRSSDADIEAFLGGQGWAPTVVSGDDPRQVFPALHRALTDAHTAISDLQREARAGRRSAAKWPAIVLRTPKGWTGPRTVDGVLVEGTHRAHQVPLSGVRTDEAHLRQLEEWMRSYRPDALFDSSGALFADLERLAPQGDKRMGSSPYANGGRLRADLPVPPLEKYALAIEKPGTTHHETTRVLGELLRDLYAATTTPDGGGYFRLFCPDETSSNRLGAVFEVTDRCWQLPVTDHDDGLSARGRVMEVLSEHLCEGWLEGYLLSGRHGLFASYEAFAMVSVSMLIQHTKWLQHAVDLPWRAPVASLNVLLTSTCWRNDHNGFSHQGPGMIDAVIPLAPDVVRIWLPPDSNTLLSISDHCLRSTDHVNLIVVDKQPHLQYLTLAEAHAHCAAGASVWAWAGTEAAAGADLDVVLAAAGDVPTQEILAAAQLLREHTPELVTRVVNVVDLMGLLTPTEHPHGFDARMFLDLFTADTDVVFAFHGYSRAVHELIHGRPTPDRFHVRGFSEQGTTTTPFDMVVLNRMSRYHLVLEALRRTRREPSGAGELADFCLRQLERHGEYVVAHLEDMPEVRDWTWS

SEQ ID NO: 395 - protein, 789 aa, Rhodococcus erythropolis SK121
MTDHHYSEDQLALDLKWWAAANYLTVAQIYLKDNTLLREPLRAEHIKPRLLGHWGTSPGLSMIYTLLNRHIVATGADWLYVTGPGHGGPALVASTYLEGTYSEIYPEVSDDAEGIHRMCRRFSAPGGVPSHVSVQTPGSIHEGGELGYALAHAAGAAFDHPNLVVACVIGDGEAETGPLSGSWKLPAFLNPRRDGAVLPILHVNGAKIAGPTVYGRSSDEDIQAYLGGQGWAPIVVSGDDPDAVFPQLYQAISQAHEKIREMQGAARRGEEWTGSWPAIVLRTPKGWTGPHTVDGILVEGTHRAHQVPLSGVRSNESHLRQLEEWMRSYRPDELFDANGSLVAELAALSPTGDKRMGSTPYANGGRLRVDLPMPPLEKYALPIQSPGSTFHETTRVLGELLRDIYAATETEDSGGIFRLFCPDETSSNRLGAVFETTDRCWQLPITDYDDGLSADGRVMEVLSEHLCEGWLEGYLLSGRHGMFASYEAFAMVSVSMLIQHAKWLQHAVDLPWRASVASLNVLLTSTCWRNDHNGFSHQGPGMIDAVIPLAPSVIRVWLPPDSNTLLSISDHCLRSTDHVNLIVVDKQPHLQYLTLEQAHEHCAAGASVWEWAGTEARGQEPDVVLAAAGDVPTQEILAAAQLLRDHTPELITRVVNVVDLMALLTPTEHPHGFGERVFLDLFSAQTDVVFAFHGYSRAVHELIHGRPSPERFHVRGFSEQGTTTTPFDMVVLNKMSRYHLVIEALRRSKRRPAGASELAEFCRTQLEKHSRYIVEHLEDMPEVENWTWS

SEQ ID NO: 396 - protein, 793 aa, Arthrobacter aurescens TC1
MISTLQLQDLLPVSTLNRRRQQSPRSRFNRPCRQPLQAAHIKPRLLGHWGTSPGLSLIYAHLNRLIRRTSVEVLFVAGPGHGGPAVVANTYLEGSYSEVYPAVGKDLKGLRRLVRQFSTPGGIASHVGPATPGSIHEGGELGYSLMHATGAAMDNPDLIVACVVGDGEAETGPLEGSWKAPSFINPLRDGAVLPILHLNGHKISGPTVLGRRSNMAVASLLEAHGWDPVIVSGDDPALVHPALASALDSAYLSIRTIQSHARTEGVTGPARWPAIVLRTPKGWTGPVTVDGKPVEGTHRSHQVPLAGVRENPAHLAQLEAWMRSYRPEELFDADGRLIAELTALAPDGDLRMGALPASRGMGSRDLAIPSLDRYALEAVPRGGVMHGSTKPLGEMLRDIYIDTADDPRFRLFCPDETNSNRLGAVFEATDRCLLEPAATTEAALADDHVSASGRVMEVLSEHLCQGWLEGYVLTGRHGLFASYEAFAMVSASMTVQHAKWLQHSRELEWRRPVPSLNILLTSTCWRNDHNGFSHQGPGLIDTVLSLSSSVIRVYFPPDANTLLVTAEHMLESKDYVNLVVIDKQEHPQYLTLEEARAHAAVGASIWDWAGHEILGTSAGKVPDIVLACAGDVPTQETLAAAWLLRRHVPEMSVRVVNVMDAMVLPPPEAHPHGLSGEKFEELFTADVDVVMAWHGYARALHQLLHGRPHPERFHVRGYNEQGTTTTPFDMVVLNKVSRYHLVMEALRRTRGQFPGAEQLLEHCRQQLDAHSLYIREHFEDLPEIRDWVWTQQQ

SEQ ID NO: 397 - protein, 875 aa, Propionibacterium freudenreichii subsp. shermanii
MSSVPSLSIDEMHQVDAWWRACNYLVAGQIYLQENPLLKRPLTPEDIKPRLLGHWGTSAGLGFIYAHLNRLIRHTGQDMIYIAGPGHGGPALVAAGYLEGTYTEIYPRVTRDEEGMRRLFRQFSTPGGIPSHASVTTPGSIHEGGELGYALSHGFGAVFDNPDLIAATVVGDGEAETGPAEGGWKGISFLNPVTDGAVLPILHLNGAKISGPTVQARKEPVELQELYEGHGYEVVWVEGSDLPWMHARFADALTYCYDRIKEIQAEARGGSWDGEMPAWPMIILRSPKGWTGPRIVDGNQVEGTWRAHQVPLAGVKTNAAHREQLEDWMRSYRIDELFGPDGTPTELVRANNPEGTKRMSASPYANGGVLSQELDLPDFHDYAVDVTPGTRATERLESTRKLGEYMRDIYTRNPTNFRLFCPDETNSNRLGAVFEVSDRTFMEPTDMLDVKLSNTGRVMEVLSEHNCHGWLDGYTLTGRHGMFATYEAFAMVSASMTMQQAKWLEGAYNLEWRAKVPSTNILLSSTCWRNDHNGFSHQSPELLSLVLNMRGTVSRIYLPPDANCLLDIADHCFKSRSYVNLIVQDKQPQPQWLSMPEAVEHCTRGYGIWDWAGTDGLGDTKPDIVIACAGDVVTMEAIAAAEILKVALPELKVRVVNVVDLMSLYRPKDHPHGMSVKDFSDTFTDDVDVIFAFHGYPGAIHQLVHGRPDADRFRARGFREQGTTTTPFDMVVRNKVDRYHLVMDAINNAHYRPEGSHELYQWCESQLVRHSEYIVENLQDMPEIRDWQLGDDASGTVTQFGGKQVAPRPGAGTVARRAGGKGTVAKAQAADTPAARGADVGDTGKQAQPGADAPSKKDADVKKGTDLKKDTGPKK

SEQ ID NO: 398 - protein, 835 aa, Pseudomonas syringae pv. tomato str. DC3000
MYLFNSTLSSAEQSDAESVIPPERPGSEVGPLDADLLSRLHRYWNAANYLCVGQIYLKANALLREPLLAEHIKPRLLGHWGTSVGQNFIYVHLNRLICERRIETIFISGPGHGGPTMNACAWLEGTYSEVHPEISSDEEGMLGFFRSFSTPGGIPSHCGPHTPNSLHEGGELGYSLMHAYGAAFDNPHLLVACVIGDGEAETCPLEGSWKSVHFLDPRRDGAVLPILHLNGYKISGPTVEARLPDEQLLELYRGRGYQPIIVAGDDLPGMHQRFAAALNTCHDAIREQQARSRKDGGAARARWPMIILRSPKGWTGPKVVDGVPVEGTFRAHQVPLANVIGNPQHLQQLESWMRSYSPETLFDQKGRLLPELQALTPPSALRMGAVPSVNGGRVLVALELPNFADYGLEVPGPGQVIAEAPRRLGEYLRDVMRNNPHNFRVFGPDETNSNRLNAVFEASNRTAAGPCLEIDEHLATEGRVMEVLSEHLCEGWLEGYLLTGRHGMWSTYEAFAQVVDSMVTQHAKWLQQSREFAWRRPLASLNILISSHAWRNDHNGFSHQSTGFVDNVLQRRADVVRVYYPPDSNCLVNVFDHCLRSRNYVNVVTCGKQPDFQWLDFDAALKHCSQGASIWDFAGSDDGEQPDVVLGCAGDVPTTEAVAAAWLLQKHVPGIRVRLVNVVDLGILSAPEDRPHGMDHVSFEALFTRDAPVMFAFHGSTWVIHSMVHGRANEARFHVRGFSDRGTTTTPFDMVVLNRLSRYQLAIDALSHVPRLRAQSLDAVHFFESQLRKHHTWIREHFEDMPEIRNWSWTADFSESQTPPPLAKGHSRGQTFTDA

SEQ ID NO: 399 - protein, 787 aa, Chitinophaga pinensis DSM 2588
MATLTNEQVHNIQAYWEASNYLAAAQIYLQDNPLLKDPLLTGHIKPRLLGHWGTSPGLNFIYVHLNRLIKSSDADILFICGPGHGAPAVLAQTWLEGTYTETYPEITQDEKGMRQFFRQFSTPGGIPSHVSAHTPGSVHEGGELGYSLAHAAGAVMDNPHLIAACVVGDGEAETGPLAGSWKQNCFLNPARDGAVLPILHLNGYKISGPTVMGRMPDDALATLFNGYGYAPLFVRAADTIGTHQEMAMALDTAYERIRAIQQYARDGKKTDERTLWPLIILRSPKGWTGPVMWKGKPVEGTFRSHQVPLPDVREDQDQLALLEQWLRSYTPEKHFTANGAPQAALKALAPIGDKRMSATPYANGGKDAQALVMPDFKNYAVTVNAPGVIIAEGTRELGKMLRDIFELNEQQQNFRVFCPDETTSNRLNAVFEVTKRCFMEHLIDIDDHLSPDGRVMEVLSEHLCQGWLEGYLLTGRHGVFPCYEAFITIIDSMFNQHAKWLKTCREIPWRKDLPSLNYLLTSHSWRQDHNGYSHQGPGFIDTVANKKSNVIRIYLPPDANCLLSVMDHCLKSRNYVNLVVAGKQPALQWLNVEDAAKHCAQGASVWEWASNDNGQQPDVVLACAGDVPTLEIIAAAWLLRKHLPDLKVRVVNVVDLMSLSPKDYHPHGLEAALFTSLFTDDTPVVFAFHGYVRIVHDLVHGRPHPARFHLRGFMEEGTTTTPFDMVVLNKMSRFHLAIAAIQRTERQLEKADEVIGYFEDKLSMHNIYIRECLEDMPDISNWKWSDE

SEQ ID NO: 400 - protein, 809 aa, Verrucomicrobiae bacterium V4
MGTFKNKFEARTPKTRRHPMSAELENIDLYVEYWNAANYLSAAQFYLKENPLLRVPLKSEHLKPRIRGHWGSAPGLNLIYVQLNRLIQKTNSQFLFITGPGHCSSAILANLYLEGTYTEFYPEITQDIDGLTLFCRQFSSPGGVPSHVSAMTPGSIHEGGELGYSLLHAFGAAFDHPELIVAAVVSDGEAETGPLAASWQSINFLNPSRDGAVLPFFHVNDGKLSGPTLFGRMEDQDIALYFSGLGYEPFFVCGSDPYKVHTELAQVLDKAYLAIRQIQNEAKEKRLKGKPKWPIIIFRTPDGWTGPKEVDGVRIEGTYRSHRSPLMDVRENPEHLKILESWLKSYHPEKLFDEKGKLREDLQALAPKGTLRMGSNPYANGGGLLVDLALPDFTEYRVPVKQPGSSFSEPTHVLGKYIRDVMRRNPNNFRLFCPDETDSNRLSAVFEVTNRCFVSKTYPEDDHLSPDGRVMEILSEHCCQGWLEGYLLSGGHGLLVSYEAFAMILDSMASQHAKWLKLYREIPWRKPIASLNYLLSSHVWRQEYDGYTHQGPGFIDTLINKKGHVIRIYLPADTNTLLAVMDHCLRSRNYINLVIAEKQPSLDWLDMNEARAHCARGASLWSWASNDRGNPDIILGCAGDVPTLETVAASWLLQKHFPELKVRVVNVVDLMTLSPPAYHPHGMDDINFINLFSASQPVLFAFHGYPRMVHDLVHGRPNPGRFHVRGYQEEGTTTTSFDMVILNKMSRYNLAIDAIKYALKGIPHLRSKAEELIGFFEQKIVEHSTFVRTHLDDMPEIKNWTWSNPAAEQ

SEQ ID NO: 401 - protein, 802 aa, Cyanothece sp. PCC 8801
MVATPERPTLEQTPLSAEELRQIQAYWRACNYLAVGMIYLRDNPLLKDPLTEDHVKNRLLGHWGSSPGLSFIYIHLNRLIKKYGLDVIYMAGPGHGAPGILGPVYLEGTYSETYPDKSEDEEGMKKFFKQFSFPGGIGSHCTPETPGSIHEGGELGYSLSHAYGAALDNPDLIVAAVVGDGEAETGPLATAWHSNKFINPIRDGAVLPILHLNGYKIANPTILARISHEELEYLFKGYGYKPYFVEGSDPEVMHQKMAATLETAIAEIKHIQQEARTSGVAKRPIWPMIVLRSPKGWTGPASVDGKKTEDFWRSHQVPLSGMHGNPAHIKVLEDWLKSYTPEELFDENGTLIPELKELAPTGHHRMSANPHANGGLLRKDLKMPDFRNYGVEVAKPGTVEVGNTALLGNFLRDVMANNMTNFRVFGPDETASNRLNAIYEISKKVWMGEILPEDADGTEITTDGRVMEMLSEHTLQGWLEGYLLTGRHGFFHTYEAFAHVVDSMFNQHAKWLDICKNEVPWRASVSSLNILLSSTVWRQDHNGFSHQDPGYVDLVTNKSADVVRVYFPPDANCLLSVANHCLKSKDYVNVIVSDKQVHLQYLNMDQAIKHCTKGIGIWDWASNDDCGTEPDHPDVIMASCGDVATKEALAATAILREEFPDLKVRFINVVDLFKLQSEIEHPHGLSDRDFDNLFTKDKPIIFNFHGYPWLIHKLTYRRTNHHNLHVRGYKEKGNINTPLELAINNQIDRFNLVIDVINRVPKLGSAAAYVYERMKNAIIEHRAYAYEHGIDKPEINNWKWPH

SEQ ID NO: 402 - protein, 802 aa, Cyanothece sp. ATCC 51142
MVATPNKPQIQETPLSPEELRKIHAYWRACNYLAVGMIYLKDNPLLKETLTEDHVKNRLLGHWGSSPGLSFVYIHLNRLIKKHDLDIVYMAGPGHGAPGILGPVYLEGTYSEVYPDKSEDEEGMKAFFKQFSFPGGIGSHCTPETPGSIHEGGELGYSLSHAYGSILDNPDLITVAVVGDGEAETGPLATAWHSNKFINPIRDGAVLPVLHLNGYKIANPTILARISHEELECLFKGYGYKPYFVEGSEPEIMHQKMAATLETAISEIKAIQKEARDTGVAKRPMWPMIVLRSPKGWTGPKEVDGKKTEDFWRSHQVPLSGMHNNPEHIKILEDWLKSYKPEELFDENGTLIPELKDLAPTGHRRMSATLYANGGLLRKDLKMPDFREYGVEVDQPGAVEAENTRPLGVFLRDVMRNNMTTFRVFGPDETASNRLNAIYEVSKKVWMADIIDADADGTEITTDGRVMEMLSEHTLQGWLEGYLLTGRHGFFHTYEAFAHVVDSMFNQHAKWLDICKNEVPWRAPISSLNILLSSTVWRQDHNGFSHQDPGYVDLVTNKSAEVVRVYFPPDVNCLLSVANHCLKSKDYVNVIVADKQKHLQYLSMDEAIKHCTKGIGIWEWASNDDCGKEPDEPDVIMACCGDVATREALAATAILREEFPQLKVRFVNVVDLFKLQSESEHPHGLSDRSFDTLFTVDKPIIFNFHGYPWLIHKLTYHRTNHDNLHVRGYKEKGNINTPLELAMNNQIDRFNLVLDVIDRVPKLGSAAAYVQQRMKNAIIEHRAYAYENGIDKPEMTNWKWPF

SEQ ID NO: 403 - protein, 802 aa, Cyanothece sp. CCY0110
MVATPNKPQVEKTPLSPEELRKIHAYWSACNYLAVGMIYLQDNPLLKEPLKEEHIKNRLLGHWGSSPGLSFIYIHINRLIKKYDLNTIYIAGPGHGAPGVLGPVYLEGTYSEIYPDKSEDEEGMKAFFKQFSFPGGIGSHCTPETPGSIHEGGELGYSLSHAYGSVFDNPDLISVAVVGDGESETGPLATAWHSNKFLNPIRDGAVLPILHLNGYKIANPTILARVSHEELECLFKGYGYKPYFVEGSDPEQMHQKMAATLETVISEIKAIQKEARDTGVAKRPMWPMIVLHSPKGWTGPTEVDGKKTEDFWRSHQVPLSGMHNNTEHLKLLEEWLKSYKPEELFDDTGKLIPELKDLAPTGKRRMSANPNSNGGLLRKDLRLPNFRDYAVEVDQPGAVEAGNTHRLGVFLRDVMANNMNIFRVFGPDETASNRLTPIYEASKKVWMGEIIDADADGTEITPDGRVMEMLSEHTLQGWLEGYLLTGRHGFFHTYEAFAHVVDSMFNQHAKWLDICKHEVPWRVPIPSLNILLSSTVWRQDHNGFSHQDPGYVDVVTNKSPDVVRVYFPPDANCLLSVTDHCLKSKNYVNVIVADKQKHLQYLSMEEAVKHCTKGIGIWEWASNDDCGKEPDEPDVIMASCGDIPTRESLAATAILREEFPHLKVRFINVVDLFKLQPESEHPHGLSDKDFDTLFTTNKPIMFNFHGYPWLIHKLTYRRTNHHNLHVRGYKEKGNINTPLELAINNQIDRFNLVIDVIERVDKLGSAAAYVQQRMKNAIIEHKAYAYEHGLDKPEISNWKWPL

SEQ ID NO: 404 - protein, 802 aa, Planktothrix rubescens NIVA-CYA 98
MVSAPDRPMETSNPLSEDELRKIDAYWRACNYLAVGMIYLRENPLLKESLKPSDVKHRLLGHWGSSPGLSFIYIHLNRLIKKYDLDMIYLAGPGHGAPGVLGPVYLEGTYSEIYPNISEDAEGMQKFFKQFSFPGGIGSHCTPETPGSIHEGGELGYSLSHAYGSVFDNPGLISVCVVGDGEAETGALATAWHSNKFLNPIRDGAVLPVLHLNGYKIANPTILSRISHEELEALFKGYGYKPYFVEGCDPALMHQKMADILETAISEIKAIQAEARSTGIAKRPLWPMIVLRSPKGWTGPTEVNGHKVEGFWRSHQVPMADVTTNPTHLKLLEDWMRSYKPEELFDANGRLIPELKDLAPKGTKRMSASPHANGGVLRKDLRLSDFRDYGVPVEYPGKSEVENTNPLGKFLRDVMRNNLQNFRVFGPDETASNRLNAIYEVSKKTWMGDFLPEDLDGSELATDGRVMEILSEHTLEGWLEGYLLTGRHGFFHTYEAFAHVIDSMFNQHAKWLDICRNEVSWRSPISSLNILLSSTVWRQDHNGFSHQDPGFLDVVTNKSASVTRIYLPPDANCLLSVADHCLKSTNYINVIVADKQKHLQFLTMDEAIKHCTKGIGIWEWASSDDCGKDPDIPDVIMAGCGDVATMESLAATAILREEIPDLKVRFVNVVDLFKLQPDTEHPHGLSDRDFDSLFTTDKPIIFNFHGYPWLIHKLAYRRKNHANMHVRGYKEKGNINTPLELAINNQVDRFNLVIDVIDRVPKLGSAAAYVRERMKNAIIENVNYAHEHGIDKDEIVDWKWPF

SEQ ID NO: 405 - protein, 805 aa, Arthrospira maxima CS-328
MVAAPSQTLETTYPLSDEEIRKTHAYWRACNYLCVGMIYLRDNPLLKEPLKPEHIKYRLLGHWGSSPGLSFIYIHLNRLIKKYDLNMIYIAGPGHGAPGVLGPVYLEGTYSEVYPDKSQDAEGMGKFFKQFSFPGGIGSHCTPETPGSIHEGGELGYSLSHAYGTVFDHPELITAAVVGDGEAETGPLATAWHSNKFINPIRDGAVLPILHLNGYKIANPTILSRIPNEELKNLFRGYGYTPYLVECSQDEDYGSAHRKMAATLEHCINEIRDIQQQARSSGKATRPQWPMIILRSPKGWTGPKEVDGRKVEGFWRAHQVPMSNVIGNPHQMKILEDWMRSYQPEELFDENGTLIPELKELAPTGVRRMSANPFANGGIWRRDLNMPDFRKYAVEVPKPGQSEAENTRPLGNFLRDVMGKNMTNFRMFGPDETASNRLNAVYEVSKKTWMGEFLEEDLDGSELAADGRVMEMLSEHTLQGWLEGYLLTGCHGFFHTYEAFAHVVDSMFNQHAKWLEVCKKEVPWRSPIASLNILLSSTVWRQDHNGFSHQDPGYVDLVTNKSPDVVRVYFPPDANCLLSCANHCLQSKDYVNVIVADKQKHLQFLNMDDAIKHCTKGIGIWEWASNDDCGKDPDIPDVVMAGCGDVATKESLAATAILRSEFPELKIRFINVVDLFKLQPDTEHPHGLSDWDFDSLFTTDKPIIFNFHGYPWLIHKLAYRRTNHPNLHVRGYKEKGNINTPLELAIENQVDRFNLVIDVIDRVPKLRSAAAYVRERMRNAIIENVAYAYEHGQDQEEISNWKWPF

SEQ ID NO: 406 - protein, 802 aa, Cyanothece sp. PCC 7822
MVAAPEKPILEQQPLSAEELRKIDAYWRACNYLAVGMIYLKDNPLLKRPLQPEDIKARLLGHWGTSPGLSFTYVHLNRLIKKYDLDMIFLAGPGHGAPGVLGPVYLEGTYSEIYPDKSEDEEGLQKFFKQFSFPGHIGSHCTPETPGSIHEGGELGYSVSHAYGAAYDNPNLIVSVVVGDGEAETGPLATAWHSNKYLNPIRDGAVLPILHLNGYKIANPTILARISPEELESLFIGYGYTPYVVEGDDPHIMHQKMAATVEQCITQIRSIQEEARSSGVAKRPRWPMIILRTPKGWTGPKEVDGKKVEGFWRAHQVPMGEMQNNPDHLKMLEDWMRTYKPEELFDETGKLIPELKELAPKGIRRMSANPHANGGILRKDLKLPDFRDYAVSVSAAGKEEVANTGLLGEFLRDVIKNNPTSFRLFGPDETASNRLQAVYEVTQKAWLANYLAEDEGGSLLSPDGRVMEMLSEHTLEGWLEGYLLTGRHGLFHTYEAFAHVIDSMFNQHAKWLDICKHEVSWRVPISSLNILLSSVVWRQDHNGFSHQDPGFIDLVTNKSAEVVRVYLPPDANCLLSVADHCLRSTNYVNVIVSDKQKHLQYLSMDEAIKHCTKGIGIWEWASNDDRDKEPDNPDVIMACCGDIPTMESLAATAILRAEFPDLKVRFINVVDLFKLQSESEHPHGLSERDFDGLFTQDKPIIFNFHGYPWLIHKLTYRRSNQERIHVRGYKEKGNINTPLELAINNEIDRFSLVIDVIDRVPKLGSAAAYVKERMKNEIIDNLHYARTHGMDKAEILDWKWPY

SEQ ID NO: 407 - protein, 802 aa, Cyanothece sp. PCC 7424
MVAAPEKPTIQQDPLSAEELRKIDAYWRACNYLAVGMIYLKDNPLLKRPLQPEDIKPRLLGHWGTSPGLSFTYVHLNRLINKYDLDMIYMAGPGHGAPGVLGPVYLEGTYSEIYPDKSEDEEGMQKFFKQFSFPGHIGSHCTPETPGSIHEGGELGYSVSHAYGAAYDNPDLIVSVVVGDGEAETGALATSWHSNKYLNPIRDGAVLPILHLNGYKIANPTILARITPEELESLFIGYGYTPYVVEGDDPHLMHQKMAATLEHCINQIRHIQQEARSSGVVHRPRWPMIILRSPKGWTGPKEVDGHKVEGFWRAHQVPMGNMQNNPEHLRMLEEWMKGYRPDELFDENGKLIPELKELAPKGHRRMSANLHANGGVLRKDLRMPDFRDYAVEISTPGTEEVENTRLLGEFLRDVMRNNMTSFRLFGPDETASNRLQAVYEVSQKTWMAEFYPEDLDGSYLSREGRVMEMLSEHTLEGWLEGYLLTGRHGFFHTYEAFAHVIDSMFNQHAKWLDICKHDVHWRASVSSLNILLSSVVWRQDHNGFSHQDPGFIDLVTNKSAEVVRVYLPPDANCLLSVANHCLRSKDYVNVIVADKQKHLQYLSMDEAIKHCTKGIGIWEWASNDDQGKEPDEPDVIMACCGDIPTMESLAATAILREEFPELKVRFINVVDLFKLQSESEHPHGLSEWDFDSLFTHDKPIIFNFHGYPWLIHKLTYRRSNQERIHVRGYKEEGNINTPLELAIRNQVDRFNLVIDVIDRVPKLGSAAAYVKERMKNEIIDNLQHAFEQGSDKPEIVEWKWPY

SEQ ID NO: 408 - protein, 806 aa, Microcystis aeruginosa NIES-843
MVFTPERPLTEQNPLSQDELYKTHAYWRACNYLAVGMIYLRDNPLLKEHLKPEHVKYRLLGHWGASPALSFTYVHLNRLIKKYDLDMIFMAGPGHGAPGVLGPVYLEGTYSEIYPDKSEDEEGLQKFFKQFSFPGHIGSHVTPETPGSIHEGGELGYSVSHAYGSVFDNPDLITAVVVGDGEAETGPLATAWHSNKFLNPIRDGAVLPILNLNGYKIANPTILSRISTHELESLFVGYGYTPYIVECKEDEDLMHCHQKMAATLEHCINQIRSYQQEARSTGVAKRYPWPMIILRSPKGWTGPKNVDGHKVEGFWRAHQVPMGAMQENPEHLRKLEEWMKSYNPEELFDYTTGKFKPEFKELAPRGHRRMSANPHANGGLLRKDLKMPDFRQYAVDVTHPGQVEAENTGVMGVFLRDVMRNNMTNFRVFGPDETASNRLAALYEVTKKAWLADTYPEDLDGSQLSPDGRVMEMLSEHTLVGWLEGYLLSGRHGLFHSYEAFAHVIDSMFNQHAKWLDICKNHVPWRASVSSWNLLLSSVVWRQDHNGFSHQDPGFIDLVTNKSADVVRVYLPPDGNCLLSVANHCLKSKDYTNIIVADKQKHLQYLTIEEAIKHCTKGIGIWDWASNDDDGTNPDEPDVIMACCGDIITKESLAATAILREEFPYLKVRFINVVDLFKLQSESEHPHGLSERDFDSLFTTDKPIIFNFHGYPWLIHKLTYRRSNQERIHVRGYKEEGNINTPLELAIRNQVDRFHLVIDVIDRVPKLGSAAGHVKERMKNAIIDNLDYAFTNGIDKDEITNWKWPY

SEQ ID NO: 409 - protein, 804 aa, Lyngbya sp. PCC 8106
MVTAPNIPTEITNPLNDDELRKTQAYWNACHYLALGMIYLMDNPLLKEPLRPEHTKPRLLGHWGASTALSFIYIHLNRLIKKYDLDVILMAGPGHGAPGILAPTYLEGTYSEVYPDKSEDYEGLRKFFKQFSFPGHIGSHCTPETPGSIHEGGELGYSLSHAYGAAFDNPDLIVTAVVGDGEAETGPLATAWHSNKFLNPVRDGAVLPILNLNGYKIANPTILARISPEELESLFVGYGYTPYVVEHVDGDDASITHQKMAATMEHCVNQIRSIQEEARRTGEAKRPRWPMIILRTPKGWTAPKKIDGHKVEGFWRAHQVPMSDVGKNPDHLRILEDWLLSYKPDQLFDDNGKLIPELRELPPTGHRRISANLHANGGMLRKDLKMPDFRKYGVEVRDPGRSEAGNTQILGEFLRDVMRNNMTNFRVFGPDETASNRLQAIYEVSKKTWLADFKEEDLDGSELSPDGRVMEMLSEHTLIGWLEGYILTGRHGFFHTYEAFAHVIDSMFNQHAKWLDISKEVPWRAPISSWNILLSSTVWRQDHNGFSHQDPGFVDLVTNKSASVTRIYFPPDVNCLLSVANHCLRSKDYVNVIVADKQKHLQYLTMEDAVKHCTKGIGIWDWASNDDRGVEPDIPDVVMASCGDITTREALAATAIMREEFPELRVRFINVVDLFKLQSESEHPHGLSNRDFDTLFTADKPVIFNFHGYPWLIHKLAYRRTKQERIHVRGYKEKGNINTPLELAIKNQIDRFNLVIDVIDRVPKLGSAAAHVKERMKNAIIENLNYAFENGKDKEDVDNWKWPY

SEQ ID NO: 410 - protein, 808 aa, Nostoc sp. PCC 7120
MTISPSKPKSSDVKQDKSAPLSTEELYQINAYWRACNYLALGMIYLQDNPLLKQPLKPGHIKNRLLGHWGSSPGLSFIYVHLNRLIKKYDLDVIYIAGPGHGAPGILGPTYLEGTYSEVYPDKSEDEEGMLKFFKQFSFPGGIGSHCTPETPGSIHEGGELGYSLSHAYGAAFDNPDLIVTAVIGDGEAETGPLATAWHSNKFINPIRDGAVLPILHLNGYKIANPTILARISHEELEDLFKGYGYTPYFVEGHDPAQVHQLMAATLETVILEIKKIQTEARTSGVAKRPRWPMIVLRTPKGWTAPAEIDGHKLEGFWRSHQVPITDVATNPDHLKILEQWMKSYKPEELFDEHGSLIPELKELAPIGHRRISANPVANGGILRKELRLSDFRNNAVEVSKPGAVEVENTKPLGNFLRDIMRNNMTNFRIFGPDETASNRLSAVYEVSEKTWLADILPEDADGSELSTDGRVMEMLSEHNLFGWLEGYLLSGRHGLFHSYEAFAHIVDSMFNQHAKWLEISKNEVAWRSPISSENILLSSTVWRQDNNGFSHQDPGFIDLVTNKSANVTRIYLPPDANCLLSVADHCLRSTNYVNVIVADKQKHLQFLSIEEAIAHCTKGIGIWDWASNDHHGQEPDLPDVIMASCGDVVTMEALAATAILRDEFPDLKVRFINVVDLYKLQPDTEHPHGLSDWDFDSLFTTDKPVIFNFHGYPWLIHKLAYRRTNHENIHVRGYKEKGSINTPLELAINNQVDRFNLVIDVIDRVPKLGSAAVYVRERMKKEIINNRNYAHKHGIDQPEILNWKWPY

SEQ ID NO: 411 - protein, 808 aa, Synechococcus sp. PCC 7335
MTAIVSSQSSESIASLDITPPSEDELNKIDAYWRACHYLAVGMIYLRDNPLLKESLTKKHVKHRLLGHWGASPALSFTYVHCNRLIKKYDLDMIFVAGPGHGAPGVLGPVYLEGTYSETYPDKSEDEEGMQRFFKQFSFPGDIGSHVTPETPGSIHEGGELGYSLSHAYGSVLDNPDLITCCVVGDGESETGPLATAWHSNKFINPARDGAVLPVLNLNGYKIANPTIFARISHEELEYMFRGYGYTPYFVEGSDPAQMHRKMAETMEACIIKIKEVQREARVNGNVKRPRWPMIVLRSPKGWTGPDQVDGKKVEDFWRSHQVPMGGMHSNEDHLRRLEAWMRSYKPEELFDENGTLVPELKELAPKGSRRMSANPHANGGLLRRALKMPRFQDYAIQMERHGVEEYENTKVLGQLMRDIFRDNPNNFRLMGPDETASNRLQDVYDTTKKVWMAELYPEDEDGGNLARDGRVMEMLSEHTLQGWLEGYLLTGRHGLFHTYEAFAHVVDSMFNQHAKWLDICKNHVPWRQSVSSLNILLSSLVWRQDHNGFSHQDPGYVDLITNKSPEVVRAYFPPDANCLLSVADHCFRSVDYINVIISDKQKHLQYLPMDEAIRHCTKGIGIWDWASNDDCGTEPDVPDVVMACCGDIPTQEALAATAILREEFPSLKVRFINVVDLFKLMSEGEHPHGLSNRDFDSLFTPDKPVIFNFHGYPWLIHKLVYRRSNQDRIHVRGYKEEGNINTPLELAINNQIDRFGLVIDVIDRVPSLGSAAGHVKERMKNKIIECLSYAHEHGTDPEELVNWKWPY

SEQ ID NO: 412 - protein, 806 aa, Acaryochloris marina MBIC11017
MVHTPVAPTSRPLSELELHNIDAYWRACNYLAVGMIYLRDNPLLKEPLQSAHVKHRLLGHWGASPALSFTYIHCNRLIKKYALDMIFMAGPGHGAPGVLGPVYLEGTYSEIYPDKSEDSEGMRRFFKQFSFPGFIGSHVTPETPGSIHEGGELGYSVSHAYGAVLDNPDLIVTCVVGDGEAETGPLATSWHSNKFINPARDGAVLPVLNLNGYKIANPTLLARISHEELEYLFRGYGYTPYFVEGKNPAEMHQKMAAVMEECILTIKKVQREARINGTLERPRWPMIVLRTPKGWTGPKEVDGKKVEDFWRSHQVPMGGMQDNPDHLQQLEAWMRSYKPEELFDEHGTLIPELKALTPVGNRRMGSNPHANGGLLRKALKLPSFQDLAIDIGEQHGTVTFENTKALGIFMREIIRKNPNNFRLMGPDETASNRLQDVYQVTKKVWMADLYPEDEDGTELSRDGRVMEMLSEHTLQGWLETYLLTGRHGLFHTYEAFAHVVDSMFNQHAKWLDICRNHVPWRRSVSSLNILLSSLVWRQDHNGFSHQDPGYVDLVTNKSPDVVRLYFPPDANCLLSVADHCFRSVDYINVIISDKQKHLQYLSIDEAVAHCTKGIGIWDWASNDDCGTEPDEPDVVMASCGDIPTMEALAATAILREEFPWLKVRFVNVVDLFKLVSEGEHPHGLSDRDFDSLFTPDKPIIFNFHGYPWLIHKLVYRRSHQERIHVRGYKEQGNINTPLELAIKNEVDRFNLVIDVIDRVPKLGSAAGHAKERMRNKIIECLAYAHEHGKDQDEIVNWTWPYVGVCE

SEQ ID NO: 413 - protein, 825 aa, Synechococcus sp. PCC 7335
MTASVPAQISVENLPLSTEELRKIDAFWRACNYLAIGMIYLKDNPLLRAPLAAEHIKPRLLGHWGTSPGLSLMYVHFSRLIKKYDLNAIFMAGPGHGAPGVLAPAYLEGTYSEIYPDISEDAEGMQKFFKQFSFPGHIGSHCTPETPGSIHEGGELGYSLSHAYGSVFDNPDLITLVAVGDGEAETGALATSWHSNKFLNPAQDGAVLPVLHLNGYKIANPTILSRISHRELSSLFVGYGYTPHFVEGDCPELVHQQMASVMEDCVSQIRAIQAEDRSIQHDDIHAGDQSGSQSKTHRPERPLWPMIVMRTPKGWTGPDEVDGHQVADFWRSHQVPLSGVKDNPEHLQMLENWLRSYRPEELFDKSGRLIEELRELPPKGDRRLSANPVANGGLLRKPLKLPNFRDYAVTVGHPGKTQVENTRLIGRFLKDVIAQNLTDFRLFGPDETLSNRLGEVFEVTSRVWMGDYLPADADGGFLSPTGRVMEMLSEHTLQGWLEGYLLTGRHGMFHTYEAFAHVVDSMFNQHAKWLDISKNVVPWRAPVASLNILLSSVVWRQDHNGFSHQDPGFIDLVTNKSPDVTRIYLPPDANCLLSVVNHCLKSTDYINVIVSDKQKHLQYLTMDEAVRHCTKGIGIWEWASNDDRGKAPDEPDLIMACCGDIPTMESLAATAILREEFPDLRVRFINVVDLYKLIHPKDHDHGLSDPDFNTLFTTDKPVIFNFHGYPWLIHKLVYSRANQERIHVRGYKEKGNINTPLELAINNQIDRFNLVIDAVNRVPKLGSRGAYVKERMQNEIIDHVSYARLHGEDKPQTSSWTWPAWAVGQ

SEQ ID NO: 414 - protein, 798 aa, Burkholderia graminis C4D1M
MSSNRASDSSYPTALSNDELRRIDAWWRACNYLSVGMIYLKDNPLLREPLKVDHVKHRLLGHWGASPALSFVWAHLNRVIKRDDLDMIFMAGPGHGAPGVLGPAYLEGTYSEVYPDKSEDAEGMQKFFKQFSFPGHIGSHVTPETPGSIHEGGELGYSLAHAYGAALDNPDLIVACVVGDGEAETGPLATAWHSNKFINPARDGTVLPILNLNGYKIANPTILSRISHGELAALLEGYGYMPYFVEGSDPSQMHQTMAGTLDTVIADIRAIHERARADGNAERPRWPMIVLRTPKGWTGPKEINGHKVEGSWRSHQVPFSDVRGNPANLDLLESWMRGYRPGELFDDSGRLLAELRELAPQGPRRMSANPHANGGLLRRDLKLPDFRDYAVEVSRAGNVLRENTQPLGQFLRDTMRCNMDTFRVFGPDETASNRLQSIYEVSKKAWMADMLPEDDDGGELSRDGRVMEMLSEHTLMGWLEGYLLSGRHGFFHTYEAFAHVVDSMFNQHAKWLDVCKNHVPWRASVASENILLSSTVWRQDHNGFSHQDPGFIDLVTNKSPSVTRVYLPPDANTLLVVADQCLRSTDCINVIVADKQKHLQFTTIDEAVVHCAKGMGLWRRASNDEDMEPDAVMASCGDVATQEALAATAILRERLPELKLRFVNVVDLFKMQPVTEHPHGSTEREFDSLFTVDKPVIFNFHGYPWLIHKLAYRFRNHENLHVRGYTEKGNINTPLELAILNKVDRFNLVLDVLDRVPRLQGRTAHLREDMRNAIILNMNYAHEHGTDNPELSEWVWPY

SEQ ID NO: 415 - protein, 798 aa, Burkholderia sp. H160
MGQHSAADASQQTALGSDELRLIDAWWRACNYLSVGMIYLLDNPLLREPLKVDHVKYRLLGHWGASPALSFVWAHLNRVIKRDDLDVIFMAGPGHGAPGVLGPTYLEGTYSEIYPDKSEDAEGMQKFFKQFSFPGHIGSHVTPETPGSIHEGGELGYSLSHAYGAALDNPDLIVACVVGDGEAETGPLATAWHSNKFINPARDGTVLPILNLNGYKIANPTILARISNRELEALFVGYGYTPHFVEGSDHAEMHQKMAHTLDTVLGEIHEIHEQARVKGNLERPLWPMIVLRSPKGWTGPKEINGHKVEGSWRSHQVPFSDVRNTPANLEVLEQWMRSYRPDELFDADGTLIPELKALSPAGPRRMSANPHANGGVLRRELKLPDIREYAVDVHHAGKVLHENTRPLGEFLRDTMRANMNTFRVFGPDETASNRLQAIYEVSKKVWMADMLPEDDDGGELARDGRVMEMLSEHTLMGWLEGYLLTGRHGFFHTYEAFAHVVDSMFNQHAKWLDISRNHVPWRAWVSAENILLSSTVWRQDHNGFSHQDPGFIDLVTNKSPSVTRVYLPPDANTLLVVADHCLRTTDCINVIVADKQKHLQFATIDEAVVHCAKGIGVWRRASNDEDAEPDVVMASCGDVATQEALAATAILRERLPELKLRFVNVVDLFRMQPASEHPHGSTEREFDSLFTTDKPVIFNFHGYPWLIHKLAYRFRNHENLHVRGYKEKGNINTPLELAILNQVDRFTLVIDVLDRVPRLQGRSAHLREDMRNAIVSNLNYAHTHGTDRADVADWVWPF

SEQ ID NO: 416 - protein, 807 aa, Synechococcus sp. WH 5701
MVSTTQSSDPAATPADSDQELTLLDAWWRAANYLAVGMIYLRANPLLAEPLRHEHIKARLLGHWGSSPGQAFLWAHANRVIRRHDLDMIYLSGPGHGAPGVLGPTYLDGSYSEVYPDKSRDTEGMQRFFKQFSFPGHIGSHCTPETPGSIHEGGELGYVLSHACGAVFDNPDLIALACVGDGEAETGPLATSWHINKFLNPIGDGAVLPVLHLNGYKIANPTLLARIPREELASLMRGYGWEPLFVEGHEPMAMHRAMASAMDEAVARILQIRAEARRSGEAVRPAWPMIVLRSPKGWTGPAELHGKKLEGFWRSHQVPLPAPNKDPEQLAMLEAWLRSYRPEELFDADGTLRSELQALSPQGPRRMGSSPHANGGLLRRKLRLPPIESYAVPVERPGQSEHENTAPLGALLRDIIGTNPDSMRVFGPDETASNRLQAIYEVSKKVWMEELLPEDAGGSELARSGRVVEMLSEHTLVGMMEGYLLTGRYGFFHTYEAFAHVIASMFNQHAKWLESCIHHAPWRAPIGPWNCLISSTVWRQDHNGFTHQDPGFIDLAGNKSGEVVRVYLPPDANCLLAVAEEALMETNVCNIIVSDKQKHLQYMTLEQARAHVSKGIGIVSWASNDDCGTDPDEPDVVMACAGDIPSKETLAAVEILRREIPQLKIRVLNVVKLFALTQPSEHPHGLSDRDFDTLFTTDKPVIFNFHGYPWLIHRLTYRRTNHANLHVRGYKEKGNINTPLELAMNNQIDRFNLVMDVIDRVPALGYRVAHVKERMKDAIHRHREYAHTHGQDSPEVTDWRWTLPLES

SEQ ID NO: 417 - protein, 813 aa, Cyanobium sp. PCC 7001
MGELTDTAIPLLASSLPAPSSTPSEQELELIDRWWRAANYLAVGMIYLQDNPLLTEPLQSAHIKNRLLGHWGSSPGQAFIWAHANRVIRQRDLEMLYLSGPGHGAPGVLAPTYLDGSYSEVYPDISLDAEGMRRFFKQFSFPGHIGSHCTPETPGSIHEGGELGYVLSHACGAVFDNPELIALACVGDGEAETGPLATSWHINKFLNPISDGAVLPVLHLNGYKIANPTLLARIPRDELASLLRGYGWEPIFVEGHEPMAMHRAMAAAMDQAVDAIQRVQRQCRASGEAVRPAWPMIVLRSPKGWTGPHDLRGQKLENFWRAHQVPLPGPKHDAEQLAMLEGWMRSYRPQELFDGEGTLLPELQALSPEGPRRMGSCPHANGGQLRRSLRLPPIETYAVAVDQPGHGEHENTAPLGALLRDTIARNPDSLRVFGPDETASNRLQAIYAVSKKVWMEDFLPEDMNGSELAREGRVVEMLSEHTLVGMMEGYLLTGRYGFFHTYEAFAHVIASMFNQHAKWLESCIHHAPWRAPVGSWNCLISSTVWRQDHNGFTHQDPGFIDLAGNKSGEVVRVYLPPDANTLLAVAEEALLETNVCNIIVSDKQKHLQYLSLEEARRHVAKGISLISWASNDDHGTEPDDPDVVMACAGDIPTKETLAAVQILRRECPQLKIRVVNVVKLFALTEPSEHPHGLSDRDFDSLFTTDRPVMFNFHGYPWLIHRLTYRRTNHRNFHVRGYKEKGNINTPLELAMNNQIDRFNLVIDVIDRVPSLGSRAAHVKERMKNAILANRAHAHEHGMDAPEITNWRWSTPEA

SEQ ID NO: 418 - protein, 811 aa, Synechococcus sp. WH 7805
MTVTPFLHVSGADNLQAPSDHELQRLDAYWRAANYLAVGMIYLQDNPLLREPLRPEHIKNRLLGHWGSSPGQAFIWTHANRLINTYDLDMIYMSGPGHGAPGARGPVYIDGSYTERYPDKSLDEDGLKKFFKMFSFPGHIGSHCTAEMPGSIHEGGELGYVLSHAAGSVFDNPELITVACVGDGEAETGPLATSWHINKFINPIKDGAVLPVLHLNGYKIANPTILSRIDHDELESLFRGLGWTPIFVEGSDPMEMHRKMAVAMEQAVLEIRAIQEEARGSGEAFRPRWPMVVLRSPKGWTGPQELDGKKIENFWRAHQVPIGDVKANPDHLRLLEDWMKSYRPWELFDDNGAVREEIRALSPTGDRRMGSNPHTNGGVLRKDLRFPELRNYEVPVESPGTTEKENTYPLGELIRDLINHNPGAYRLFGPDETASNRLQAVYETTKKAWMANFLPEDLNGSELARDGAVVEMLSEHTLVGMMDGYLLTGRNAFFHTYEAFAHVVASMYNQHCKWLEHCEEIPWRAPIGPWNCLISSTVWRQDHNGFTHQDPGFIDLAGNKKGSITRVYLPADANSLLAVSEKALTETDVANIIVSDKQKHLQYLTLDEARRHVAKGAGIWEWACNDNCGVDPDEPDVVLASAGDIPTKECLAAIEILRSQTPHLKIRYVNVVKLFSLGNPKDHPHGLSDRDFESLFTPDKPVIFNFHGYPWLIHRLTYNRPNHSNFHVRGYKEQGNINTPLELAICNQIDRFNLVIDVIDRVDSLGSRAAHVKEQMKDEIHKHRAYAYEHGTDAPEINNWRWSLGRSSCAV

SEQ ID NO: 419 - protein, 811 aa, Synechococcus sp. WH 7803
MTVTPLLHLSGSEHLQAPADDELQRLDAYWRAANYLAVGMIYLQDNPLLREPLRPEHIKNRLLGHWGSSPGQAFIWTHANRLIKAYDLDMIYMSGPGHGAPGARGPVYIDGSYSERYPDKSLDETGLKKFFKMFSFPGHIGSHCTAEMPGSIHEGGELGYVLSHAAGSVFDNPELITVACVGDGEAETGPLATSWHINKFLNPIKDGAVLPVLHLNGYKIANPTILSRIDHEELDSLFRGLGWTPIFVEGCDPMEMHRKMAVAMEQAVLEIRAIQEQARSSGEAFRPRWPMIVLRSPKGWTGPQELDGKKIENFWRSHQVPIGDVKTNPDHLQLLEDWMKSYRPWELFDDSGAVREEIRALSPKGDRRMGSNPHTNGGVLRKDLRFPELRNYEVPVEIPGTTEKENTYPLGELIRDLISNNPGGYRLFGPDETASNRLQAVYETTKKAWMANFLPEDLNGSELSRDGAVVEMLSEHTLVGMMDGYLLTGRYGFFHTYEAFAHVVASMYNQHCKWLEHCEEIPWRAPIAPWNCLISSTVWRQDHNGFTHQDPGFMDLAGNKKGSITRVYLPADANSLLAVAEKALTETDVANIIVSDKQKHLQYLTLDEARRHVAKGAGIWEWACNDNCGIDPDEPDVVLASAGDIPTKECLAAIEILRSEIPHLKVRYVNVVKLFAMANPKDHPHGLSDRDFESLFTPDKPVIFNFHGYPWLIHRLTYNRPNHNNFHVRGYKEQGNINTPLELAICNQIDRFNLVIDVIDRVESLGSRAAHVKEQMKDEIHKHRAYAHEHGTDAPEINNWRWSLGRSSCNV

SEQ ID NO: 420 - protein, 809 aa, Synechococcus sp. RS9917
MTTTPYQAAAAHVQAPMEEELQRLDAYWRTANYLAVGMIYLQDNPLLREPLQPEHIKNRLLGHWGSSPGQAFIWTHANRLINKYDLDMIYMSGPGHGAPGARGPVYIDGSYTERYPDKSLDEAGLKKFFKMFSFPGHIGSHCTAEMPGSIHEGGELGYVLSHACGSVFDNPELITIACVGDGEAETGPLATSWHINKFINPVKDGAVLPVLHLNGYKIANPTILSRIPHEELDSLLKGYGWSPIVVEGSDPMTMHRQMAVAMEQAVLEIRAIRDQARSSGEAFRPRWPMIVLRSPKGWTGPQEIDGKKIENFWRSHQVPVADVKSNESHLRLLEDWMKSYRPWELFDDNGAVREEIRAMAPKGDRRMGSNPHTNGGELRKELFFPDLRNYEVPVTSPGTTEKENTYPLGELIRDLISLNPGGYRLFGPDETASNRLQAVYGATKKVWMADFLPEDLNGSELSRDGAVVEMLSEHTLVGMMDGYLLTGRNGFFHTYEAFAHVVASMYNQHCKWLEHCEEIAWRAPIGPWNCLISSTVWRQDHNGFTHQDPGFIDLAGNKKGSITRVYLPADANSLLAVAETALTETDVANIIVSDKQKHLQYLTLDQARRHVAKGAGIWEWACNDNCGVEPDDPDVVLASAGDIPTKECLAAIEIMRERIPYIKIRYVNVVKLFALAAPKDHPHGLSDVDFASLFTPDKPVIFNFHGYPWLIHRLTYNRPNHNNFHVRGYKEKGNINTPLELAISNQIDRYDLVIDVIDRVEKLGSRAAHVKEQMKDEIQMHRAYAYEHGTDAPEINNWRWSLGHGSCKA

SEQ ID NO: 421 - protein, 797 aa, Burkholderia phytofirmans PsJN
MAEATAHPTPPQTLDADTLRNMDRYWRACNYLSAGMIYLRDNPLLREPLKPEHIKNRLLGHWGSDPGQSFLLVHLNRLIKKLDLNVIYVAGPGHGAPATLANCYLEGHYSEIYPDRSQDVAGMERFFRQFSFPGGIGSHCTPETPGSIHEGGELGYSLSHGYGAAFDNPDLIVAVMIGDGEAETGPLATSWHSNKFLNPIRDGAVLPVLHLNGYKIANPTILARIPREELEALLTGYGHKPYFVEGEDPAVMHQQMAATLEQCIGEIRAIQQHARESNDASRPRWPMIVLRSPKGWTGPKEVDGHKVEGSWRAHQVPVLDPATNSKSLKLVENWLRSYEPETLFDEAGRLVKELRELAPEGARRISANPHANGGVLCKTLAMPPFRDYAVAVKKPAGSYTSPTEVLGKFLRDVMRNNMTNFRVFGPDETSSNKLTAIYEASEKTWLAQTVPSDADGGELAVDGRVMEMLSEHTLEGWFEGYVLTGRHGLFATYEAFVHVIDSMFNQHAKWLEKAKRDLGWRQPVPSINLLITSLVWRQDHNGFTHQDPGFLDVVTNKSPDVVRIYLPPDANCLLSVADHCLRSRDYVNVIVADKQPHLQYLDMDAAVTHCTKGIGIWDWASTDQGVEPDVVMACAGDIPTMEALAAVQILKEQFADLKIRFVNVVDLFRLMPEHAHPHGLSSRDFDSLFTTDKPVIFNFHSYASLVHKLTYNRTNHDNLHVHGYHEKGNINTPLELAIINQVDRFSLAIDVIDRVPRLRGVGDHAKEWLRGQIIEHLAYAHAEGIDKEEIRNWTWKG

SEQ ID NO: 422 - protein, 797 aa, Burkholderia xenovorans LB400
MAEASSRPTPPQVLDADTLRNMDRYWRACNYLSAGMIYLRDNPLLREPLKPEHIKNRLLGHWGSDPGQSFLLVHLNRLIRKLDLNVIYVAGPGHGAPATLAHCYLEGHYSEIYPDRSEDEAGMQRFFRQFSFPGGIGSHCTPETPGSIHEGGELGYSLSHGYGAAFDNPDLIVTVMIGDGEAETGPLATSWHSNKFLNPVRDGAVLPVLHLNGYKIANPTILARIPREELEALLTGYGHKPYFVEGDDPAVMHQQMAATLEQCIGEIRAIQQHARANNDATRPRWPMIVLRSPKGWTGPKEVDGHKVEGSWRAHQVPVLDPVTNGKSLKLVENWMRSYEPESLFDEAGRLVEELRELAPKGARRISANPHANGGLLCKTLDMPAFGDYAVAVKKPGGTYTSPTEVLGKFLCDVMRRNMTNFRVFGPDETASNKLTAIYEASEKTWLAQTEPSDADGGDLAVDGRVMEMLSEHTLEGWFEGYVLTGRHGLFATYEAFVHVIDSMFNQHAKWLEKAKRDLGWRQPVPSINLLITSLVWRQDHNGFTHQDPGFLDVVTNKSPDVVRIYLPPDANCLLSVADHCLRSRDYVNVIVADKQPHLQYLDMDAAVIHCTKGIGIWDWASTDQGVEPDVVIASAGDIATMEALAAVQILKERFADLKIRFVNVVDLFRLMPEHAHPHGLSNRDFDSLFTATKPVIFNFHSYASLVHKLTYNRTNHDNLHVHGYHEKGNINTPLELAIINQVDRFSLAIDVIDRVPKLRGVGDHAKEWLRGQVIEHLAYAHAEGIDREEIRNWTWKG

SEQ ID NO: 423 - protein, 797 aa, Burkholderia graminis C4D1M
MAEAISRPAPPQTLDPDTLRKMDRYWRACNYLSAGMIYLRDNPLLREPLKPEHIKNRLLGHWGSDPGQSFLLVHLNRLINKLDLNMIYISGPGHGAPATLANCYLEGHYSEIYPDRSEDEAGLRRFFRQFSFPGGIGSHCTPETPGSIHEGGELGYSLSHGYGAAFDNPDLIVAVMIGDGEAETGPLATSWHSNKFLNPVRDGAVLPVLHLNGYKIANPTLLARIPREELEALLTGYGHKPYFVEGDDPNVMHQQMAATLEQCIGEIRAIQQHARASNDTTRPRWPMIVLRSPKGWTGPKEVDGHKVEGSWRSHQVPIADPATNSKSLKLLEGWLRSYEPESLFDESGRLVEELRELAPKGTRRISANPHANGGVLCKMLDMPAFRDYAVEVKKPASAYSSPTQTLGKFLRDVMRRNMTNFRVFGPDETASNKLTAIYEASDKTWLADSQPNDADGGALSADGRVMEMLSEHTLEGWFEGYVLTGRHGLFATYEAFVHVIDSMFNQHAKWLEKAKRELGWRQPVPSINLLITSLVWRQDHNGFTHQDPGFLDVVTNKSPDVVRIYLPPDANCLLSVADHCLRSRDYVNVIVSDKQPHLEYLDMDAAVTHCTKGIGIWDWASTDQGAEPDVVIACAGDIATMEALAAVQLLKERFADLKIRFVNVVDLFRLMPEHAHPHGLSSRDFDSLFTTSKPVIFNFHSYASLVHKLTYNRTNHDNLHVHGYHEKGNINTPLELAIINQVDRFSLAIDVIDRVPKLRGVGDHAKEWLRGQIIEHLAYAHAEGIDKEEIRNWTWKD

SEQ ID NO: 424 - protein, 797 aa, Burkholderia sp. H160
MAEATSHPTPPQVLDPDTLRNIDRYWRACNYLSVGMIYLRDNPLLREPLKPEHIKNRLLGHWGSDAGQSFVLVHLNRLIRKHDLDVIFLSGPGHGAPASLAHCYLEGHYSEIYPDRSEDEIGMRRFFRQFSFPGGIGSHCTPETPGSIHEGGELGYCLSHGYGAAFDNPDLIVTVMIGDGEAETGPLATSWHSNKFLNPIRDGAVLPVLHLNGYKIANPTLLARIPHEELEALMVGYGHKPYFVEGDDPATMHQQMAATLEQCIGEIRAIQQHARQNNDTARPRWPMIVLRSPKGWTGPKEVDGHKVEGSWRSHQVPVADAVSNRKSLKIVEDWLRSYGPETLFDVNGRLVEELRALAPEGARRISANPHANGGLLCKTLDMPPFRDYAVAVKKPAAAYTSPTAVLGTFLRDVMRKNMSNFRLFGPDETSSNKLHAVYEASGKTWLAELEPGDADGGHLSPDGRVMEMLSEHTLEGWLEGYALTGRHGLFATYEAFVHVIDSMFNQHAKWLEKAKRELDWRQPVPSLNLLITSIVWRQDHNGFTHQDPGFLDVVTNKSPDVVRIYLPPDANCLLSVGDHCLRSRDYVNVIVSDKQPHLDYLDMDAAVIHCTKGIGIWDWASTDQGAEPDVVMACAGDIATMEALAAVQILKEHCPTLKIRFVNVVDLFRLMPERAHPHGLSDRDFDSLFTTDKPVIFNFHAYAALVHKLTYNRKNHGNMHVHGYNEKGNINTPLELAIINGVDRFTLAIDAIDRVPTLRGVGDHTKEWLRGQIIEHLAYAHEEGIDKEEIRNWTWKG

SEQ ID NO: 425 - protein, 794 aa, Burkholderia phymatum STM815
MDDTRLQPTPLQADELRNMDGYWRACNYLAAGMIYLRENPLLREPLQAGHIKRRLLGHWGSDPGQSFVLVHLNRVIKQRDLNVIFLSGPGHGAPASLAHSYLEGRYSEIYPDRGESEEGMARLFKLFSFPGGIGSHCTPETPGSIHEGGELGYSLSHGYGAAFDNPDLIVTVMIGDGEAETGPLATAWHSNKFLNPARDGAVLPVLHLNGYKIANPTILARIPHEELEALFNGYGYKPWFVEGDDPDTMHQQMAATLDQCLDEIHAIQQRARQGGDLQRPRWPMIVLRTPKGWTGPREFGGHRIEGSWRAHQVPIADPASNEQSLKRVEEWLRSYRPEELFDESGRLVRELRALAPEGPRRISANPHANGGALCKALDLPAFADYAVDVVTPATRYLSPTDVLGQFLCDVMRRNMTSFRVFGPDETSSNKLTAIYEASQKTWLAEVVESDGDGGYLSADGRVMEMLSEHTLEGWLEGYTLTGRHGLFATYEAFVHVIDSMFNQHAKWLEKAKRELRWRQPVPSLNLLITSLVWRQDHNGFTHQDPGFLDVVTNKSPDVVRIYLPPDANCLLSVADHCLRSRDYVNVIVADKQPHLQYLDMPSAITHCTKGIGIWDWASTDQDHEPDVVMASAGDIPTMEALAAVEILKALFPDLKIRFVNVVDLFRLMPAADHPHGLSTRDFDSLFTTDKPVIFNFHSYASLVHKLTYRRTNHENIHVHGYAEKGNINTPLELAIINGIDRFSLAIDVIDRVPSLRGVGDHAKERLRDKRIEHLHYAHTEGIDSEEIREWTWKG

SEQ ID NO: 426 - protein, 795 aa, Acidobacterium capsulatum ATCC 51196
MSKTATNAEPTLKPQELQRMDAYWRACNYLAAGMIYLRENPLLKEPLRPEHIKNRLLGHWGSDPGQSFVWVHLNRLIREQDLNMIYISGPGHGAPATLANCYLEGTYSEIYPDKSHDVEGMRKFFRQFSFPGGIGSHCTPETPGSIHEGGELGYSLSHAFGAAFDHPDLIVNVVVGDGEAETGPMATSWHANKFLNPARDGAVLPILHLNGYKIANPTILARISHEELEALFTGYGWKPYFVEGSEPEQMHQKMAATLDSCVREIKEIQEQARESGKWERPRWPMIVLRSPKGWTGPKEVDGHKVEDFWRAHQVPILGVKENPEHLKMLEAWMRSYEPEKLFDESGRLVAELQELAPKGDRRMSANPHTNGGKLRKPLDLPAFCDFALKFQRPGEMYASSTETLGTYLAEVFRRNPESFRLFGPDETASNKLSGVYEATKKTWEAGYKPEDADGGELAADGRVMEMLSEHTLEGWLEGYLLTGRHGFFATYEAFVHVIDSMFNQHAKWLEKSKKEIRWRAPISSLNLLITSVVWRQDHNGFTHQDPGFLDIVANKSAEVTRIYLPPDANCLLSVADHCLKSTDYVNVIVADKQPHLQFLSADEAIKHCTKGIGIWEWASTDKGCEPDVVIASAGDIATMEALAAAALLREHFPKLKIRFVNVVDLFRLVPEDEHPHGLPERDYDSLFPPDTPVIFNFHGYPQLIHRLTYQRNNHHNLHVHGYRERGNINTPLELAIMNKVDRFHLAMNAIDRVPGLRAIGGHAKNWLFDQVTEHVMYAHEHGIDPEAINEWTWPE

SEQ ID NO: 427 - protein, 788 aa, Leptospirillum sp. Group II '5-way CG'
MAPRTEEQELKEMDAWWRAANYLSLGMLYLKDNPLLRLPLTPDHLKKRLLGHWGSDPGQNFVWVHANRLIRRHDLNMIYISGPGHGAPATLSNAYLEGTYTEVYPDRTEDTRGLKNFFRQFSFPGGLGSHCTPETPGSINEGGELGYSLSHAYGAVFDHPDLIAVCVVGDGEAETGPMATSWHSNKFLNPVTDGAVLPVLHLNGYKIANPTILARISPEELKSLFVGYGYKPVVVEGDDPAEMHLKMAKAMDSCLSDIRRIQKNSRSSGVPARAPWPMIILRTPKGWTAPKEMDGHRIEGFFRAHQVPILDAATNPAHLSLLEQWFRKYRPEELFDENGTLVPAVKALAPKGNRRMSANPLANGGLLRKPLIMPDFRDYAVDVSKPGTVEAENTFVLGTFLRDIMKKNPRNFRVFGPDETASNHLQALYEVTKKAWMGETRPEDADGCQLAPDGHVMEMLSEHTLEGWLEGYLLTGRHGLLNTYEAFAHIIDSMVNQHAKWLEKAKTDVSWRAPVSSLNILLSSTVWRQDHNGFTHQDPGFLDVVTNKRASVVRIYLPPDANTLLSVADHCLRSTDYVNVIVADKQPHLQYLDRDAAARHAAKGIGLWEWASNDQGEEPDAVMACCGDVVTLEALAAVAILREKIPDLRIRFVNVVDLFRLQPPSEHPHGLSDRDFDSLFTTDRPIIFNFHGYPWLIHKLAYRRTNHRNLHVRGYKEKGSINTPLQLAIENQIDRFSLAIDVIDRVPRVGVRGAHVKEWLKDQILEHLAYASREGEDPPEVARWKWPF

SEQ ID NO: 428 - protein, 792 aa, Leptospirillum ferrodiazotrophum
MAMAKEPDEKEIESINNYWMAANYLSLGMLYLRDNPLLEAPLSPDHLKPRLLGHWGSDPGQNFVWAHANRLIKRHDLSAIYISGPGHGAPASLANGYLEGTYSELYPDRSQDREGMKTLFRRFSHPGGVGSHCTPETPGSINEGGELGYSLSHAFGAAFDNPDLLVVAVVGDGEAETGPMATSWHSNKFLNPRQDGAVLPVLHLNGYKIANPTILSRISREEIKSLFEGYGYVPHFVEGDDPLPMHRLMARTMEKCLSEIRTIQKKARESDRPERGRWPMIVLRTPKGWTAPKELDGHKIEGSFRAHQVPILDAATNPAHLKILEDWFRSYRPQDHFDKNGTLRAELRELAPKGPRRMSANPVANGGLLRIPLRLPDFRDYQVPVPRPGGVVDQNTLRMGQFLRDVMKMNPGKFRVFGPDETASNHLQALYEATGKAWMAETLPEDADGTFLSPTGHVMEMLSEHTLEGWLEGYLLTGRHGLINTYEAFVHIIDSMVNQHAKWLEKSRGDVSWRAPVSSLNILLSSTVWRQDHNGFTHQDPGFLDVLTNKSPKVVRIYLPPDANCLLSVTDHCLRSTDYVNAIVADKQPHLQFLDMESAIRHCTLGIGLWEWASSDGGEDPDVVMASAGDIVTLESLAATAILRELFPDIRIRFVNVVDLFRLVPQSEHPHGFSDRDFDSLFTVDRPIIFNFHGYPWLIHKLTYRRTNHRNLHVRGYKEQGSINTPLQLAIENQIDRFSLAIDAIDRIPRLQSKGAHAKEWLKGQIIDHLRFAREQGMDRPEIEAFRWPFPK

SEQ ID NO: 429 - protein, 796 aa, Synechococcus elongatus PCC 6301
MTSTLQATDIATLSPNEQAAIDAWWRAANYLSVGQIYLRDNPLLQEPLRPEHIKQRLLGHWGSDPGLSFVYVHLNRLIRRLDLNLIYVTGPGHGAPALLANAWLEGTYSEVYPNCQQSTAGLQQFFKQFSFPGGIGSHCTPETPGSIHEGGELGYSLSHAFGAALDNPDLIVACVIGDGEAETGPLATSWHSNKFLNPAQDGAVLPILHLNGYKIANPTLLSRISHEELRSLFIGYGYEPFFVEGNDPAILHGVMASTLATCVQKIQAIQAAARSGESSDRPMWPMIVLRTPKGWTGPATIKGHVVEGSWRSHQVPMADVLTNPEHLQLLEDWLRSYRPEELFDASGAPVAELQAIAPIGDRRMSANPVTNGGLLRRALTLPDFRDQAVSVPAPGKSRADSTRPLGQFLREVIRHNPDNFRLFGPDETASNRLDAVYEVTSKVWLGDRIPEDEDGGHLSDRGRVMEILSEHTLEGWLEAYLLTGRHGFFATYEAFAHVIDSMVNQHAKWLDVSKREVDWRAPVSSLNILLSSTVWRQDHNGFSHQDPGFIDLVTNKSARVTRIYLPPDANCLLSVADHCLRSTDYINVIVADKQSHLQYLDAEAAARHCAKGIGIWDWASNDQGASPDVVIASCGDVVTLEALAATALLREHFPDLKIRFVNVVDLFRLQPDTEHPHGLSDRDFDSLFTVDKPIIFNFHGYPWLIHKLAYRRHNHNNLHVRGYKEVGNINTPLELAIRNQVDRFNLAIDVIDRVPHLRDRGAHVKEWLKDQIHDHIQYAYQEGIDRPEINQWQWPF

SEQ ID NO: 430 - protein, 812 aa, Thermosynechococcus elongatus BP-1
MVSSPPRPTALTDDIHAFGPARATIQGQPLSDSEVEAMDAFFRACNYLAVGMIYLLDNPLLKEPLKPEHIKKRLLGHWGSSPGLAFCYLHLNRIIKKYQQEVIFLAGPGHGAPGVLAPVYLEGSYSEIYPNISEDAAGLKKFFKQFSFPGGIGSHCTPETPGSIHEGGELGYVLSHACGAAFDNPDLIVAAVVGDGEAETAPLATSWHINKFLNPARDGAVLPILNLNGYKINNPTILARIPHQDLENYFRGLGYDPCFVEGSDRPSMHQAMAATLDYCVTRIKEIQRTAREEGLTTLPRWPMIVLRTPKGWTGPAEVNGHKVEGSWRAHQVPLADVHTNPENLQLLENWLRSYRPEELFDHNGTFRPDLKALAPTGNYRMGMNPHANGGLLRKDLKMPNFREYGITFDKPGQIEVENTRPLGVFLRDVMRNNPRNFRIFGPDETTSNKLNAVYEASKKFWIAESFDEDADGGELSPEGRVIEMLSEHTLEGMLEGYLLTGRHGFFSTYEAFVHVIDSMFNQHAKWLSICNELSWRADVSSLNLLITSTVWRQDHNGFTHQDPGFLDIVCNKSAKVTRIYLPPDVNSLLSVADHCLRSKNYVNVIVSDKQLHLQYLTMDQAIIHCTKGVGIWDWASNDQGYEPDLVMASAGDIPTQEALAAIALLRQEFPELKIRYINVVDLFKLQPETEHPHGLSDRDFDSLFTLDRPIIFNFHGYPWLIHRLAYRRHNHRNLHVRGYKEKGNINTPLELAINNEIDRFSLAIDAIDRLPELQVAGAHAKEKFRNMQIAARNYAYEYGVDKPEFSHWTWPF

SEQ ID NO: 431 - protein, 811 aa, Methylococcus capsulatus str. Bath
MATQFPLSSEFERLTVYGPTRATVSGTPLDAEEVRKIHAFWRACNYLALGMIYLRGNPLLREPLKPEHIKHRLLGHWGSSPNLAFVYTHLNRAIRKHDLDMIFMAGPGHGAPGVLGPLYLEGSYSEIYPDKDLSEEGLLNFFKQFSFPGGIGSHCTPETPGSIHEGGELGYVLSHACGAAFDNPDLIVAAVVGDGEAETGPLATSWHINKFLNPIRDGAVLPILNLNGYKINNPTLLARISHEELENLLRGYGYTPYFVEGSEPESMHQAMAATVDRSIEDIRAAQTEARASGIARRPRWPMIVLRSPKGWTAPRQIDGHNVEGFWRAHQVPVADVAKNPEHLKLLEGWMRSYKPEELFDAEGCPVAEIREMAPAGLRRMGLNPHANGGHLKKALRIPNFRNYGIEVAKPGQIEAPNTQPLGVFLRDVMKENAHNFRLFGPDENTSNKLDAVYAAAKKFWIAEYFPEDQDGGELAPDGRVMEMLSEHTLEGMLEGYLLTGRHGFLSTYEAFVHVIDSMFNQHAKWLSICNQLSWRQDVASLNLLITSTVWRQDHNGFTHQDPGFLDVVVNKSADVTRIYLPPDVNSLLSVADHCLRSQNYINVIVSDKQLHLQFMDMDAAIAHCTEGLGIWEWASNDEGQEPDVVMACAGDIPTLEALAATALLREEFPELKIRFINVVDLFKLQPESEHPHGLSDKDFDSLFTRDKPVIFNFHGYPWLIHRLAYRRTNHANMHVRGYKEKGNINTPLELAINNQIDRFSLAIDVIDRIPEIAVSGAHAKARFRKQQIACRQYAYEHGVDMPEVAGWRWPG

SEQ ID NO: 432 - protein, 813 aa, Cyanothece sp. PCC 7425
MVATPEKPTFDEMRSISAYGEARSTIAGTPLSSEELQNLHAFWRAANYLAVGMIYLRDNPLLKETLQPEHIKRRLLGHWGSSPGISFLYTHLNRVIKKFGQEMLFMVGAGHGAPGFLGPCYLEGSYSHFFPECSEDEAGMKQFFKQFSFPGGVGSHCTPETPGSIHEGGELGYSLSHAFGAAFDNPNLIVVAMPGDGESETGPLATSWHSNKFINPIRDGAVLPVLHLNGYKINNPTILSRISHRELKALFEGYGYTPYFVEGSDPESMHQALAATLDHCIAEIHTIQQQARSSGQATRPIWPMIVLRTPKGWTGPVEVDGHRVEGFWRAHQVPMGGMHSNPDHVRQLAAWMKSYKPEELFDPDGTLISSIKAQAPTGDRRLGSTPYANGGLLRRDLKMPDFRQYGVAVEKPGTLEVENTKPLGAFLRDVMKANSTNFRVFGPDENTSNKLHAIYEVSKKFWIADYLPEDADGGELSPDGRVMEMLSEHTLEGWLEGYLLTGRHGFFSTYESFAHVIDSMFNQHAKWLEICNHIHWRKEISSLNLLITSTVWRQDHNGFTHQDPGFLDVVLNKSPDVVRIYLPPDVNTLLSVADHCLRSKDYINVIVSDKQLHLQYHSMDDAIRNCTKGVAIWDWASNDQGGEPDVVLAAAGDIPTQEALAASVLLRENFPDLKIRFINVIDLFMLQPSSEHPHGLSDNDFDSLFTLDKPIIFNFHGYPWLIHRLTYRRHNHKNLHVRGYKEKGNINTPLDLAIQNQIDRFSIAIDVIDRIHRLKVAGAHVKESLKNEQIDCRHYAYEHGIDRPDIVNWKWPY

SEQ ID NO: 433 - protein, 821 aa, Synechocystis sp. PCC 6803
MGSTLVGKCTSLGVFSMVTSPFSLSPFGQARSTVTGNPLDPTELNQMHGFWRAANYLAVGMIYLRDNPLLREPLQPEQIKHRLLGHWGSSPGISFLYTHLNRIIRKFDQDMLYMVGPGHGAPGFLGPCYLEGSYSRFFAECSEDEDGMKRFFKQFSFPGGIGSHCTPETPGSIHEGGELGYCLSHAYGAAFDNPNLIVVGLAGDGESETGPLATSWHSNKFINPIRDGAVLPVLHLNGYKINNPSVLSRISHEELKALFEGYGYTPYFVEGSDPESMHQAMAATLDHCVSEIHQIQQEARSTGIAVRPRWPMVVMRTPKGWTGPDYVDGHKVEGFWRSHQVPMGGMHENPAHLQQLEAWMRSYKPEELFDEQGTLKPGFKAIAPEGDKRLGSTPYANGGLLRRGLKMPDFRQYGIDVDQPGTIEAPNTAPLGVFLRDVMANNMTNFRLFGPDENSSNKLHAVYEVSKKFWIAEYLEEDQDGGELSPDGRVMEMLSEHTLEGWLEAYLLTGRHGFFATYESFAHVITSMVNQHAKWLDICRHLNWRADISSLNILMTSTVWRQDHNGFTHQDPGFLDVILNKSPDVVRIYLPPDVNSLLSVADHCLQSKNYINIIVCDKQAHLQYQDMTSAIRNCTKGVDIWEWASNDAGTEPDVVMAAAGDIPTKEALAATAMLRQFFPNLRIRFVSVIDLLKLQPESEHPHGLSDRDFDSLFTTDKPIIFNFHAYPWLIHRLTYRRTNHGNLHVRGYKEKGNINTPMDLAIQNQIDRFSLAIDVIDRLPQLRVAGAHIKEMLKDMQIDCTNYAYEHGIDMPEIVNWRWPL

SEQ ID NO: 434 - protein, 821 aa, Cyanothece sp. PCC 7425
MIATPERPPIEDINAISAFGLARSTVTDSLLSPTELEHIHAYWSACNYLAVGMIYLQANPLLREPLQPEQIKNRLLGHWGTSPGLSFIYVHLNRLIKKYDLDMIYLAGPGHGAPGVLGPVYLEGTYSEIYPDKSEDIEGLQKFFRQFSFPGGIGSHATPETPGSIHEGGELGYSISHAYGSVFDNPDLISAVVVGDGEAETGPLATAWHSNKFLNPVRDGAVLPILHLNGYKINNPTLLSRISHEELEFLFRGYGYTPYFVEGSDPASMHQAMAATLEHCLNEIRTIQQQARQGDGGENVLRPRWPMIVLRSPKGWTGPQQVDGHKVEGYWRAHQVPLTAVQSNPEHLHMLEDWLRSYQPEQLFDQQGRLIPELKALAPTGTRRMSANPHANGGLLKKALRMPDFRDYGIGIEQPGQRMAENTKPLGAFLRDIMKLNPRNFRVFGPDETTSNKLNAVYEASKKFWIAQYLPEDSDDGQLAPDGRVMEMLSEHTLEGWLEGYLLTGRHGFFSTYEAFVHIIDSMFNQHAKWLQICEHLSWRQSIASLNLLITSTVWRQDHNGFTHQDPGFLDIVVNKSPAVVRIYLPPDINCLLSVADHCLRSENYINVIVSDKQLHLQYLDMEAAIQHCTKGLGIWDWASNDQGAEPDVVMACAGDIPTQEALAATALLRQEFPTLKIRFINVVDLLRLQPESEHPHGMSDRDFDSLFTLDKPIIFNFHGYPWLIHRLAYRRTNHPNLHVRGYKEKGNINTPLELAIRNQIDRFSLAIDVIDRVPWLKVLGAHAKEKFKNMQIECRHYAYEYGLDKPEVANWQWSSSPAQP

SEQ ID NO: 435 - protein, 789 aa, Allochromatium vinosum DSM 180
MTTATPLTPEQLDRIDAYWRACNYLAVGMIYLRDNPLLREPLKPEHIKQRLLGHWGASPGLSFMYVHLNRIIRERDQDAIFLAGPGHGAPGVLAPVYLEGTYSEIYPNKSEDEEGLKAFFKQFSFPGGIGSHCTPETPGSIHEGGELGYSISHAFGAAFDNPDLLVAVAVGDGEAETGPLATSWHSSKFLNPIRDGAVLPILHLNGYKINNPTLLSRIPDEELASLMRGYGWTPHFVAGDDPLTLHQTMAATLDACHDQIRAIQHAARASGEATRAHWPMIVLRTPKGWTGPSEVDGHKVEGFWRAHQVPLSGMHDNPEHLKQLEDWLRSYRPEELFDAQGRLIPELKALAPQGTKRMSASPHANGGLIRRALRMPDFRDYAIRVDKPGTARAMNTKPTGALLRDVMARNLDNFRVFGPDENSSNKLDAVYEVSKKLWLCDYKPEDADGGELSPDGRVLEMLSEHTLEGWYEGYVLTGRHGFFATYEAFVHVIDSMYNQHAKWLSICEDIPWRARISSLNLLITSTVWRQDHNGFTHQDPGFLDVVVNKNPEVTRIYLPPDVNTLLSTVNHCLQSRDDINVIVADKQSHLQYLDMDAAIKHCTKGIGIWEWASNDQGAEPDVVMAGCGDIPTKEALAATALLREHFPDIKIRFINVVDLFKLQPAGEHPHGLSDADFDSLFTKDRPIIFNFHGYPWLIHRLAYRRTNHKNLHVRGYKEKGNINTPLELAISNEIDRFSLAIDVINRVPRLQVAGAHVKETLRDQQIECRNYAYEHGIDKPDVDEWVWPF

SEQ ID NO: 436 - protein, 788 aa, Mariprofundus ferrooxydans PV-1
MNQRSLGAEKLKAMHGFWRACNYLAAGMIYLRDNPLLSGPLKPEHIKQRLLGHWGSSPGLSFIYTHLNRLIVEQDVNAIFLAGPGHGAPGVLAPVYLEGRYSEVYPNKSEDEEGMRLFFKDFSFPGGIGSHCTPETPGSIHEGGELGYSISHAFGAAFDNPDLLVAVVVGDGEAETAPLATSWHSNKFLNPVRDGAVLPVLHLNGYKINNPSVLSRIPAEELTSLMQGYGWKPCFVEGDDPELMHQQMAAALDECMAEIRSIWSAAREEGVTERPLWPMIVLRSPKGWTGPAEVDGHQVEGSWRAHQVPLKGVRENEEKLHQLEAWLRSYGPEELFDAEGCLRPEFKTLTPKGERRMSANQHANGGRLRRMLRLPDFRRYALEFEKPGTVEAENTRPLGRFLRDIMSRNMHNFRVFSPDENSSNKLDDIYQASKKCWMAGRLPIDSDGGELSADGRVMEMLSEHTLEGWLEGYLLTGRHGFFSTYESFVHVIDSMFNQHAKWLAMSRDVDWRASVSSLNMLITSTVWRQDHNGFTHQDPGFLDLVVNKSPKVTRIYLPPDVNTLLVTANHCLNSHDYINVIVADKQNHLQYLDMDAAIKHCTKGLGIWSWASNDQGYEPDVVMACAGDVPTREALAATYLLRQHFPDLKVRFINVVDLYKLVPDSEHPHGLTDRDYDSLFTVDKPIIFNFHGYPWLIHRLAYRRTNHKNLHVRGYKEHGSINTPLELAIANEIDRFSLAIDVINRIPRLAVAGAHVKEQLRDQQLTCRQYAYEHGVDLPEATNWTWPL

SEQ ID NO: 437 - protein, 789 aa, Gallionella ferruginea ES-2
MNSKIPPLSASEINHINAYWRACNYLAAGMIYLRDNPLLKEPLKLEHIKNRLLGHWGSSPGLSFGYIHMNRLIVKYDLNAIFMAGPGHGAPGVLGPVYLEGRYSEVYPNKGENIDGMRQFFKEFSFPGGIGSHCTPETPGSIHEGGELGYSVSHAFGAAFDNPDLIVTVMVGDGESETAPLATSWHSNKFLNPIRDGAVLPILHLNGYKINNPTILSRISHEELENLFKGYGWTPYFVEGSDPETMHQRMAQVMEECVLEIRRIQTEARESGIPARPRWPMIVLRSPKGWTGPAEVDGKKMEGFWRSHQVPIGDVKTPEHFAKLEEWLSSYKIDELFDENGKLLPELKALAPKGIRRMSANLHANGGLLRRALHMPNCRDYAVEVKNPGTTVAENTRPLGKFLRDIMQANMQNFRVFGPDENSSNKLDNIYEVSKKTWLADYLPEDAGGGELSPDGRVMEMLSEHTLEGWLEGYLLSGRHGFFSTYEAFVHVIDSMFNQHAKWLAMSKDVPWRAPVSSLNLLITSTVWRQDHNGFTHQDPGFLDLVVNKSPEVTRIYLPPDVNCLLSVADHCLKSTDYINVIVCDKQKHLQFLNMEAAILHCTKGIGIWDWACNDQGSEPDVVMASAGDIPTKEALAAVMLLREHFPDLKIRFINVVDLYKLTPSTEHPHGLSDRDFDSLFTKDRPVMFNFHGYPWLIHRLAYRRHNHQNFHVRGYKEKGSINTPLELAIQNQIDRFSLVIDIIDRLPALQVSGAHIKEKMLNKQIECRNYAYAHGIDLPEVDNWTWTL

SEQ ID NO: 438 - protein, 811 aa, Aspergillus clavatus NRRL 1
MTSKVETESISAYGAARSTITGSPLNNEDLRKTDAYFRASLYLCLGMLYLRANPLLKEPLTVEHLKARLLGHWGSDAGQAFTYIHMNRLIKKYGLDVLFISGPGHGAPGVLSQSYLEGVYTEVYPDKTEDEAGMQRFFKQFSFPGGIGSHATPETPGSLHEGGELGYSISHGFGVVFDHPKLIALTIVGDGEAETGPLATSWHSNKFLNPVTDGAVLPVLHLNGYKINNPTVLARISHEELEMLLKGYGWTPNFVEGSDRDSMHQAMAATLEHCVLEIRKIQQQARESDKPFRPRWPMIVLRSPKGWSAPREVDGELLEGYWRAHQIPIPDVRNNLSHLKVLENWMRSYKPNEVFDENGRLISELRELAPIGNSRMSANPVANGGLLRRPLDLPNFRDYALTDIEPGVSIRPSMINMSRYLRDVVAKNMTTFRVFGPDETQSNKLGEIYEAGKKVWLADYFKEDEDGGNLAMQGRVMEILSEHTCEGWLEGYILSGRHGMLNSYEPFIHIIDSMVNQHCKWIEKCLEVEWRAKVASLNILLTATVWRQDHNGFTHQDPGFLDVVANKSPEVVRIYLPPDGNTLLSTMDHCFQSVNYVNVIVADKQEHVQFLNMEEAIEHCTKGLGIWNWASNDQGHEPDVVMAACGDVPTHEALAATALLREHLPQLKVRFVNVVDLFRLISRKNHPHGMSDRQWKAIFTTDKPVIFNFHSYPWLIHRLTYNRPGQHNLHVRGYREKGNIDTPFELAVRNQTDRFSLAMDAIDRCTSLGNTASGVREKLINQQLAAKNKAYDDGIDPDYIRSWTWDYPRKK

SEQ ID NO: 439 - protein, 812 aa, Neosartorya fischeri NRRL 181
MTSKGEIESLSAYGVARSTIQGTPLSQDELRKMDAYFRASMYLCLGMLYLRDNPLLKEPLKVEHLKARLLGHWGSDAGQSFTWIHMNRLIKKYDLDVLFISGPGHGAPGILSQSYLEGVYTEVYPEKTQDEKGLQRFFKQFSFPGGIGSHATPETPGSIHEGGELGYSISHAFGTVFDHPNLITLTMVGDGEAETGPLATSWHSNKFLNPITDGAVLPVLHLNGYKINNPTILARISHEELEMLLKGYGWTPYFVEGSDRESMHQAMAATLEHCVLEIKKIQKQARESNKAFRPLWPMIVLRSPKGWSAPREIDGKYLEGFWRAHQIPITDVQSKPEHLKVLENWMKAYKPEEVFDKNGTLIPELKELAPTGTSRMSANPVGNGGLLRRPMDLPDFRDYALTDIEPGVTIRPSMSNMSKYLRDVVARNMTTFRVFGPDETESNKLAEIYKAGKKVWMAEYFKEDEDGGNLDMQGRVMEILSEHTCEGWLEGYILSGRHGMLNSYEPFIHVIDSMVNQHCKWIEKCLAVEWRAKVSSLNILLTATVWRQDHNGFTHQDPGFLDVVANKSPEVVRIYLPPDGNTLLSTMNHCFRSVNYVNVIVADKQEHVQFLNMEEAIEHCTKGVGIWDWASNDQGCEPDVVMASCGDVATHEALAATALLREHLPQLKVRFVNVVDLFRLISDINHPHGMPDRQWGAIFTTDKPIIFNFHSYPWLIHRLTYKRPGQHNLHVRGYKEKGNIDTPFELAVRNQTDRYSLAIDAIDRIPSLGNTASGVRERLINLQLAAKNKAFDDGIDPDYIRNWTWDYPRKKC

SEQ ID NO: 440 - protein, 810 aa, Aspergillus oryzae RIB40
MAPSSESDDNISAYGATRSTIKGQPLDADEVRKMDAYFRASMYLCLGMLYMRDNVLLKEPLKVEHLKARLLGHWGSDAGQSFTWLHMNRLIKKYDLDVLFVSGPGHGAPAVLSQSYLEGVYSEVYPDKSEDEKGLQRFFKQFSFPGGIGSHATPETPGSIHEGGELGYSISHAFGSVFDHPNLITLTMVGDGESETGPLATSWHSTKFLNPCTDGAVLPVLHLNGYKINNPTVLARISHEELKALFVGYGWTPYFVEGNDRESMHQAMAATLEHCIVEIKKIQKQARESNKPFRPRWPMIVLRSPKGWSAPREIDGKLLEGFWRSHQIPITDVLTNPAHLKLLETWMKSYKPEELFDKNGKLVEELKALAPSGNSRMSANPVGNGGILRRPLQLPDFRDYALKDIDPGVSVRGSMTNMSKFLRDVVKENMTTFRVFGPDETESNKLAEIYKAGKKVWLGDYFEEDKDGGNLAFEGRVMEMLSEHTCEGWLEGYVLSGRHGILNSYEPFIHVIDSMVNQHCKWIEKCLEVEWRAKVASLNILLTATVWRQDHNGFTHQDPGFLDVVANKSPEVVRIYLPPDGNTLLSVMDHCFRSVNYVNVVVADKQEHIQFLSMDEAIEHCTKGLGIWDWASNDQGQEPDVVMAACGDVPTHEALAATALLNEHLPQLKVRFVNVVDLFRLINEKDHPHGMPDRQWKAVFTDDKPIIFNFHSYPWLIHRLTYKRPGQHNLHVRGYREKGNIDTPFELAVRNQTDRYSLAIDAIDRVGSLGNTASHVREKLINQQLAAKQEAYDNGLDAEYIRNWKYPKKA

SEQ ID NO: 441 - protein, 815 aa, Aspergillus niger
MPSDSNDQSISAYGAARSTVKGQNLDPEEVRKMDAYFRASMYLCLGMLYLRENVLLKQPLKVEHLKARLLGHWGSDAGQSFTWIHMNRLIKKYDLDVLFISGPGHGAPGILSQSYLEGVYSEVYPDKSEDERGMQRFFKQFSFPGGIGSHATPETPGSLHEGGELGYSISHAFGTVFDHPNLITLTMVGDGEAETGPLATSWHSTKYLNPCTDGAVLPVLHLNGYKINNPTLLARISHDELSALMKGYGWTPYFVEGSDRETMHQAMAATLEHCVLEIRKFQKKARESKEPFRPHWPMIILRSPKGWSAPREVDGKLLEGFWRAHQIPITDVLTNPSHLQLLESWMKSYKPEELFTHDGRLISELKALAPTGNSRMSANPVGNGGLLRRPLDLPDFRKYALTSIDPGATIRGSMVNMSHYLRDVVAFNQTNFRVFGPDETESNKLSEIYKAGKKVWLAEYFPEDNNGGNLSMAGRVMEMLSEHTCEGWLEGYVLSGRHGLLNSYEPFIHIIDSMVNQHCKWIEKCLEVEWRAKVASLNILLTATVWRQDHNGFTHQDPGFLDVVANKSPEVVRIYLPPDGNSLLSVMDHCFRSANYVNVIVADKQDHIQFMDMDAAIAHCTKGVGIWDWASNDQGAEPDVVMAACGDVPTHEALAATALLREHLPQLKVRFVNVVDLFKLMSKIHHPHGMSDREWKAIFTADRPIVFNFHSYPWLIHRLTYKRPGQENIHVRGYKEKGNIDTPFELAVRNQTDRYSLAVDAIDHARGLGNTASGVREKFLNMQLLAKQKAYDDGIDPDYIRNWTWQYPRKKGEGV

SEQ ID NO: 442 - protein, 818 aa, Aspergillus terreus NIH2624
MPSTVGKSNDPTIVAYGPARSTIKGQPLEAEELRKTDAYFRASMYLCLGMLYLRDNVLLKEPLRTDHLKARLLGHWGSDAGQSFTWIHMNRLIKKYNLDVLFVSGPGHGAPGVLSQSYLEGVYSEVYPDKSEDAKGMQKFFKQFSFPGGIGSHATPETPGSIHEGGELGYSISHAFGTVFDHPNLITLTMVGDGESETGPLATSWHSTKFLNPCVDGAVLPVLHLNGYKINNPTVLARISHEELESLFHGYGWTPYFVEGSDRESMHQAMAATLEHCVNEIRKFQKQARESNKPFRPHWPMIVLRTPKGWSAPRDVDGKLLEGFWRSHQIPIPDVWSNPKHLQVLESWMRSYKPEELFDKDGKLIPELKELPPTGNRRISANPVANGGILRKPLDMPDFRDYALKEIEPGVSIRGSMVNMSKWLRDVIANNQKSFRLFGPDETESNKLSEIYKAGKKVWMGEYFEEDQDGGNLAPEGRVMEMLSEHTCEGWLEGYVLSGRHGLLNSYEPFIHIIDSMVNQHCKWIEKCLEVEWRVKVASLNILLTATVWRQDHNGFTHQDPGFLDVVSNKSPEVVRIYLPPDGNCLLSVMDHCLRSVNYVNVVVADKQDHIQYLSMEEAIEHCSKGVGIWDWASNDQGVEPDVVMASCGDVPTHEALAATALLRENIPDLKVRFVNVVDLFVLISKINHPHGMTDRHWKAVFTDDKPIVFNFHSYPWLIHRLTYKRPGQHNLHVRGYNEKGNIDTPFELAIRNKTDRYSLAIDAIDRVPSLHNKAAAVREKFINEQLAARGWAYDHGIDPDHIRNWTWAYPRKKKNVD

SEQ ID NO: 443 - protein, 810 aa, Penicillium chrysogenum Wisconsin 54-1255
MASKVGEKSISAYGEARSTVEGKPLDAETIRKMNAWFRASMYLCLGMLYLRDNPLLKEPLKLEHLKARLLGHWGSDAGQSFTWMHMNRLIKKYNLDVLFVSGPGHGAPGIISQSYLEGVYSEVYPDKGEDTEGMTKFFKQFSFPGGIGSHATPETPGSIHEGGELGYSLSHAFGTVFDNPNLITLTMVGDGESETGPLATSWHSTKFLNPINDGAVLPVLHLNGYKINNPTVLARISHDELTSLLVGYGWKPYFVEGSDLDSMHQAMAITLEQCVTEIKEHQKKARETKTPFRPRWPMIVLRTPKGWSAPREVDGHLLEGFWRAHQIPITDVRTNPAHLKVLETWMRAYKPEELFDENGTLIQELKELAPTGNSRISANPVGNGGLLRRPLHIPDFREYGFKDIDAGLTIKGGMANMAKFLRDVVAQNMNNFRLFGPDETESNKLSEVYKAGKKVWMGDYFEEDKDGGNLSPDGRVMEILSEHTCEGWLEGYILSGRHGLLNSYEPFIHVIDSMVNQHCKWIEKCLEVEWRARVSSLNILITATVWRQDHNGFTHQDPGFLDVVANKSPEVVRIYLPPDGNTLLSVMDHCLRSVNYVNVIVADKQEHIQFLDMDAAVAHCTKGLGIWDWASNDQGAEPDIVMASCGDVSTHEALAATALLREYLPQLKVRFVNVVDLFRLISAIHHPHGMSDKRWKSIFTVDKPIIFNFHSYPWLIHRLTYKRPGQHNLHVRGYKEKGNIDTPFELAMRNDTDRYSLAMAAIDLIQTLGNSAAGVREKLYNEQLAAKSEAFDNGVDPEHIRNWKWPFPKE

SEQ ID NO: 444 - protein, 817 aa, Penicillium marneffei ATCC 18224
MAPGAIDVNIQSISAYGPARSTVKVDKPLSSDEVHKINEYFKASLYLCLGMLYLRDNPLLKEPLKKEHIKNRVLGHWGSDAGQSFTWIHMNRLIKKYSLDSLFISGPGHGAPGILSQSYLEGVYSEVYPDKTEDEDGMRRFFKSFSFPGGIGSHATPETPGSIHEGGELGYSISHAFGAVYDHPDLIALTMVGDGEAETGPLATSWHSTKFLNPITDGAVLPVLHLNGYKINNPTLLARISHEELEALFIGYGWAPYFVEGSDLQSMHQSMAATLEHCVLDIKEIQKKARESKKAFRPRWPMIVLRTPKGWTAPREVDGKRLEGFWRSHQVPMPDVLTNPDHLKLLESWMKSYGPDELFANKGKLIPELKALAPTGNSRMSANPVGNGGLLRKPLDLPDFRTYGVQKIEPGVSLIGNMTNLAKFLRDVIAKNKTNFRLFGPDETESNKLGEVYKAGKKVWLGAYFDEDQDGGNLAMEGRVMEMLSEHTIEGWLEGYILSGRHGLLNSYEPFIHIIDSMVNQHCKWLEKCLEVEWRAKVASLNILLTATVWRQDHNGFTHQDPGFLDVVANKSPEVVRIYLPPDGNSLLSVADHCLRSVNYVNVIVADKQEHLQFLSMEEAIEHCTKGVGIWDWASNDQGEEPDVVMASAGDVATHEALAATALLRQYLPGVKVRFVNVVDLFRLIPETQHPHGMSDLQWKALFTEDKPIIFNFHSYPFLVHRLTYRRPGQKNLHVRGYREKGNIDTPFELAVRNETDRFSLAIAAIDNIPRLHNTASAIREKFVNSQIAARNTAFGDGVDSEEIRTWKWPFPKKELI

SEQ ID NO: 445 - protein, 815 aa, Talaromyces stipitatus ATCC 10500
MAPSAVEVDIQAISAYGPARSTVKVDHPLDAEEVRKMEEYFKASLYLCLGMLYLRDNPLLKEPLKKEHIKKRVLGHWGSDAGQAFTWIHMNRLIKKYDLDALFISGPGHGAPGILSQAYLEGVYSEVYPDKTEDEDGMRRFFKSFSFPGGIGSHATPETPGSIHEGGELGYSVSHAFGTVYDHPNLISLTMVGDGEAETGPLATSWHSTKFLNPITDGAVLPVLHLNGYKINNPTLLARISHEELEALFIGYGWKPYFVEGSDTKSMHQSMAATLEHCVLEIKEIQKKARESKKAFRPRWPMIVLRTPKGWTAPRDVDGKRLEGFWRSHQVPIPDVLTNPDHLKLLEAWMRSYGPEKLFADNGKLIPELRELAPTGNSRISANPVGNGGLLRKPLDLPDFRKYGAEKVEPGISIVGNITGLAKFLRDVIAKNTTNFRLFGPDETESNKLAEVYKAGKKVWLGAYFDEDQDGGNLATEGRVMEMLSEHTIEGWLEGYVLSGRHGLLNSYEPFIHIIDSMVNQHCKWLEKCLEVEWRAKVASLNILLTATVWRQDHNGFTHQDPGFLDVVANKSPEVVRIYLPPDGNSLLSVADHCLRSVNYVNVIVADKQEHLQFLSMEEAIEHCTKGAGIWDWASNDQGEEPDVVMASAGDVATHEALAATALLREFLPDVKVRFVNVVDLFRLISETQHPHGMSDSQWKALFTEDKPIIFNFHSYPFLVHRLTYRRPGQQNLHVRGYREKGNIDTPFELAVRNETDRYSLAIAAIDHIPRLHNKASSVREKFVNLQIAARNTAFEDGLDSEEIRNWKWPFPKKI

SEQ ID NO: 446 - protein, 821 aa, Botryotinia fuckeliana B05.10
MAPPSGEVKVESISPYGVARTTIDEKPLSDEEVKKFDAYFRACMYLCLGMLYLRENALLKEPLKKEHLKARLLGHWGSDAGQAFTYLHMNRLIKKYDLNTLFVSGPGHGAPAVLSNAYLEGTYSEVYPDKAEDEEGMRKFFKQFSFPGGIGSHATPETPGSIHEGGELGYSISHAFGTVFDNPDLITLTMVGDGEAETGPLATAWHSTKFLNPITDGAVLPVLHLNGYKINNPTILARISHKELEALFVGYGWTPYFVEGSDLESMHQAMAGTLERCVVEIRKYQKEARESGKAVRPRWPMIVLRSPKGWTGPRKVDDKLLEGFWRAHQIPLPNVASNPEHLQLLESWMRSYKPEEFFDKEGKLLSELKELAPVGNARMSANPVGNGGILRRPLDMPDFRKYAFENVEAGVSKLPSMANMAKLLRDVVANNMHTFRLFGPDETESNKLGEVYKAGKKVWMGENFEEDADGGNLATEGRVMEMLSEHTVEGWLEGYILSGRHGLLNSYEPFIHVIDSMVNQHCKWIEKCNEVEWRVKMSSLNILLTATVWRQDHNGFTHQDPGFLDVVANKSPEVVRIYLPPDGNCLLSCMDHCLRSTNYVNVVVADKQDHLQYLNMEDALTHCEKGLGIWDWASNDQGFEPDVVMATCGDVPTHESLAATALLRELIPDLKIRFVNVVDLFKLIHHGDHPHGITDKEWVSIFTDNKPIIFNFHSYPWLVHRLTYKRPGQSNLHVHGYNEKGNIDTPLELAIRNKTDRYSLALHAVDRIERLGNTGSHIREKLLNMQIEARREAFENGIDPIHIREWKWPFQNGGKDEKMLK

SEQ ID NO: 447 - protein, 832 aa, Sclerotinia sclerotiorum 1980
MAPASGEVEVESISAYGVARTTVDEKPLSAEEVKKYDAYFSACMYLCLGMLYLRENALLKEPLKKEHLKARLLGHWGSDAGQAFTYLHMNRLIKKYDLNALFVSGPGHGAPAVLSNAYLEGTYSEVYPDKAEDEEGMRKFFKQFSFPGGIGSHATPETPGSIHEGGELGYSISHAFGTVFDNPNLITLTMVGDGEAETGPLATAWHSTKFLNPITDGAVLPVLHLNGYKINNPTILARISHKELESLFIGYGWKPYFVEGSDLESMHQAMAGTLERCVVEIRKYQKEARESGKAIRPRWPMIVLRSPKGWTGPRKVDDKLLEGFWRAHQIPLPNVASNPEHLKVLEAWMRSYKPEEVFDKEGKLLPELKELAPVGNARMSANPVGNGGILRKPLDMPDFRKYAFENIEAGVSLLPSMSNMAKLLRDVVAKNMHTFRLFGPDETESNKLGEVYKAGKKVWMGENFEEDADGGNLATEGRVMEMLSEHTVEGWLEGYILSGRHGLLNSYEPFIHVIDSMVNQHCKWIEKCNEVEWRVKMASLNILLTATVWRQDHNGFTHQDPGFLDVVANKSPEVVRIYLPPDGNCLLSCMDHCLRSTNYVNVIVADKQDHLQFLNMEDALTHCEKGLGIWDWASNDQGFEPDVIMAACGDVPTHESLAATALLRELIPDLKIRFVNVVDLFKLIHHGDHPHGITDKDWISIFTSNKPIIFNFHSYPWLVHRLTYKRPGQVNIHVRGYKEKGNIDTPLELAIRNQTDRYSLAMDAVDRVERLSNKGAHVREKLLNMQILARRDAFENGIDPVHIREWRWPFQRGGKDEEMLNMLRLTSYKEKG

SEQ ID NO: 448 - protein, 822 aa, Pyrenophora tritici-repentis Pt-1C-BFP
MDAMAAKAPADPETVSEDVEHLSLSAYGPARASITEHPLSDDEVRKMTDYFHASLYMCLGMIYLRRNPLLREPLTLDHIKRRLLGHWGSDAGQSFTYIHMNRLIKKYDLDAIFISGPGHGAPAVLSNSFLEGVYSEVYPEKSEDEEGMKRFFRSFSFPGGIGSHATPETPGSLHEGGELGYSISHAFGAVFDHPDLIALTMVGDGESETGPLATSWHSTKFLNPITDGAVLPILHLNGYKINNPTVLARVSHKELEALFIGYGWTPYFVEGSDIPSMHQAMAATMERCVTKIREYQKEARDSGKAFRPRWPMIILRTPKGWTGPRKVDGDHFLEGFWRAHQVPLTNVLKDKSQLKLLEEWMRGYGPDKHFDENGKLIPELRELAPTGNRRMSANPVTNGGAIRRKLHVPDFRNYSVEVTKGGVAKMGSMANFAAFLRDVIRDNPKDFRLFGPDETQSNKLDKVYEAGKKVWLADYFEEDKDGGNLVHDGRVMEMLSEHTVEGWLEGYILSGRHGLLNSYEPFIHIIDSMVNQHCKWIEKCLEVEWRQKIASLNILLTSTVWRQDHNGFTHQDPGFLDVVANKSPEVVRIYLPPDANCLLSTMNHCLRSENYVNVIVADKQEHLQFLTMEQAIAHCTKGVGIWEWASNDSGAEPDIVMASCGDVSTHESLAATALLRTHLPDLKIRFVNVVDLFKLIDDGQHPHGLKAHEYKAIFTDDVPCIFNFHSYPWLVHRLTYGRKGQQNLLVRGYREKGNIDTPLELAIRNGTDRFSLAIDALDKIRNLGNRGAATREKLLDEQIKAKNYAYHEGIDPSWTEEWVWPF

SEQ ID NO: 449 - protein, 821 aa, Phaeosphaeria nodorum SN15
MDAMAAKAPVDPEKVVEDVEHLSLSPFGPARASITEHPLTDDEVSKMTDYFHASMYMCLGMIYLRRNPLLRDPLTLDHVKRRLLGHWGSDSGQSFTYIHMNRLIKKYDLDAIFISGPGHGAPAVLSNSFLEGVYSEVYPDKSEDENGMRRFFKSFSFPGGIGSHATPETPGSLHEGGELGYSISHAFGTVFDHPDLIALTMVGDGESETGPLATSWHSTKFLNPITDGAVLPVLHLNGYKINNPTVLSRISHKELEALFIGCGWTPYFVEGSDLPSMHQAMAATMERCVTKIREYQKEARDSGKAFRPRWPMIVLRTPKGWTGPRKVGDHFSEGFWRAHQVPLTNVLKDKSELKLLEQWMRSYEPEKHWDENGKLKPELRELAPEGNRRMSANPVANGGLIRGKLHIPDFREYAVEVTKGGVAKMGSMANFAGFLRDVIRDNPKTFRVFGPDETQSNKLDTIYEAGKKVWMGEYFEEDEDGGNLAYEGRVMEMLSEHTVEGWLEGYILSGRHGLLNSYEPFIHIIDSMVNQHCKWIEKCLEVEWRQKIASLNILLTATVWRQDHNGFTHQDPGFLDVVANKSPEVVRIYLPPDANCLLSTMDHCLRSSNYVNVIVADKQEHLQFLTMEQAIAHCTKGVGVWEWASNDKGEEPDVVMASCGDTSTHEALAATALLRQHLPDLKIRFVNVVDLFKLIDSSEHPHGLKAHEWKAIFTSDKPCIFNFHSYPWLIHRLTYGRKGQQNMLVRGYREKGNIDTPLELAIRNGTDRYSLAIDAIDHITTLGNKGGSAREALLNEQIKAKNYAYHEGLDPKETEDWVWPF

SEQ ID NO: 450 - protein, 834 aa, Cryptococcus neoformans var. neoformans JEC21
MAEETSSLTSFGQARSTVKDQPLTVEELKKIDAYMRASLYLCLGMLYLRQNPLLKEPLKKEHLKARLLGHWGSDAGQIFTYIHMNRLIKKYDLDALFVSGPGHGAPAVLSQSYLEGVYTEVYPNITEDVEGMRRFFKQFSFPGGVGSHATPETPGSLHEGGELGYSISHAFGTVFDNPNLITLTMVGDGESETGPLAASWHSTKFLNPITDGAVLPVLHLNGYKINNPTVLARISHEEIEALFIGYGWKPYFVEGSDLTSMHQAMAATLEKAVLEIKAYQKQARDSGKAFRPRWPMIILRSPKGWTAPRNVSGHHLEGYWRAHQIPLADVASNSEHLKLLEDWMRSYKPEELFTEDGKLIPELKALPPAGQARMSANPVSNGGLVRKALNLPDFKDYAIKDIAPGVTLAPSMSNMALFVRDVIKKNQTNFRLFGPDETESNKLAAVYEAGKKVWMGEYLPEDTDGGNLAHAGRVMEILSEHTVEGWLEGYVLSGRHGLLNSYEPFIHIIDSMVNQHCKWIEKCLEVEWRVKVSSLNILLTATVWRQDHNGFTHQDPGFLDVVANKSPEVVRIYLPPDGNCLLSVMNHCFDSKNYVNVVVADKQDHLQYLDMEAAVAHCTKGLGIWEWACVGDPNENPDLVMACCGDVPTMESLAATALLKEYLPELKIRFVNVVDLFKLISHVDHPHGLTDRQWVSYFTEDTPIIFNFHSYPWLIHRLTYKRPGSQNIHVRGYKEKGNIDTPLELAIRNETDRYSLAMDAIDRLPHLKNKGSMAREKLYDAQIKARDWAFEHGIDPEDVRKWKWPYGPKTEGIASKLGFGGENKQQVASVGTSE

SEQ ID NO: 451 - protein, 819 aa, Gibberella zeae PH-1
MSPEVKSISPFGIARSTVQGEPLSKEEIQQYNDFFKASCYLSLGMIYLKENPLLRQPLKAEHLKLRLLGHFGSAPGQIFTYMHFNRLIIKHDLHALFISGPGHGAPAVLSQSYLEGVYTEVYPDKTLDDEGMQKFFKSFSFPGGIGSHATPETPGSLHEGGELGYSISHAFGAVFDNPDLIALTMVGDGEAETGPLATAWHSNKFLNPIVDGAVLPVLHLNGYKINNPTVLARISHRELECLFIGYGWQPYFVEGDDIESMHQAMAATLEHCVDEIRKIQKEARDSGEAVRPLWPMIVLRSPKGWTAPRKVDNNYLEGYWRAHQVPIADPATNPAHLKVLEDWMRSYEPERLFDANGAPIASLRALIPQGNRRMSANPVANGGLLRKPLKMPDFRDYAIKVESPGNVMNASMTNMAVFLRDVMATNQTNFRLFGPDETESNKLGGVYDAGKKVWMGEYFEEDDNGGNLAKAGRVVEMLSEHNCEGWLEGYLLSGRHGLLNSYEPFIHVIDSMVNQHCKWIEKCLEVEWRAKIASLNILLTAVVWRQDHNGFTHQDPGFLDVVANKSPEVVRIYLPPDGNCLLSVMDHCLRSVNYVNVVVSDKQEHLQYLPMDAAIEHCTKGIGIWPQFSTDAGQNPDLVMASCGDISTHESLAAIDLLLEHFPDLKIRCVNVVDLFKLIHPSDHPHGLTDSEWTSLFTDDTPVIFNFHSYPWMVHRLTYKRPGSRNLHVRGYKEKGNIDTPLELAIRNQTDRFSLAIDAIDWMPQLRNRGASARQALLNSQIQARNEAFETGMDPAFLKNWTWKRNGLWKKVSEGLASR

SEQ ID NO: 452 - protein, 818 aa, Nectria haematococca mpVI 77-13-4
MAEVESIQPFGIARSTVKGTPLSEEEISQYNDFFKASCYLSLGMIYLKENPLLREPLKPEHLKLRLLGHFGSAPGQIFTWMHFNRLIKKYDLDSIFISGPGHGAPAVLSQSYLEGVYTEVYPDKTLDTEGLQKFFKSFSFPGGIGSHATPETPGSLHEGGELGYSVSHAFGAVYDNPDLIALTMVGDGEAETGPLATAWHSNKFLNPIVDGAVLPVLHLNGYKINNPTVLARISHKELENLFLGYGWQPYFVEGDDIESMHQAMSATLEHCVNEIKKFQKQARDSGEAFRPMWPMIVLRSPKGWTAPRKVDDNYLEGYWRAHQVPITDPATNPAHLKLLEDWMRSYEPERLFDEAGAPIAALRALTPEGNRRMSANPVANGGLIKKPLKMPDFRDYAIKVDSPGNVNNASMTNMAVFLRDVIAQNQNNFRLFGPDETESNKLGGVYAAGKKVWMGEYFEEDENGGNLAKSGRVMEMLSEHNCEGWLEGYILSGRHGLLNSYEPFIHVIDSMVNQHCKWIEKCLEVEWRAKVASLNILLTAVVWRQDHNGFTHQDPGFLDVVANKSPEVVRIYLPPDGNCLLSVMDHCLRSVNYVNVVVSDKQEHLQYLPMDQAIEHCTKGIGIWPQFSTDAGQEPDLVMASCGDISTHESLAAIDLLLEHFPELKIRCVNVVDLFKLIHHTDHPHGLPDSEWTALFTDDKPVIFNFHSYPWMVHRLTYKRPGSLNLHVRGYKEKGNIDTPLELAIRNQTDRFSLAIDAIDRMPQLKNRGAAARQTLLNAQIQARNEAFETGMDPPFLKNWTWKRNGLWKKIGDGLASR

SEQ ID NO: 453 - protein, 820 aa, Metarhizium anisopliae
MADEQSIRAFGPARSTIKGNPLSSSDIALYNDYFKASCYLSLGMIYLRDNPLLREPLNKAHLKQRLLGHFGSAPGQIFTYMHFNRLIKKYDLNAYFVSGPGHGAPAVLSQSYLEGVYSEVYPEKSLDAAGLQKFFKYFSFPGGIGSHATPETPGSIHEGGELGYSISHAFGSVFDHPDLIALTMVGDGEAETGPLATSWHSTKFLNPITDGAVLPVLHLNGYKINNPTVLARISHDELKNLFIGYGWEPFFVEGDELDSMHQAMASTLEHCVRLIKDYQKEARESGKAFRPRWPMIVLRTPKGWTAPRKVDNNYLGGFWRAHQVPITDVNTNSEHLKVLENWMRSYEPDRLFDKEGAPVAALRALCPEGHRRMSANLVTNGGLIKKPLKMPDFRDYAIKVDQPGATMNGSMTNMAGFLRDIMALNMHNFRLFGPDETESNKLARVYEAGKKVWMGDYFEEDANGGNLAMAGRVMEMLSEHTCEGWLEGYILSGRHGLLNSYEPFIHVIDSMVNQHCKWIEKCLEVEWRAKVASLNILLTALVWRQDHNGFTHQDPGFLDVVANKSPEVVRIYLPPDGNCLLSVMDHCFRSNNYVNVIVADKQDHLQYLDMESAIQHCTKGIGIWTKFSTDSGCEPDLIMASCGDISTQESIAAVDLLLNYFPDLKIRVVNCVDLFKLIHPTDHPHGLTDKEWISIFTENTPIILNFHSYPWMVHRLTYKRPGSKNLHVRGYREKGNIDTPLELAIRNQTDRFSLAIDAIDRMKFLGNRGASARQALLDQRIAARNEAFEQGMDPPALSEWTWQRNGLWQKAAEKLTIHTK

SEQ ID NO: 454 - protein, 827 aa, Neurospora crassa OR74A
MSDSNELEVESISPFGPARSTIKGEPLTKEEIDKFNDFFKASLYLSLGMIYLRDNPLLKEPLDTKHLKARLLGHFGSAPGQIFTWMHFNRLIKKYDLDSIFISGPGHGAPAVLSQAYLEGTYSEVYPEISEDEEGMQKFFKHFSFPGGIGSHATPETPGSIHEGGELGYSISHAFGAVFDHPNLIALTMVGDGEAETGPLATSWHSTKFLNPITDGAVLPVLHLNGYKINNPTILARISHKELENLFRGYGYEPYFVEGDDVDTMHQAMAATLEHCVLEIRKFQQKARESGKAFRPRWPVIILRSPKGWTGPRKIDDKFLEGFWRAHQVPITDVHEKPEHLKILEQWMKSYEPDRIFRDGRISEDLKDLCPTGTRRMSANPVANGGIIRKTLRMPDFRNYALKVDKPASIMAASMTNMSMFLRDVIAGNPTTFRLFGPDETESNKLGKVYEAGKKVWLGEYFEEDKDGGNLAPEGRVMEMLSEHTCEGWLEGYILTGRHGLLNSYEPFIHVIDSMVNQHCKWLEKCLEVEWRHKVASLNILLTAVVWRQDHNGFTHQDPGFLDVVANKSPEIVRIYLPPDGNCLLSVTDHCLRSSNYVNVIVADKQEHLQYLSMDDATIHCTKGIGIWPQFSSDRGEEPDLVMASCGDISTHESLAAIDLLLQHFPELKIRCVNCVDLFKLISHDEHPHGLTDAEWISLFTDNRPIIFNFHSYPWLVHRLTYKRPGSHNVHVRGYREKGNIDTPLELAIRNGTDRFSLAMAAIDHMTGILGNRGAAAREQLRNEQLKAKAMAFEVGMDPPFLKNWTWPHTGLWSKGEARVASEQHLH

SEQ ID NO: 455 - protein, 838 aa, Podospora anserina
MGEQQRTSSEQPPPPPQPKSISPYGPARSTVQGAPLTKEEVEQCNDFFKASLYLSLGMIYLRSNPLLTTPLDKSHFKARLLGHFGSAPGQIFTYMHFNRLIKKYDLDAIFISGPGHGAPAVLSQAYLEGTYSEVYPECSEDEEGLRKFFKQFSFPGGIGSHATPETPGSLHEGGELGYSISHAFGAVFDNPDLIAVTMVGDGEAETGPLATSWHSTKFLNPITDGAVLPILHLNGYKINNPTILARISHDELESLFRGYGYQPYFVEGDDVESMHQAMAATLEHCVLEIRKFQQQARTTGKAFRPMWPVVILRSPKGWTGPRKINGGLDYLEGYWRSHQVPLTDVHKNPEQFALLESWMRSYEPERLFIANGGRISSSLRQALCPTGNRRMSANPVANGGMLQKPLRMPDFRDYALGVDHPAETLSASMSNMARFLRDIISLNPNNFRLFGPDETESNKLGTVYEVAQKVWMGEYFPEDLNGGNLATEGRVMEMLSEHTCEGWLEGYLLSGRHGLLNSYEPFIHVIDSMVNQHCKWLEKSLEVSWRHPIPSLNILLTAVVWRQDHNGFTHQDPGFLDVVANKSPEVVRIYLPPDGNCLLSVTDHCLRSRNYVNVIVADKQPHLQFLSMADAIVHCTKGIGIWPGFSSCPAGSAPDVVMASCGDISTQESLAAISLLLDHFPALKIRCVNVVDLFKLISHEEHPHGLTNAEYEAIFTGDKPVVFNFHSYPWLVYRLIHGRKNAGGVVVRGYKEKGNIDTPLELAIRNGTDRFSLAMEAIDRLSEAGGVLEGKGGEARELLRNEQVRCQMRAFEEGVDPVEVTGWVWPSERRGLWSERKH

SEQ ID NO: 456 - protein, 815 aa, Acidithiobacillus ferrooxidans ATCC 53993
MTTEHDAACEGESISAYGTARATVEDQPLNTDDLRKIDAYWRASLYLCLGMLYLRDNPLLRDPLKPEHIKPRLLGHWGSDAGQCFTYIHFNRLINKYDLNAIYISGPGHGAPAILSQAYLEGTYSETYPDKSQDIAGMRRFFKQFSFPGGIGSHATPETPGSIHEGGELGYSVSHAFGTVYDNPDLIALVMVGDGEAETGPLATSWHSNKFLNPITDGAVLPVLHLNGYKINNPTILARITHEELEALFIGYGYTPYFVEGSDPASMHQAMAATMERCVLKIREFQDKARHTGTAFRPRWPMIILRSPKGWTAPRKVDGHYLEGFWRAHQIPIPDVVSNPAHLQLLESWMRSYRPEELFDAQGRLIPELHELAPKGKRRMSANPVANGGLLRRPLDMPDFRVFSIAVQDAGGTRADNVPTLGHFLREITRRNMQNFRIFGPDETQSNKLDAIYDVTQKVWLGAYFPEDADGGALALSGRVMEMLSEHTLEGWLEGYLLSGRHGLINSYEAFIHIIDSMFNQHAKWLEKCNELPWRAKVASLNLLITGLVWRQDHNGFTHQDPGFLDVVANKSPNVVRIYLPPDANCLLSVTDHCLRSVNYINVIVADKQTHLQYLDMDAAMAHCAKGAGIWEWASNDMGEEPDVVMASCGDVPTMESLAATALLRQHLPDIKIRFVNVVDLFKLVPHTEHPHGMTDREFEALFTSSKPVIFNFHSYPWLIHRLTYRRPAQHHIHVRGYKEKGNIDTPLELAIRNQTDRFSLAIDAIDRIPRFCDTGSGVREILLNLQFACKNHAYEYGVDPQEITDWQWPFRDTP

SEQ ID NO: 457 - protein, 820 aa, Acidiphilium cryptum JF-5
MRLKNPMLTDGDIEAISPYGPARATIHGTPLNPDELERLDAYWDISLYLCLGMLYLRDNPLLRTTLQPEHVKARLLGHWGSDAGQCFTYIHFNRLICKYDLDAMYISGPGHGAPAVLSQAYLEGTYSEIYPEISEDLAGLRRFFNQFSFPGGIGSHATPETPGSIHEGGELGYSLSHAFGTVFDNPDLITLVMVGDGEAETGPLATSWHGNKFLNPITDGAVLPVLHLNGYKINNPTILARISHEELEALFVGYGYTPYFVEGSDRASMHQAMAATMEHCVHEIRAAQGEARRTGKAFRPRWPVIVLRSPKGWTGPRLVDNHYLEGSWRAHQIPIADVPCNPDHLKLLEDWMRSYRPEIHFDGDGRIIPELRALAPKGLRRMSANPAANGGTIRRPLNLPDFRSFQVDVDHPGVRRAGNVPTLGPFLREIIRENHDNFRIFGPDETQSNKLDSIYTAGKKSWLGAHFPEDEDGGNLAVAGRVMEMLSEHTVEGWLEGYLLSGRHGLINSYEPFVHVIDSMFNQHAKWLEKCNELAWRVPISSLNILITALVWRQDHNGFTHQDPGFLDVVANKNPDVVRIYLPPDANCLLSVADHCLRSQNYVNVIVSDKQIHLQYLNMDAAIAHCAKGAGIWDWASNDHGQEPDVVMASCGDVPTVEALAATALLRTHLPDIKIRFVNCVDLFRLVPNWEHPHGLTDSEFEELFTATKPVIFNFHSYPWLIHRLTYRRPAQHNIHVCGYGEKGNIDTPLELAIRNRTDRFSLAIDAISRIPRFRDSSSDVLEVLLERRQACVQHAHEFGTDPKHISDWIWPKADSEGRS

SEQ ID NO: 458 - protein, 787 aa, Thermotoga lettingae TMO
MVEKLVDFWKACCYISAGMIYLKDNPLLRTPLKSEHIKNRLLGHWGASPALSFVYVHANRVINKYNLNAIFIAGPGHGAPGVIAPVYLEGTLSEYYPEFTQDEEGMKKLFKYFSFPGGFGSHCTPELPGSIQEGGELGYSLSHAYGAIFDNPKLLAVTVIGDGEAETGPLAASWHSNKFLNPARDGAVLPVLSLNGYKINNPTVLARIEEAELLNLFKGYGYDPIIVDGTDDYVESHQKMAEAMDKSVERIINIWSDAKEKIQRPILPMIILRSPKGWTAPKIVKDHYIEGYWRSHQVPLSDVKENTENLVILQQWLMSYEPNKLFDQSGKLRKDLLELIPPDNLKMSKNPISNGGLIRIPLKLPQLKEFSIDPQQQKYHENTRPLGDYLRKIIDLNPNNFRVFGPDETKSNRLDAIFAHGKAWNARIFPVDSDEGYLSAFGRVMEILSEHTIEGWLEGYLLTGRHGFLNTYEGFAPIISSMVNQFGKWIDISSDISWRMPVSSLNLLLTSVVWRQDHNGFTHQDPGFITSIVDKWPNVVRVYFPPDANTLLATTWHCLQTTNRINIIVADKQKHPQYLNIDEAIKNVIKGIGIWNFASNHPQEEPDVVVASCGDIPTKEAIAAVKIVKDFFPELRIRFVNVINLFALTPSGEHPDGLTDREFDSYFTTDKPVIFNFHGYPWLIHRLTYRRKNHDNIHVRGYRENRKYGIDSTALSPFLKGRGGITTPMQLSILNQTDRFSIAIDIIDRVERISQKAGYARDLIRNAQIEALQYAYEHGVDKPDLCD

SEQ ID NO: 459 - protein, 792 aa, Dictyoglomus turgidum DSM 6724
MLEKLNDYWKACCYLAAGMIYLWDNPLLKEPLKPEHIKERLLGHWGASPGLSFVYVHGNRVINKYDLNCIFIAGPGHGAPGVIAPAYLEGTISELYSQFSQDEEGMKNLFKAFSFPGGLGSHCTPELPGSIQEGGELGYSLSHAFGAVFDHKDLIAITVVGDGEAETGPLATSWHSNKFLNPVRDGAVLPVLLLNGYKINNPTLLSRIENDELINLFKGYGYEPYIVEGEESFEVHEKMAKAMDSAVEKIINIWEDARSNNKPFRPLWPMIILRTPKGWTAPRKVGDHYIEGYWRAHQVPFSDAKENQKSLEVLEAWLRSYEPQKLFTPEGKLREDLRELAPKGEKRMSATHYANGGFLRKELKLPDLKNYAVKVESPINDEAENTRPLGIFLKEIIRLNPDNFRVFGPDETKSNRLDAVFEYGKAWMAKILPEDEDEGFLSPFGRTMEMLSEHTLEGWLEGYLLTGRHGFLNTYEGFAPIISSMVNQFGKWLDISSDIPWRAPISSLNLLLTSVVWRQDHNGFTHQDPGFITSIVDKWPNVVRVYFPPDANTLLCTVWHCFQTTNRINIIVIDKQKHPQYLSIEDAFKHAMKGIGIWDFASNHPEHEPDVVIASCGDIPTKEAIYAVKILKKLFPNLKIRFVNVLNLFTLTPNTEHPDGLSDREFDSYFTKDKPVIFNFHGYPWLIHRLTYRRNNHKNIHVRGYRENRKIGIDAGYLAPFLKGRGGITTPLQLAILNQIDRFSIAMDVIERVEALQDEGGYYKDLLKNKQIEALEYAYNHGVDKEFDEKDL

SEQ ID NO: 460 - protein, 793 aa, Nitrobacter hamburgensis X14
MKTTADSKTLSPELLHNMDAYWRAANFLSVGQIYLYDNPLLKRPLTLADVKHMLLGHWGTTPGQNFIYVHLNRVIKKYDLDMIYVSGPGHGGPAVVGNTYLEGTYSEIYPDISQDEAGLRKLFTQFSFPGGIPSHASPECPGSIHEGGELGYSLSHSFGAVFDNPDLVVACVVGDGEAETGPLATAWHSNKFLNPATDGAVLPILHLNGYKISNPTILARITREELEQLLRGYGWAPYFVEGHEPALMHEAMAATLDMAVEQIKQIQQDARIHGNVTRPRWPMIVLDSPKGWTGPKVVDGLQVEGTFRAHQVPLSDPATHPEHLKLLEDWLRSYRPEELFNEHGHLKPELAELAPKDERRMGANPHANGGILLRDLRMPNFRDYAADVPSPGVRGIGDTRVLGPFLRDVTKLNSEQRNFRVFGPDETLSNGLEALFEVTNRQWDATTAANDDFLAPTGRVMEMLSEHQCEGWLEGYLLTGRHGLFNCYEAFIHIVDSMFNQHAKWLEVTSHLPWRRKIASLNYLLASHVWRQDHNGYTHQDPGFIGHVMNKKAEIVRVYLPPDANCLLSVTDHCLRSRHYVNVVIAGKHPAPQWLTMDAAAAHCSEGIGIWQWAGSDQDSEPDVVMACCGDVPTLETLAAVSILRQRLPDLKIRVVNVVDLLKLQPKNEHPHGLSDTDFDSLFTKDKPVIFAFHGYPWLVHRLTYRRTNHENLHVRGYKEEGTITTAFDMTVLNDLDRFHLVIDVIDRLPQLSAKGAYLKQQLQDKLTEHKHYIRRYGEDMPEIRNWRWGAKT

SEQ ID NO: 461 - protein, 789 aa, Blastopirellula marina DSM 3645
MNATSLTSELLDKMDAYWRAANYLSVGQIYLFDNPLLKRPLQLSDIKPMLLGHWGTTPGQNFIYVHLNRIIKKYDLNMIYVSGPGHGGPAVVGNTYLEGTYSEIYPNISQDEEGLRKLFIQFSFPGGIPSHASPECPGSIHEGGELGYSLSHSFGAVFDNPDLIVACVVGDGEAETGPLATAWHSNKFLDPATDGAVLPILHLNGYKIANPTILARIEPEELDKLLHGYGWTPYYVEGDDSRRMHEVMAIALDEAVEQIKTIQQDARANGNFTRPRWPMIVFRSPKGWTGPKIVGGLQIEGTFRAHQVPLSDPKSHPEHLQLLEDWLRSYRPEELFDDQGRLKPELAELAPQGERRMGANPHANGGKLLRDLRLPDFRDYACDVPEPGAHGIGDTHVLGPFLRDVTKLNQPQRNFRVFGPDETLSNGLEALFQVTKRQWEARTEDNDEFLAPQGRVMEMLSEHQCEGWLEGYLLTGRHGVFNCYEAFIHIVDSMFNQHAKWLKVTAGLAWRHKIASLNYLLASHVWRQDHNGFTHQDPGFLDHVVNKKAAIVRVYLPPDANCLLSVMDHCLRSRHYVNVVVAGKHPAPQWLTMDAAVKHCTEGIGIWQWASNDQNETPDVVMACCGDVPTLETLAAVSILQEHLPDLKVRVVNVVDLMRLQPHSEHPHGLSDVDFDELFTKDKPVIFAFHAYPTLIHQLTYRRTNHANIHVRGYKEEGTITTPFDMTVLNDLDRYHLVMDVIDRVPKTGEKGVYLKQQLEDKLIEHRQYICRHGQDMPEIRNWKWNAAK

SEQ ID NO: 462 - protein, 797 aa, Marinomonas sp. MWYL1
MPKTTMQTAALAPDQLSLIDRYWRASNYLSVGQIYLHDNPLLSRPLVLADIKRILLGHWGTTPGQNFIYVHLNRIIKQYDLSMIYISGPGHGGPAVVSNTYLEGSYSEIYPDISQDTVGLQKLFKQFSFPGGIPSHASPECPGSIHEGGELGYSLSHAFGAVFDNPELIAACVVGDGEAETGPLATAWHSNKFLNPITDGVVLPILHLNGYKIANPTVLARISHQELEQLFRGYGWHPIFVEGSDPDYMHKAMATALDFAVREIKAIKLNAQENRVFERPRWPMIILKSPKGWTGPKIVDGVQIEGTFHAHQVPISNPESKPEHLPLIEEWLRSYRPQELFDSNGRLLPELVELAPKGERRMGANPHANGGLLLKPLQMPDFRDYACTVPKHGVRGVGDTHVLGPFVRDVVKLNQENFRVFGPDETISNGLEAVFETTNRQWEATTKINDEYLAPNGRVMEMLSEHQCQGWLEGYLLTGRHGLFNCYEAFIHIVDSMFNQHAKWLKVTAGLSWRPKIASLNYLLASHVWRQDHNGFTHQDPGFIDHVVNKKADIVRVYLPPDANCLLSVMDHCLRSKHYVNVVVAGKHPAPQWLDMDAAAKHCAAGIGIWQWASNDTGLNQHDQTDVVMACCGDVPTLETLAAVSILREHLPTLNIRVVNVVDLMKLQPQTEHPHGLNDAEFDFLFTENKPVIFAFHTYPSLIHKLTYRRTNHRNIHVRGYKEEGTITTAFDMTVLNDMDRFHLVMDVIDRLPQTGVKGVELKRMLSEKLIEHRQYINEYGVDMPEIRDWKWSNKDE

SEQ ID NO: 463 - protein, 793 aa, Rhodopirellula baltica SH 1
MIETLESTQVSHETLRTIDAYWRAANYLSVGQIYLSDNPLLKRPLRIEDVKKMLLGHWGTTPGQNFIYAHLNRTIKQNDLNMIYVSGPGHGGPAVVANTYLEGSYSEIYPHISQDEAGMRKLFVQFSFPGGIPSHASPECPGSIHEGGELGYSLSHSFGAVFDNPDLIVACVVGDGEAETGPLATAWHSNKFLNPATDGAVLPILHLNGFKIANPTILARINHEELEQLMRGYGWTPIFVEGKDPMKMHAAMAEALDVAIGQIRSIQQNARETGDTSRPRWPMIVLRSPKGWTGPKFVDGVRNEGTFHSHQVPLSDPAKCPEHLKQIEQWLRSYRPEELLDENGRLRQEIADLAPTGDRRMGANPHANGGRLLRRLKMPDFRDYAVEISQRGCRGIGDTHVTGKFIRDIVRLNEEHKNFRIFGPDETISNGLEAVFDVTQRQWNAAIVEDDESLAPTGRVLEMLSEHQCEGWLEGYLLTGRHGLFNCYEAFVHIVDSMFNQHAKWLKVTSELPWRHKIASLNYLLASHVWRQDHNGFTHQDPGFLDVVVNKKAEIVRVYLPPDANCLLSVMDHCLRSQHYVNVVVAGKHPSPQWLTMGEAAEHCAKGIGIWDWAGNESSSDPDVVMACCGDVPTLETLAAVSILREHLPDLTIRVVNVVDLMRLQPKSEHPHGLSDSDFDALFTKNKHVIFAFHAYPWLVHRLTYRRTNHANIHVRGYKEEGTITTPFDMTVLNDLDRFHLVMDAIDRLPETGGRGQRLKALMQEKLVEHRRYINENGQDMPEIRDWEWSARS

SEQ ID NO: 464 - protein, 793 aa, Legionella drancourtii LLAP12
MKTLTQEMLNKIDRYWRAANYLSVGQIYLRDNPLLKRPLVFSDIKPRLLGHWGTTPGQNFIYTHLNHIIKKYDLNMMYISGPGHGGPAVVANAYLEGTYSEVYPEVSQDEDGLRKLFSQFSFPGGIPSHASPECPGSIHEGGELGYSLSHAFGAVFDNPDLIVACVIGDGEAETGPLATAWHANKFLCPVTDGAVLPILHLNGYKIANPTVLARITKEELGSLLYGYGWTPYWVEGDEPLLMHETMAAALQSIIEQIKLIQHDARSQKNNQRPHWPMIILKTPKGWTAPKVVDGIQIEGTFRSHQVPISDCSSNIEHLKILEHWLRNYKPETLFDEQGRLLNDLKDMAPENEKRMSANPHANGGGLLQALKLPDPDNYSIKLLVRGMPGQGDTRVLGPYIRDVIQLNASNFRVFGPDETISNGLEAVFEATNRQWDTQILPSDSFLSSQGRVFEVLSEHQCEGWLEGYLLTGRHGLFNCYEAFIHIISSMFNQHAKWLKVTSTIPWRKKIASLNYLLTSHVWRQDHNGFSHQDPGFIDHVVNKKAEIIRVYLPPDANCLLSIMHHCLQSQHYVNVVIAGKHPAPQWLSIEEAKQHCANGIGIWEWASHSKGEVPDVIMACAGDVPTLETLAAVSILRAQLPHINIRVINVVDLMKLQPDYEHPHGLSDEDFDLLFLPDKPVIFAYHGYPWLIHRLTSSRSNHRNMHVRGYREEGTITTPFDMTVLNELDRFHLVLDVLNHLPHLGSKEQKLIENINIKLLEHQHYIRQHGNDLPEIRDWKWEYHTLEDESYTI

SEQ ID NO: 465 - protein, 789 aa, Streptomyces sp. Mg1
MSTQSLPKELLHRMDAYWRAANYVSVGQLYLYDNPLLRRPLELDDVKPLVVGHWGTTPGQNFVYVHLNRVIKKYGLDMFYVSGPGHGGPALVGNTYLEGTYSEIYPDVTQDEAGLRKLFTQFSFPGGISSHVAPTTPGSIHEGGELGYSLSHAFGAVFDNPGLIVACVVGDGEAETGPLATAWQSTRFLDPAGDGAVLPILHLNGYKISNPTVLARIGDDELAQYLRGCGWEPHFVSGDDPETMHELMATTLDRAIEGIRQIQEASRAGAGGKRPRWPMIVLRSPKGWTGPKSVDGHQIEGTFRSHQVPLLVDAAHPDHVGQLESWMRSYKPEELFDESGRLLPDLAELAPVGDRRMSANPHTNGGVLLHGLRMPDFRPYAVDVPAPGAVSAQDTLVLGGFLRDVIVSNAERRNFRIFGPDETLSNFLGAVFETTNRQWNAGTVQDDEFLAPSGRVVDSMLSEHQCEGWLEGYLLTGRHGLFNCYEAFIHIIDSMFNQHAKWLKVTKQLPWRRDIASLNYLLTSHVWQQDHNGFTHQDPGFLDHVVNKKADIVRVYLPPDANCLLSVMDHCLRSRHYVNVVVASKRAMPQWLAMDEAVVHCTEGIGIWPWAGNDEGVDPDIVLACCGDTPTLEILAAVSILREHLPEVSVRVVNVVDLMRLESDRKHPHGLSDRDYDALFTRDKHIIFAFHGYPWLIHRLTYSRTNRNLHVRGYNEEGTITTAFDMRVQNHLDRFHLVQDVIDRLPQLGSRGDYLRQQMSDRLVEHTRHIAVHGTDLPEIRDWTWNGPL

SEQ ID NO: 466 - protein, 688 aa, Lactobacillus reuteri SD2112
MAVDYDSKKYLESVDAYWRAANYLSVGTLFLMGDPLLRQPLKAEDVKPKPIGHWGTIVPQNFIYAHLNRVIKKYDLDMFYIEGSGHGGQVMVNNSYLDGSYTEIYPEYTQDTKGMAKLFKHFSFPGGTASHAAPETPGSIHEGGELGYSLSHGVGAILDNPDVIAAVEIGDGEAETGPLMASWFSDKFINPIKDGAVLPIIQVNGFKISNPTILSRMSDEELTKYFEGMGWKPYFVSAYKEADRDGEFDGYKPHMEVHEQMAKTMDKAVEEIKAIQKNARENNDDSLPQWPLIIFRAPKGWTGPTKDLDGNPIENSFRAHQIPIPVSQDDMEHKDMLINWMKSYKPEELFDENGHPVALVEENTPEGNRRMAMNPITNGGIDPKPLVLPNYRDFAVDVQTPGSVVKQDMLEWGKYLSKMAELNPTNFRGFGPDESKSNRLYAFLDNQKRQWMEGIHEPNDENVAPQGRMIDSQLSEHQAEGFLEGYTLTGRHGFFATYEAFGRVVDSMLTQHMKWLRKAKDLYWRRQYPALNFVDTSTVFQQDHNGYTHQDPGLLTHLFEKERPDLVKEYLPADTNSLMAVSNKAFRNQECINLFVTSKHPRAQWFSIDEATELVDNGLGYINWASTDQGSEPDVVFASAGTEPTEEALAAIDILHDNFPELKIRYINIIEIMKLMKQDKNPEGLSDA

SEQ ID NO: 467 - protein, 824 aa, Lactobacillus vaginalis ATCC 49540
MIYVLFNGKNVSIYSEGVFIRMAVDYDSKKYLESVDAYWRAANYLSVGTLFLMGDPLLRQPLKAEDVKPKPIGHWGTIVPQNFIYAHLNRVIKKYDLDMFYIEGSGHGGQVMVNNSYLDGSYTEIYPEFTQDTKGMAKLFKHFSFPGGTASHAAPETPGSIHEGGELGYSLSHGVGAILDNPDVIAAVEIGDGEAETGPLMASWFSDKFINPIKDGAVLPIIQVNGFKISNPTILSRMSDEELTKYFEGMGWKPYFVSAYKEADREGEFNGYKDHMEVHEQMAKTMDTVVEEIKAIQKNARENNDDSLPQWPMIIFRAPKGWTGPTKDLDGNPIENSFRAHQIPIPVSQDDMEHKDMLVDWMKSYKPEELFDENGHPVALVEENTPEGNRRMAMNPITNGGIDPKPLVLPNYRDFAVDVQTPGSVVKQDMLEWGKYLSKMAELNPNTFRGFGPDESKSNRLYAFLDNDKRQWMEGIHEPNDENLAHSGRMIDSQLSEHQAEGFLEGYTLTGRHGFFATYEAFGRVVDSMLTQHMKWLRKAKDLYWRHQYPALNFVDTSTVFQQDHNGYTHQDPGLLTHMFEKERPDLVKEYLPADTNSLMAVSNKAFNDQECINIFVTSKHPRAQWFSIDEATELVDNGLGYINWASTDQGSEPDVVFASAGTEPTEEALAAIDILHDNFPELKIRYINIIEIMKLMKQDKNPEGLSDAEFNRYFTTDKPVIFAWHGFRDMIQALFFDRANRNVHIHSYEENGDITTPFDMRVLNELDRFNLAKDAIQSVPGYEQKSAAFVAKMDNMINKHNHYIRSEGKDLPEVTNWTWKGLK

SEQ ID NO: 468 - protein, 803 aa, Lactobacillus reuteri 100-23
MAVDYDSKKYLESVDAYWRAANYLSVGTLYLMGDPLLRQPLKAEDVKPKPIGHWGTIVPQNFIYAHLNRVIKKYDLDMFYIEGSGHGGQVMVNNSYLDGSYTEIYPEYTQDTKGMAKLFKHFSFPGGTASHAAPETPGSIHEGGELGYSLSHGVGAILDNPEVIAAVEIGDGEAETGPLMASWFSDKFINPIKDGAVLPIIQVNGFKISNPTILSRMSDEELTKYFEGMGWKPYFVSAYKEADRDGEFKGYKPHMEVHEEMAKTLDKVVEEIKAIQKNARENNDDSLPQWPMIIFRAPKGWTGPKTDLDGNPIENSFRAHQIPVPVSQDDMEHKDILVDWLKSYKPEELFDEDGHPVALVEENTPEGNRRMAMNPITNGGIDPKPLVLPNYRDFAIDVQNPGSVVKQDMLEWGKYLNKMAELNPTNFRGFGPDESKSNRLYAFLDGQKRQWMESVHEPNDEDVAPQGRMIDSQLSEHQAEGFLEGYTLTGRHGFFATYEAFGRVVDSMLTQHMKWLRKAKDLYWRHQYPALNFVDTSTVFQQDHNGYTHQDPGLLTHLFEKERPDLVKEYLPADTNSLMAVSNKAFRNQECINLFVTSKHPRAQWFSIDEATQLADNGLGYIDWASTDQGTEPDVVFASSGTEPTEEALAAIDILHDNFPELKIRYINIIEIMRLMNTDKNPEGLTDAEFNSYFTTDKPVIFAWHGFRDMIQALFFDRANRNVHIHSYEENGDITTPFDMRVLNELDRFHLAKDAIQSVPGYEQKSAAFVAKMDNMINKHNHYIRSEGKDLPEVTNWTWKGLK

SEQ ID NO: 469 - protein, 799 aa, Lactobacillus coleohominis 101-4-CHN
MTVDYDSKQYLENVDAYWRAANYLSVGTLFLMHNPLLRRELEAKDVKPKPIGHWGTIVPQNFIYAHLNRVIKKYDLDMFYIEGSGHGGQVMVNNSYLDGSYTEIYPDYTQDVKGMAKLFKHFSFPGGTASHAAPETPGSIHEGGELGYSLSHGVGAILDNPDVIAAVEIGDGEAETGPLAASWFSDKFINPIKDGAVLPILQINGFKISNPTIVSRMTNEELTKYFEGMGWKPYFVSAYTDGEFDGLKPHMEVHEEMAKVMDKAIEEIKAIQKNARENNDDSLPQWPMIIFRVPKGWTGPKKDLDGNPIENSFRAHQIPIPVSQDDMEHKDMLVDWMKSYKPEELFDENGHPVEAVTMTTPEGDKRMAMNPITNGGIDPKPLVLPDYRDFAVDVKTPGSVVKQDMIEWGKYLNKVAELNPNNFRGFGPDESKSNRLYAILDDQKRQWMEDIHEPNDENMNHSGRMIDSQLSEHQAEGWLEGYTLTGRHGFFATYESFGRVVDSMLTQHMKWLRKAKEMYWRHDYPALNFVDTSTVFQQDHNGYTHQDPGLLTHMYEKERPDLVKEYLPADTNELMAISDVAFRNRECINIFVTSKHPRAQWFSIDEATEIAKNGLGYVDWASTDQDADPDVVFASAGTEPTEESLAAISILHENFPELKIRYINVVDIMKLMPIEKNPEGLTDEEFDRYFTTDAPVIFAWHGFEDMIQSLFFPRHNHNLHVHCYRENGDITTPFDMRVLNELDRFHLAKDAILNVKGYEQKAASFAQKMDDMVAKHNQYIRDEGKDLPEVENWVWKTLK

SEQ ID NO: 470 - protein, 799 aa, Lactobacillus fermentum 28-3-CHN
MAVDYNSKEYLETVDAYWRAANYLSVGTLFLMHNPLLRQELKASDVKPKPIGHWGTIVPQNFIYAHLNRVIKKYDLKMFYIEGSGHGGQVMVNNSYLDGSYTEIYPEITQDEAGMAKLFKHFSFPGGTASHAAPETPGSLHEGGELGYSLSHGVGAILDNPDQIAAVEIGDGEAETGPLAASWFSDKFINPITDGAVLPILQINGFKISNPTILSRMSDEELTKYFEGMGWKPYFVSAYAGGEFDGLKEHMEVHEEMAKVMDAAVEDILAIQKHARENNDDSMPQWPMIVFRVPKGWTGPVKDLNGDPIENSFRAHQIPIPVTQDDMEHKDMLVDWMKSYKPEELFDENGAPVEKVVANIPEGDRRMAVNPITNGGVNPKELVMPNYRDFAVDVKNHGTEMHQDMLEWGKYIAKMIELNPTTFRGFGPDESKSNRLYAALDGGKRTWMEDIHEPNDENLSRTGRIIDSQLSEHQAEGWLEGYTLTGRHGFFATYESFGRVVDSMLTQHMKWLRKAKEQYWRHDYPALTFVDTSTVFQQDHNGYTHQDPGLLTHLYEKERPDMIKEYLPADTNSLLAVSDVAFRDRECINVLVTSKHPRLQWFSIDEATELVANGLGYIDWASTDQGAEPDVVFASAGTEPTEEALAAIDLLHDNFPELKIRYINVINIMKLMTIAKNPEGLSDEEFDRYFTADKPVIFAWHGFRDMIQSLFFPRHNRNLHVHCYEENGDITTPFDMRVLNKLDRFHLAKDAILSVPGYEQKAVAFAQKMDDMVARHNHFIRTEGKDLPEVEAWTWKGLK

SEQ ID NO: 471 - protein, 805 aa, Lactobacillus acidophilus ATCC 4796
MLKGEKMTVNYDSKDYLKSVDAYWRAANYLSVGQLFLMKNPLLKKPLTAEDVKPKPIGHWGTIAPQNFIYAHLNRALKKYDLDMFYIEGSGHGGQVMVSNSYLDGSYTERYPEITQDEKGMAKLFKRFSFPGGVASHAAPETPGSIHEGGELGYALSHGVGAILDNPDVIAAVEIGDGEAETGPLAASWFSDKFINPIKDGAVLPILQINGFKISNPTIVSRMSDEELTEYFRGMGWDPHFVSVFKGGRFDGEKDPMQVHEEMAKTMDEVIEEIKAIQKHARENNDATLPHWPLIIFQCPKGWTGPKKDLDGNPIENSFRAHQIPIPVSQYDMKHVDMLTDWLESYKPNELFNEDGSPKEIVTENTAKGDQRMAMNPITNGGKDPKRLNLPDYRNFALKFDKPGSVEAQDMVEWAKYLNEVAKLNPTTFRGFGPDESKSNRLFKLLDDQKRQWEPEVHEPNDENLAPSGRVIDSQLSEHQDEGFLEGYVLTGRHGFFATYEAFGRVVDSMLTQHMKWLRKAKEQYWRHDYPSLNFVATSTVFQQDHNGYTHQDPGILTHLYEKNRPDLVHEYLPSDTNTLLAVGNKAFTDRECINVLVTSKQPRPQWFSIEEAQKLVDKGLSYIDWASTDKGVKPDIVFASTETEPTIETLAAIDILHDKFPDLKIRYINVIDVMKLMSPKDNKNGISDEEFDRLFPKDVPVIFAWHGYKSMMESIWFARNRHNVHIHCYEENGDITTPFDMRVLNHLDRFDLAKDAVESVDKLKGKNADFISHMDDLLEKHHQYIRDNGKDMPEVTEWKWKGLK

SEQ ID NO: 472 - protein, 812 aa, Lactobacillus crispatus JV-V01
MKKSTLRCSKENKMAVDYDSKDYLKSVDAYWRAANYLSVGQLFLMKNPLLKTPLVAEDVKPKPIGHWGTIAPQNFIYAHLNRVLKKYDLNMFYIEGSGHGGQVMVSNSYLDGSYTERYPEITQDQKGMAKLFKRFSFPGGVASHAAPETPGSIHEGGELGYSLSHGTGAVLDNPDVIAAVEIGDGEAETGPLAASWFSDKFINPIKDGAVLPILQINGFKISNPTIVSRMSDQELTEYFRGMGWDPHFVSVFKGGRFDGEKDPMQVHEEMAKTMDEVIEEIKAIQKHARENNDATLPHWPMIIFQCPKGWTGPKKDLDGNPIENSFRAHQIPIPVAQGDMEHADMLTDWLESYKPEELFNEDGSPKEIVTENTAKGEHRMAMNPITNGGLDPKRLNLPDYRKFALKFDKPGSMEAQDMVEWAKYLDEVAKLNPTTFRGFGPDESKSNRLFQLLDDQKRQWEPEIHEPNDENLAPSGRVIDSQLSEHQDEGFLEGYVLTGRHGFFATYEAFGRVVDSMLTQHMKWLRKAKEQYWRHDYPSLNFVATSTVFQQDHNGYTHQDPGILTHLYEKNRPDLVHEYLPSDTNTLLAVGDKALKDRECINVLVTSKQPRPQWFSIEEAQKLVDKGLSYIDWASTDKGAKPDVVFASTETEPTIETLAAIDILHKKFPDLKIRYINVVDVMKLMDPKDNKNGLSTEEFDRLFPKDVPVIFAWHGYKSMMESIWFARKRYNVHIHCYEENGDITTPFDMRVLNHLDRFDLAKDAVESIPALKGKNADFISHMDYLLEKHHQYIRDNGKDMPEVTEWQWSGLK

SEQ ID NO: 473 - protein, 799 aa, Lactobacillus ultunensis DSM 16047
MTVDYDSKDYLKSVDAYWRAANYLSVGQLFLMKNPLLKTPLVAEDVKPKPIGHWGTIAPQNFIYAHLNRVLKKYDLYMFYIEGSGHGGQVMVSNSYLDGSYTKRYPEITQDEKGMAKLFKRFSFPGGVASHAAPETPGSIHEGGELGYSLSHGVGAILDNPDVIAAVEIGDGEAETGPLTASWFSDKFINPITDGAVLPIIQINGFKISNPTIVSRMSDQELTEYFRGMGWDPHFVSVFKGGRFDGEKDPMQVHEEMAKTMDEVIQEIKAIQKHARENNDPTLPHWPMIVFQCPKGWTGPKKDLDGNPIENSFRAHQIPIPVSQGNMKHADMLTDWLESYKPEELFNEDGSPKDIVTENTAKGDHRMAMNPITNGGLNPKRLNLPDYRDFALKFDKPGSVEAQDMVEWAKYLDEVAKLNPTTFRGFGPDESKSNRLFKLLDDQKRQWEPEIHEPNDENLAPSGRVIDSQLSEHQDEGFLEGYVLTGRHGFFATYEAFGRVVDSMLTQHMKWLRKAKEQYWRHDYPSLNFVATSTVFQQDHNGYTHQDPGVLTHLFEKNRPDLIHEYLPSDTNTLLAVGNKALQDRECINVLVTSKQPRPQWFSIEEAQKLVDHGLGYVDWASTDKGAKPDVVFASTETEPTIETLAAIDILHKKFPDLKIRYINVVDVMKLMSPKDNKNAISDEEFDRLFPSDVPVIFAWHGYKTMMESIWFARNRHNVHIHCYEENGDITTPFDMRVLNHLDRFDLAKDAVESVEKLKGKHADFISQMDDLLEKHHQYIRDYGKDMPEVTEWQWEGLK

SEQ ID NO: 474 - protein, 798 aa, Lactobacillus crispatus 125-2-CHN
MAVDYDSKEYLKSVDAYWRAANYLSVGQLFLMKAPLLKTPLVAEDVKPKPIGHWGTIAPQNFIYAHLNRVLKKYDLDMFYIEGSGHGGQVMVSNSYLDGSYTERYPEITQDEKGMAKLFKRFSFPGGVASHAAPETPGSIHEGGELGYSLSHGTGAILDNPDVIAAVEIGDGESETGPLTASWFSNKFINPINDGAVLPILQINGFKISNPTIVSRMSDKELTEYFRGMGWDPHFVSVFKGGRFDGEKDPMQVHEEMAKTMDEVIEEIKAIQKHARENNDATLPHWPMIIFQCPKGWTGPKKDLDGNPIENSFRAHQIPIPVAQDDMEHKEMLEKWLKSYKPEELFNEDGSPKKIVTENTAKGDHRMAMNPVTNGGKNPKRLNLPDYRKYALKFKPGQMEAQDMVEWAKYLSEVADLNPDTFRGFGPDESKSNRLFALLDDQKRQWEPEIHEPNDENLAPSGRVIDSQLSEHQDEGFLEGYVLTGRHGFFATYEAFGRVVDSMLTQHMKWLRKAKEQYWRHDYPSLNFVATSTVFQQDHNGYTHQDPGILTHLYEKNRPDLVHEYLPSDTNTLLAVGDKALKDRECINVLVTSKQPRPQWFSIEEATKLADKGLSYIDWASTDQGYKPDIVFASTETEPTLESLAAIDILHKRFPDLKIRYINVVDVMKLMSPKDNKNAVSDKEFDRLFPSDIPVIFAWHGYKTMMESIWFARNHHNIHIHCYEENGDITTPFDMRVLNHLDRFDLAKDAVESIPSLAGKNPDFINEMDDLLAKHHQYIRDNGKDIPEVTEWKWTGLK

SEQ ID NO: 475 - protein, 818 aa, Lactobacillus gasseri JV-V03
MINTVISNENYFKEILAMVVNYDSEEYLKSVDAYWRAANYLSVGQLFLMNNPLLKGELKAEDVKPKPIGHWGTIVPQNFIYAHLNRAIKKYDLNMFYIEGSGHGGQVMVSNSYLDGSYTERYPEITQDEKGMAKLFKQFSFPGGVASHAAPETPGSIHEGGELGYSLSHGVGAILDNPDVIAAVEIGDGESETGPLATSWFSSKFINPIKDGAVIPILQINGFKISNPTIVSRMSDEDLTKYFEGMGWKPYFVSAYKDGEFNGYKDHMEVHHEMAKTMDEVVEEIKAIQKHARENNDDSLVKWPMIVFRVPKGWTGPKFDLDGNPIENSFRAHQIPIPVSQGDMSHKEMLTDWMESYKPEELFNEDGSPKEIVKENTLSGDQRMAMNPVTNGGINPKVLNMPDYRDFAVKFDKPGSVEKQDMAEWAKYLDKMAALNPTNFRGFGPDETKSNRLFQLLDNQKRQWMENIHTPNDENLAREGRVIDSQLSEHQDEGWLEGYVLTGRHGFFATYEAFGRVVDSMLTQHMKWLRKAKEQTWRHDYPALNLVDTSTVFQQDHNGYTHQDPGMLTHLYEKNRPDLIHEYLPADTNSLLAVSDKAFRDRECINVLVTSKQPRPQWFSIEEAKKLVDKGLGYIDWASTDKGAKPDVVFASTGTEPTIESLAAIDLLHKKFPDLKIRYINVIDVMKLMSPEKNPNAISNEEFDRLFPKDTPVIFAWHGFKPMMESIWFDRGRGKNDVHIHGYEENGDITTPFDMRVLNHMDRYDLAKDVVESVPELSEKNADFIDEMDSLLAKHHQYIRDNGKDMPEVTEWQWNGLK

SEQ ID NO: 476 - protein, 798 aa, Lactobacillus iners DSM 13335
MNYDSEEYLKSVDAYWRAANYLSVGQLFLMNNPLLKQDLVATDVKPKPIGHWGTIAPQNFIYAHLNRVIKKYNLNMFYIEGSGHGGQVMVSNSYLDGSYTETYPEITQDEKGMAKLFKQFSFPGGIASHAAPETPGSIHEGGELGYCLSHGVGAILDNPDVIAAVEIGDGESETGPLATSWFSDKFINPIHDGAVIPILQINGFKISNPTIVSRMSDAELTQYFEGMGWKPYFISAYNDGQFNGYKPHMQVHHEMAHVLDQVIEEIKAIQTHARETGDSSLPTWPMIIFRVPKGWTGPKFDLDGNPIENSFRAHQIPIPVSQKQMEHKDLLTDWLKSYHPEELFEDTGYPKPIVLQNTLTGVHRMAKNPITNGGLSPKSLNLPDFRKFAVKFDQPGSVEKQDMVEWAKYLDAIAKLNPDNFRGFGPDECKSNRLFDLLDNQKRQWMEKIHQPNDENLNNSGRIIDSQLSEHQAEGWLEGYVLTGRHGFFATYEAFGRVVDSMLTQHFKWLRKAKEQAWRRYYPALNFVDTSTVFQQDHNGYTHQDPGLLTHLFEKGHADLVHEYLPADANSLLAVSDKAFKDRECINILVTSKQPRPQWFSIDEAKRLVDHGLGYIDWASTDHNAKPDVVFASTGTEPTIETLAAIDILHKEFPELKIRYINVIDVMKLMPTSKNNAAISDQEFERLFPIGVPVIFAWHGFKPMMSSIWFERGRGKDDIHIHCYEENGDITTPFDMRVLNELDRFHLVKDAVMMTNLADTNAEFIEQIDRLLDKHHVYIRDYGEDMPEVVSWKWQGLK

SEQ ID NO: 477 - protein, 800 aa, Lactobacillus delbrueckii subsp. bulgaricus ATCC 11842
MTADYDSKEYLKSVDAWWRAANYLSVGQLFLLKNPLLKEELTADDVKIKPVGHWGTIAPQNFIYAHLNRVIKKYDLNMFYIEGSGHGGQVMVSNSYLDGSYSEIYPEISQDEAGMTKLFKRFSFPGGVASHAAPETPGSIHEGGELGYTLSHATGAILDNPDVIAAAEIGDGEAETGPLAAGWFSNRFIDPVKDGAVLPILQVNGFKISNPTITARMSDEELTKYFEGMGWKPYFVSTFKGGRFDGMKDIDQIHEEMAKTLDAIIEDIKAIQKNARENGDKSFAHWPLLIFQCPKGWTGPKTDLDGNPIENSFRAHQIPLPVDQKHMDHKELLLDWLKSYKPEELFDETGYPTDLVLQNAVHGDQRMAMNPVTNGGINPKRLNLPDWRDFAFEVGKPGSKDAQDMVEWAKYLTKVAELNPTTFRGFGPDESKSNRLFDFLDSEKRQWESEIHEPNDENLAAQGRLIDSQLSEHQDEGMLEGYVLTGRHGFFATYEAFGRVVDSMLTQHMKWLRKAKEQYWRRDYPSLNFVATSTVFQQDHNGYTHQDPGLLTHLFEKNRPDMIHEYLPADTNTLLAVADKAFRDREGINLLVTSKQERPQWFTPEEAAKLVDKGLGYIDWASTDKDAKPDVVFASTETEPTMETLAAIDILHQNFPDLKIRYINVVDVMKLMAPKDNPAAISQEEFDRLFPTDVPTIFAWHGYKTMMESIWFARKRYNVSIHCYEENGDITTAFDMRVLNHLDRFDLAKDAVEQIPALKDKSAAFIDKMDSLLSKHHAYIRDHGEDIPEVTSWKWTGLDK

SEQ ID NO: 478 - protein, 789 aa, Lactobacillus jensenii JV-V16
MAVNYDSQDYLRSVDAYWRAANYLSVGQLFLMKNPLLKTELKAEDVKPKPIGHWGTIVPQNFIYAHLNRAIKKYDLNMFYIEGSGHGGQVMVSNSYLDGSYTERYPEITQDEAGMTRLFKRFSFPGGVASHAAPETPGSIHEGGELGYSLSHGVGAILDNPDVIAAVEIGDGESETGPLAASWFSDKFINPIHDGAVLPILQINGFKISNPTIVSRMSDSELTQYFEGMGWKPYFVNVHGLSHMEAHELMAKELDKAIEDIKAIQKHARESGDDSMPQWPMLVLRAPKGWTGPKFDLDGNPIENSFRAHQIPIPVDQEHMEHKDMLIDWMKSYKPEELFNEDGSPKDIVLENTVQGDQRMAMNPVTNGGINPKRLHLPDWRNYAIDFDKPGSVEKQDMAEWSKYLNEIANLNPTNFRGFGPDESKSNRLFTILDGQKRQWMEDIEEPNDEDLARSGRMIDSQLSEHQAEGWLEGYVLTGRHGFFATYEAFGRVVDSMLTQHMKWLRKAKEQYWRHDYPALNIVDTSTVFQQDHNGYTHQDPGLLTHLFEKNRPDLIHEYLPADTNSLLAVSNKAFADRECINVLVTSKQPRPQWFSKEEAQRLVENGLSYIDWASTDEHAEPDVVFASTGTEPTLETLAAIDLLHKNFPELKIRYINVLDVMKMQSQRKNPNGLSDEEFDRLFTKDKPVIFAWHGFKPMMESIWFDRHNHNVSIHGYEENGDITTPFDMRVLNEIDRFHLAKDAVEHLDLPAAGFIDEMDRLLSKHHTYIRDNGKDIPEVTEWKWKGLN

SEQ ID NO: 479 - protein, 796 aa, Lactobacillus buchneri ATCC 11577
MTVDYDSKEYLDLLDKYWRAANYLSVGQLYLRDNPLLKRPLKSDDVKIKPIGHWGTIVSQNFIYAQLNRAINKYDLNMFYIEGSGHGGQVMVSNSYLDGSYSDIYPNISQDEKGMQKLFKQFSFPGGVASHAAPETPGSIHEGGELGYSLSHGTGAILDNPDVIAAVEIGDGESETGPLAASWFSDKFINPITDGAVLPIINMNGFKISNPTILSRMSDADLTDYFKGMGWEAHFVEATADTDHAKVEAEFAKTLDTVIEKIKSIQKNARENETPDNVKLPVWPMIIFRSPKGWTGPKKDLDGNPIEGSFRAHQVPIPVDANDMEHADELVDWLKSYKPEELFDENGTLKPELRALAPKGEQRMSVNPITNGGIKPEPLKLPNVRDFEVKFDKRGTEQKQDMIEWSKWLDAVAKLNPTTFRGFGPDETKSNRLYSLLDDGKRQWMEDIHEPYDEDLANHGRVIDSQLSEHQAEGWLEGYVLTGRHGFFATYESFGRVVDSMLTQHFKWLRKASEQYWRKQYPSLNFVDTSTVFQQDHNGYTHQDPGLLTHLAEKKPEFIREYLPADANELLAVGDSAFRTYEKINLIVTSKHPRRQWYSMDEAQNLVKNGLGYIDWASTDQGQEPDVVFAAAGSEPNLEALAAISILNKEFPELKIRFINVVDILKLNSPKKDPRGLSDEEFDNLFTTDKPVIFAWHGFEDMIKDIFFDRHNHNLYVHGYRENGDITTPFDMRVLNELDRFHLAADAIRHIPAYAVKGGYFIQRMNNIVDKHNRYIREVGTDLPEVTSWNWEPLNK

SEQ ID NO: 480 - protein, 802 aa, Oenococcus oeni ATCC BAA-1163
MINKENLRMTINYDSKDYLKYVDAYWRAANYLSVGQLFLRNNPLLKDELQSKDVKIKPIGHWGTVAPQNFIYAHLNRAILKYDLNMFYIEGSGHGGQVMVSNSYLDGSYTETYPKITQDIQGMQRLFKQFSFPGGIASHAAPETPGSIHEGGELGYSISHGVGAILDNPNVIAAVEIGDGESETGPLAASWFSDKFINPIHDGAVLPIVQINGFKISNPTILSRMSDRDLTNYYQGMGWEPLFVETDGSDNFKVHAEMADAVDKAIEKIKAIQKNARNNNDDSLPIWPMIVLRAPKGWTGPKKDLDGNPIENSFRAHQVPIPVDANHLEHKDMLIDWMKSYKPEELFNEDGSLKEIVKVNQPKGQRRMAMNPITNGGIKPRTLNMPGIERFAFPKNNLKNNKKPGMDLQVVSTFIAEIMKKNPINFRQFGPDETMSNRLWDEFKVTNRQWMQAVHEPNDQYMAHSGRILDAQLSEHQAEGWMEGYVLTGRHAFFASYEAFTRVIDSMLTQYYKWLRKAVEQDWRHDYPSLNVINASHAFQQDHNGYTHQDPGMLTHMAEKGHEFVNEFLPADANSLLAVMNKSLQVRNKINIIVASKHPRTQWFTIDEAKELVDNGLGIIPWASNDDGVEPDVVFAAGGTEATMESLAAISLLHESFPELKFRFINVIDLLKLRKKGDNDDYRGLSDLEFDHYFTREKPVVFSFHGFESLARDLFYDRHNHNVIFHGYRENGDITTPFDMRVLNHLDRFHLAKDAINATKYADVAGQFGQRMDDMLSKHTAYICDQGTDLPEVTSWQWQDIK

SEQ ID NO: 481 - protein, 788 aa, Lactobacillus plantarum WCFS1 [sequence omitted]

SEQ ID NO: 482 - protein, 788 aa, XPKA_LACPE
MSTDYSSPAYLQKVDKYWRAANYLSVGQLYLKDNPLLQRPLKASDVKVHPIGHWGTIAGQNFIYAHLNRVINKYGLKMFYVEGPGHGGQVMVSNSYLDGTYTDIYPEITQDVEGMQKLFKQFSFPGGVASHAAPETPGSIHEGGELGYSISHGVGAILDNPDEIAAVVVGDGESETGPLATSWQSTKFINPINDGAVLPILNLNGFKISNPTIFGRTSDEKIKQYFESMNWEPIFVEGDDPEKVHPALAKAMDEAVEKIKAIQKNARENDDATLPVWPMIVFRAPKGWTGPKSWDGDKIEGSFRAHQIPIPVDQTDMEHADALVDWLESYQPKELFNEDGSLKDDIKEIIPTGDARMAANPITNGGVDPKALNLPNFRDYAVDTSKHGANVKQDMIVWSDYLRDVIKKNPDNFRLFGPDETMSNRLYGVFETTNRQWMEDIHPDSDQYEAPAGRVLDAQLSEHQAEGWLEGYVLTGRHGLFASYEAFLRVVDSMLTQHFKWLRKANELDWRKKYPSLNIIAASTVFQQDHNGYTHQDPGALTHLAEKKPEYIREYLPADANSLLAVGDVIFRSQEKINYVVTSKHPRQQWFSIEEAKQLVDNGLGIIDWASTDQGSEPDIVFAAAGTEPTLETLAAIQLLHDSFPDMKIRFVNVVDILKLRSPEKDPRGLSDAEFDHYFTKDKPVVFAFHGYEDLVRDIFFDRHNHNLHVHGYRENGDITTPFDVRVMNQMDRFDLAKSAIAAQPAMENTGAAFVQDMDNMLAKHNAYIRDAGTDLPEVNDWQWKGLK

SEQ ID NO: 483 - protein, 787 aa, Lactobacillus sakei subsp. sakei 23K
MTDYSSKEYLAKVDAFWRAANYISVGQLYLKDNPLLQRPLEAKDVKVKPIGHWGTISGQNFLYAHLNRAINKYDLNMFYVEGPGHGGQVMVSNSYLDGSYTEIYPEISQDVDGMKKLFKQFSFPGGVASHAAPETPGSIHEGGELGYSLSHGVGAILDNPDVIAAVVVGDGEAETGPLAASWLSSTFINPKNDGAVLPILNLNGFKISNPTILSRKSDEELTKYFEGNGWAPIFVEGDDPEKMHPATAAAMDEAIEKIQAIQKAARENGDTSRPVWPMIVFRAPKGWTGPKTWDGVPIENSFRAHQIPVPIDSTDMQHADALVDWMKSYRPEELFTAEGQLKPEIAAMAPKGDKRMAANPITNGGIDPKPLRLPDYRDYAVDNTEHGKVVAQDMIVLGEYVRDIIKDNDQNKNFRIFGPDETMSNRLNHIFDVTNRQWMEPIKEPNDQFMATEGRVLDSQLSEHQAEGWLEGYVLTGRHGFFASYESFLRVVDSMLTQHFKWLRKADEQAWRNKYPSLNVIATSTVFQQDHNGYTHQDPGVLTHLAEKKPEFIREYLPADANTLLATMNTVFQSQEKINLVIASKHPRQQWFSIDEATVLVKNGLKIIDWASTDQDAEPDVVIAAAGTEPTLESLAAISILHKQYPDMKIRFINVVDLLKLRSPKVDPRGLTDEEFDMYFTKDKPVVFAFHGFEGLVRDIFFDRHNHNLHVHGYRENGDITTPFDMRVLNQMDRYNLSKEVAIDVLGDQAGQFAQSMDDMVAKHNQYIRDEGTDLPEVEEWQWTPLR

SEQ ID NO: 484 - protein, 787 aa, Pediococcus pentosaceus ATCC 25745
MTDYSSKEYFDKLEKFWRAANYLSVGQLYLKDNPLLKRDIKPEDVKVHPIGHWGTIPGQNYIYAHLNRVINKYGVNMFYVEGPGHGGQVMVSNSYLDGSYTEAYPAITQDEEGMKKLFKQFSWPGGVASHAAPVTPGSIHEGGELGYSLSHGVGAILDNPDQIAAVVVGDGEAETGPLAASWQHNRFINPITDGAVLPILDINGYKLSNPSLTSRMSDEELTEFFHGQHWDPYFVEGDDSEAMDPKMAEVMDKAIEKIQEIQKNARENHDETMPYWPVIVFRSPKGWTGPKTWDNKVIEGTFRAHQIPIPVDQKNLEHVDALIDWMKSYKPEELFDENGRVLPEIAEIAPKGEKRMASNPITNGGVNPTDLNLPDYRDYAVDTTKRGQNIKQDMLVWSDYLRDVITKNPTNFRMFGPDETMSNRLYGLFEVTNRQFVAPIKKDWDEALAPEGRILDAQLSEHSAEGWLETYTLTGRHGIFTSYEAFLRVVDSMITQHFKWLRKADELDWRNDYPSLNLVSTSTSFQQDHNGYTHQDPGLLTHLAEKKPEFIREYLPADANSLLAISPLVMNDRNKINLIIASKQPRPQFYSMEEAEVLAKNGLGIIDWASTTNGEEPDVVFAAAGTEPNMESLAAINILHDNFPDLKIRFINVVDLLKLQSPKVNPNGLSDEEFDRYFTKDKPVIFTFHGFEDLIRSIFFDRHNHNLHVHGYREEGDITTPFDMRVLNELDRFHLAQDTINSIPEFAEKGADFSQQMDNTLERHYQYIRDNGDDLPEVTNWTWKDVN

SEQ ID NO: 485 - protein, 795 aa, Lactobacillus rhamnosus GG
MSMDTKVKTVDYSSKEYFDKMTAYWRAANYVSVGQLYLKDNPLLERPLKSEDVKPHPIGHWGTIAGQNFIYTHLNRVINKYDLNMFYIEGPGHGGQVMVSNSYLDGSYSEIYPRVSQDKEGMKNLFTQFSWPGGVASHASAQTPGSIHEGGELGYALSHATGAILDNPDVIAAVVTGDGETETGPLAASWFSNTFINPISDGAILPIVHMNGFKISNPTILSRKSDEDLTKYFEGMGWKPYFVEGDDPTKLNPEMAKVMDAAIEEIKAIQKHARETGDTTMPHWPVIIFRSPKGWTGPKSWNGEPIEGSFRAHQIPIPVDAEDMEHADSLAGWLKSYHPEELFDENGKLIPELAALPPKGDKRMAANPITNGGLDPKPLVLPDYRKYALDNTEHGKQIKQDMIVWSDYLRDLIKLNPHNFRIFGPDETMSNRLYSLFEVTNRQWLEPIKEPADQYMAPAGRIIDSQLSEHQAEGFNEGYTLTGRHGLFTSYEAFLRVVDSMLTQHFKWIRKAHEEPWHKAYPSLNVVSTSTSFQQDHNGYTHQDPGILTHMAEKKAEYIREYLPADANSLLAISPKLFSSQNTVNVLITSKQPRPQFYSIDEATVLANAGLKRIDWASNDDGVEPDVVIAAAGTEPNMESLAAINLLHDAFPDLKIRFINVLDLLKLRSPEIDPRGLSDAEFNSYFTTDKPVLFAYHGFEGLIRDIFFTRQNRNVLIHGYREEGDITTPFDMRVLNELDRFHLAKDIIQHVPAYAEKAAAFVQKMDDTLQYHHDFIRANGEDIPEVQEWTWKSIK

SEQ ID NO: 486 - protein, 803 aa, Lactobacillus brevis subsp. gravesensis ATCC 27305
MANSTDSNQALKERETDYSSKDYFNLMTKYWRAANYISVGQLYLKDNPLLKRPLTKADVKFHPIGHWGTIAGQNFIYTHLNRVIKKYGLDMFYIEGSGHGGQVMVSNSYLDGSYTDIYPNITQDEKGLQRLFKRFSFPGGVASHADAKTPGSIHEGGELGYSLSHGVGAIFDNPNVIAAVEIGDGEAETGPLATSWFSNVFINPVNDGAVLPILNLNGFKIANPTILSRKSDEELTKYFEGMGWEPTFVEGDDAGKLNPVMAKAMDSSIEKIHAIQNQARESSADDATRPVWPMIILRAPKGWTGPKMWDGKPIEGSFRAHQIPIPVDSEHMEHADALVEWLKSYKPEELFDKNGALKPEIKATVPVGHSRMAANPITNGGKDQKQLDLPDWRNYALDNSKRGAGEERQDMVELGKFFRDVIKNNPKNFRLFGPDETASNQLQEAFAVTNRQWMEPIHNPYDQWMKADGRIIDSQLSEHQDEGWLEGYTLTGRHGVFTSYEAFLRVVDSMLTQYFKWIREANEQPWRQKYPSLNIISSSTSFQQDHNGYSHQDPGILTHLAEKKPRYIREFLPADANSLLAVMHKALNMKQTLNVTIASKHPRPQFYSVQEAEQLVDQGLKVIDWASTTKPGEEPDIVMAAAGTEPNLESLAAIDILHQQFPDLKIRFINVVDLLKLHSPQFDPRGLSDEEFDNYFTKDKPIVFAFHGYEDLIESLFFNRHNHNLHVHGYREDGDITTPFDMRVLNHLDRFHLAKEVAEDVYGDKSSEFTSHMDDKLQQHHDYIRETGADLPEIRNWEWKSLK

SEQ ID NO: 487 - protein, 786 aa, Lactobacillus salivarius ATCC 11741
MTDYSSQEYLDKLDAYWRAANYVSVGQLYLKDNPLLRRPLKAEDVKVKPIGHWGTIAGQNFIYAHLNRVINKYDLNMFYVEGPGHGGQVMVSNSYLDGSYSEIYPEISQDEQGMKRLFKRFSFPGGVASHAAPETPGSIHEGGELGYSISHSVGAVLDNPDLIVAAVVGDGEAETGPLAASWQSNKFINPIHDGAVLPILDLNGFKISNPTILSRESDETLTKYFEGMGWHPIFVEGDDPKLMHPAMAKAMDEAIEEIKAIQKNARENNDPSLPAWPVIIFRAPKGWTGPKEWDGEPIEKSFRAHQIPIPVDQNDMQHADALVDWLESYKPEELFDENGKLKAEIAEITPKGDKRMAANPHTNPGKLIREVIKPDFRDFAVDTSVPGKEVAQDMTVLGKYLEKVLSDNRHNYRVFGPDETMSNRLAPIFDVTKRQWLAEIKEPNDQYLAPSGQVIDSQLSEHQAEGFLEGYVLTGRHGFFASYESFLRVVDSMLTQHFKWLRKATEQPWRTSIPSLNVIATSTVFQQDHNGYTHQDPGILGHLADKKPEYIREYLPADANSLLAVFDKTINDRDKINLIVASKHPRQQFYSAAEAKELVDKGLKIIDWASTDKNAEPDVVIAAAGTEPNLEALAAISILHEKLPDLKIRFINVVDILKLRSPKVDPRGLSDDEFDAYFTKDKPVIFAFHGYEGLLRDIFYYRHNHNVAFHGYRENGDITTPFDMRVLSQMDRFDLVKSVALSLPDADKYGQLVAEMDAKVAKHHQYIRDEGTDLPEVENWEWKPLD

SEQ ID NO: 488 - protein, 789 aa, Lactobacillus ruminis ATCC 25644
MAKDYSSKEYFAKLDAYWRAANYISVGQLYLKDNPLLRRPLESSDVKAKPIGHWGTIAGQNFIYAHLNRVINKYDLNMLYIEGPGHGGQVMVSNSYLDGSYTEIYPEITEDEEGMKKLFKRFSFPGGVASHAAPETPGSIHEGGELGYSLSHATGAILDNPDLIAAAVVGDGEAETGPLATSWQSNKFINPIHDGAVLPILDLNGFKISNPTILSRESNETLTKYFEGLGWHPIIVEGEDPEKLHPELARAMDEAIEEIKAIQKHARETGDDSLPTWPMIIFRAPKGWTGPKEWDGKPIEGSFRAHQIPIPVDQNDMEHADKLVAWLKSYRPEELFDESGKLKPEFAEIAPKGDKRMAANPHTNPGNLIRDLILPDFREFALENAEHGKTVAQDMTVLGKYLERVIELNAKNRNFRIFGPDETMSNRLAPIFDETKRQWMQDIKEPNDEFLAHSGRIIDSQLSEHQDEGFLEGYVLTGRHGFFASYEAFLRVVDSMLTQHFKWLRKAKEQPWRSEIPSLNVVSTSTVFQQDHNGYTHQDPGILGHLADKKPEFIREYLPADANTLLAVFDKVLNDREKINLIVSSKHPRPQFYTAAEAKELVDKGLKIIDWASTDHNAEPDVVIAACGTEPNLESLAAVSILHEKLPDLKIRFINIVDLLKLRSPKHDPRGLSDEEFDAFFTKDKPILFAFHGYEGLVRDLFFDRHNHNVMIHGYRENGDITTPFDMRVLNQMDRFDLVKDVVLNLPDADKYGQIAAEMDSIIAKHNQYIRDEGADLPEVENWTWKPLE

SEQ ID NO: 489 - protein, 794 aa, Bacillus coagulans 36D1
MEMAASQVAYSSPAYLKNLDVYWRAANYISVGQLYLKDNPLLKEPVKPSDLKAKPIGHWGTISGQNFIYAHLNRVINKYDLNMFYIEGPGHGGQVMVSNSYLDGSYTEIYPNVTQDIEGMKRLFKQFSFPGGIASHAAPETPGSIHEGGELGYSLSHGTGAILDQPDLMAAVVVGDGEAETGPLATSWLSNRFINPVTDGAVLPILLLNGFKISNPTMLSRMSDEQLALYFEGIGWRPYFVEGEDPEEMHRDMAYVMDQMIEQIQAIQSHARKTGDTTRPAWPMLVFRAPKGWTGPKEWDEKPVEHSFRAHQIPVPVDQDHMEHLDVLINWMKSYRPEELFNENGRLRPEIAKIAPKGSKRMAMNPATNAGFHIKDLDLPDFRDYALDNKEHGKQMAQDMTVLGTYLKDVILKNEAKRNFRIFGPDETMSNRLAPVFEATKRQWVGKIKEPNDEFLAPDGRVIDSQLSEHQAEGFLEGYVLTGRHGFFASYEAFLRVVDSMITQHFKWLRKAAEQKWRADIPSLNVVATSTVFQQDHNGYTHQDPGILGHLADKKPEFIREYLPADANTLLAVFDKILNDRGKINLIVSSKHPRPQWFTVEEAEELADRGLKIIDWASTDEGGNPDIVIAACGTEPLLESLAAVSILHEKLPKLKIRMINVLDILKLRSPALDPRGLSDEAFDAYFTKDKPVVFAFHGYEGLIKDLFFDRANHNLHVHGYRENGDITTPFDMRVMNQMDRFDLVKEVVSSLPDTARHAALISEMDSMLQKHHAYIREEGTDLPEIENWQWQAIK

SEQ ID NO: 490 - protein, 791 aa, Kingella oralis ATCC 51147
MQNTQFDTPEYLAKVDAWWRAANYISAAQMYLKDNPLLKKPLTANDVKAHPIGHWGTVPGQNFIYAHLNRAINKYDVDMFYIEGPGHGGQVMVSNSYLDHSYTDIYPEITQDEAGLKKLCKIFSFPGGIASHAAPETPGSIHEGGELGYALSHAFGAVLDNPNIIAAAVIGDGEAETGPLCAGWFGNTFINPVNDGAVLPILYLNGGKIHNPTILARKTDAELTQYFNGMGWEPIFVEVSDPAHSHAIMAQKLDEAVERILAIWQDARSRSANDATMPRWPVLVARIPKGWTGPKTWNGEPIEGGFRAHQVPIPTNSHDMSTADALEAWLRSYRPEELFDDNGRFLDKWREISPKGAKRMSVHPITNGGVAPKALVMPDWTKHALKIGTPGSQDAQDMIECGRLMADVITANPDNFRIFGPDETKSNRLNEVFKVTNRQWLGVRDAAYDEWIAPVGRVIDSQLSEHQAEGFLEGYVLTGRHGFFASYESFLRVVDSMITQHFKWLRKCKTHAPWRKDYPSLNLIATSTVFQQDHNGYTHQDPGLLTHLAEKKPEFVREYLPADANTLLAVMSEALTSRDRINLIVSSKHLRPQFYSADEAKELVREGYKIIEWASTCHDGEPDVVIAAAGTEPNMEALAAINVLHKHYPEMKIRFINVVDILKLRHPSIDPRGLSDEAFDALFTRDKPVVFCFHGYENMVRDIFFPRHNRNVRIHGYRENGDITTPFDMRVLSEMDRFHVAKDAAQAVYGEKAADFANKMDETIQFHRSYIREHGKDIPEVAEWKWQPLAK

SEQ ID NO: 491 - protein, 789 aa, Granulicatella adiacens ATCC 49175
MTQFDTPEYLAKVDAWWRAANYISVAQMYLKDNPLLRRPIQKEDVKLHPIGHWGTIAGQNFIYAHLNRAINKYDLDMFYIEGPGHGGQVMVSNSYLDGSYTELYPQITQDEAGFKQLCKIFSFPGGIASHAAPETPGSIHEGGELGYSLSHATGAVLDNPNVIAAAVIGDGEAETGPLAAGWFSNTFINPVNDGAVLPILYLNGGKIHNPTILARRTDEELTQFFNGLGWDPIFVEGTDPEKVHPLMAAKLDEAIEKIQAIQKEARAKSAEEATMPHWPVLVVRTPKGWTGPKEWNHEPIEGGFRAHQVPIPVSGEAMEHVDALVDWLKSYRPEELFDENGKLVEEIAAISPKGPRRMSMNPITNAGVVKPMEITDWTKHAIDTSKPGAIQKQDMIEFGKFAADLVKANPDNFRIFGPDETKSNRLNEVFKATNRQWVGRRDESYDEWISPVGRVIDSQLSEHQAEGFLEGYVLTGRHGFFASYESFLRVVDSMITQHFKWLRKAKTHAPWRKNYPSLNLIATSTVFQQDHNGYTHQDPGLLTHLAEKKPEFVREYLPADTNSLMAVMAEALSSEDKINLIVSSKHPRPQFYSVEEAKELVSEGYKVIDWASTVKEGEEPDVVIAAAGTEPNLEALAGISILHKQFPELKIRFINVVDILKLRSPKVDPRGLSDEEFDKLFTTDKPVVFCFHGYEGMIRDLFFDRNNHNVHIHGYRENGDITTPFDMRVLSEMDRFHVAKDAAVAVYGEKASEFAAKMDETVEFHHSYIREHGEDIPEVVSWQWENVNK

SEQ ID NO: 492 - protein, 794 aa, Streptococcus gordonii str. Challis substr. CH1
MTTDYNSKAYLEKVDAWWRAANYISAAQMYLKDNPLLKRDVVANDLKAHPIGHWGTVPGQNFIYAHLNRTINKYDLDMFYIEGPGHGGQVMVSNSYLDGSYTELNPNIPQNEEGFKHLCKIFSFPGGIASHAAPETPGSIHEGGELGYALSHAAGAILDNPDVIAATVIGDGEGETGPLMAGWLSNTFINPVNDGAILPIFYLNGGKIHNPTIFERKTDEELTLFFEGLGWKPIFADVTAISENHEAAHALFAAKLDEAIEEIKKVQAEARKGSAEEATQAIFPVLVARIPKGWTGPKSWEGTPIEGGFRAHQVPIPVDAHHMEHVDALLNWLKSYRPEELFDESGKVLPEIAAIGPKGDRRMAMNPITNAGVIKPMDTADWKKHALKFGTPGEIVAQDMIEFGKYATDLVDANPDNFRIFGPDETKSNRLQEVFTRTSRQWLGRMRPEYDEALSPAGRVIDSQLSEHQAEGMLEGYVLTGRHGFFASYESFLRVVDSMVTQHFKWLRKCKTHTTWRKNYPALNLIATSTVFQQDHNGYTHQDPGILTHLAEKTPEFIREYLPADTNSLLAVMDKAFKAEDKVNLIVTSKHPRPQFYSAEEAEELVREGYKVIDWASTVSNNEEPDVVFAAAGTEPNLEALAAVSILHKAFPELKIRFVNVVDILKLRHPSVDARGLSDEEFDQVFTTDKPVIFAFHGYEGMIRDIFFNRHNHNLRVHGYRENGDITTPFDMRVMSELDRFHLAQDAANAALGEDAAVFSAKMDETVAYHNAYIRENGDDIPEVQNWKWENINK

SEQ ID NO: 493 - protein, 792 aa, Streptococcus agalactiae NEM316
MSEFDTKSYLEKLDAWWRAANYISAAQMYLKDNPLLRRELVENDLKVHPIGHWGTVPGQNFIYAHLNRAINKYDLDMFYIEGPGHGGQVMVSNSYLDGSYTELNPNIEQTEDGFKQLCKIFSFPGGIASHAAPETPGSIHEGGELGYALSHATGAILDNPDVIAATVIGDGEGETGPLMAGWLSNTFINPVNDGAVLPIFYLNGGKIHNPTIFERKTDEELSQFFEGLGWKPIFADVVELSEDHAAAHALFAEKLDQAIQEIKTIQSEARQKPAEEAIQAKFPVLVARIPKGWTGPKAWEGTPIEGGFRAHQVPIPVDAHHMEHVDSLLSWLQSYRPEELFDESGKIVDEIAAISPKGDRRMSMNPITNAGIVKAMDTADWKKFALDINVPGQIMAQDMIEFGKYAADLVDANPDNFRIFGPDETKSNRLQEVFTRTSRQWLGRRKPDYDEALSPAGRVIDSQLSEHQAEGFLEGYVLTGRHGFFASYESFLRVVDSMVTQHFKWLRKSKTHTTWRKNYPALNLIAASTVFQQDHNGYTHQDPGILTHLAEKTPEYIREYLPADTNSLLAVMDKAFKAEDKINLIVTSKHPRPQFYSIAEAEELVAEGYKVIDWASNVSLNQEPDVVFAAAGTEPNLEALAAISILHKAFPELKIRFVNVLDILKLRHPSQDARGLSDEEFDKVFTTDKPVIFAFHSYEDMIRDIFFSRHNHNLHTHGYRENGDITTPFDMRVMSELDRFHLAQDAALASLGNEAQAFSDEMNQMVAYHKDYIREHGDDIPEVQNWKWENIK

SEQ ID NO: 494 - protein, 791 aa, Listeria grayi DSM 20601
MTDYSSPNYLAKVDAWWRAADFISVGQLYLKGNPLLRRPLEKEDLKVHPIGHWGTISGQNFIYAHLNRVINKYDLNMFYIEGPGHGGQVMVSNSYLDGSYTDTYPTITQDEVGLTKLYKQFSFPGGIASHAAPETPGSLHEGGELGYALSHATGSILDNPDVIAATVIGDGEAETGPLSAGWFSNTFINPVNDGAVLPILYLNGAKISNPTILSRKTDKELTSFFQGLGWDPIFVEGEDPAKVHPLMAEKLDQAIEKIKAIQTEARKEAADKATMPTWPVILFRTPKGWTGPKEWNNEPIEGSFRAHQVPIPVDQHHFDHVDALENWLQSYRPEELFTEEGSLKEEIKSLAPKNRMATNPITNGGIDPQPLRLPSWKDYAVETANKDVITQDMIELGGFVRDIVKENPDNFRIFGPDETKSNRLNKVFEVTNRQWMSKAEFPRDEWLAPAGRIIDGQLSEHQAEGFLEGYVLTGRHGFFASYESFLRVVDSMLTQHFKWLRKAKEQTWRNSYPSLNVIATSTVFQQDHNGYTHQDPGVLTHLAEKKPEFIREYLPADTNSLLAVMNEAFRSEELINLIVSSKHPRPQFYSAEEAEILVKDGLKIIDWASTVSEAEEPDVVIASAGTEPNLEALAAVTLLNEAFPSLKIRFINIVDILKLRHPDIDPRGLTDEEFDRYFTTDKPIIFAFHSYEGMVRDIFFNRHNHNLFIHGYRENGDITTPFDMRVLSEMDRFHLAKDAAEAVYGEIATSFAAEMDAVLSKHHHFIRENGEDLPEVENWKWQALKTDLLEV

SEQ ID NO: 495 - protein, 788 aa, Enterococcus casseliflavus EC30
MKTTYDTPEYYQKMNAWWRAANYLSVGQIYLKDNPLLRRPIEEKDLKVNPIGHWGTIAGQNFIYTHLNRVINKYDLNMFYIEGPGHGGQVMVANAYLDGSYSEIYPKATQDEAGMKHLFKTFSFPGGIASHAAPETPGSIHEGGELGYSIAHATGAILDNPDVIAAVVVGDGEAETGPLAGSWFSNTFINPVNDGAILPILHLNGAKIANPTILARKSDQDLTKYFEGMGWTPYFVEGDDPEAVHPQLAQKMDQAIEQIHAIQAEARKGSAEEAAMPHWPVLIVRTPKGWTGPKVWDGEPIEGGFRAHQVPIPVNAKHMEHVDALTDWLQSYRPEELFDENGRIKAEIQELAPKGEQRMAVNPITNGGIDPQPLRLPDWQAHAIAIETPGETTAQDMMVFGKFARDIIKENPDNFRIFGPDEAKSNRLNHVFEVTDRQWLEPKHPDYDEWLSSVGRVIDSQLSEHQAEGFLEGYVLTGRHGFFASYESFLRVVDSMITQHFKWLRKAHDLDWRNPYPSLNLIASSTVFQQDHNGYTHQDPGIMTHIAEKKADFVRVYLPADANSLMAVMAETLASEEKINLVVSSKHPRPQFYSADEAKVLVKDGLKVIDWASTDEGQEPDIVIAAAGTEPNLEALAAVSLLIEAFPELKVRFINVVDLLKLRRPEVDPRGLSDEAFEAYFTKDKPIVFAFHGYEGLIRDIFFGRRNQQLHIHGYRENGDITTPFDMRILSELDRFHLAKDAAEWVYGEKATDFAQKMADTVAYHHDFIRENGYDIAEVEEWEWKPLR

SEQ ID NO: 496 - protein, 787 aa, Enterococcus gallinarum EG2
METTFDTQEYFDKMNAWWRAANYLSVGQIYLKDNPLLRRPIEEKDLKVNPIGHWGTIAGQNFIYTHLNRVINKYDLNMFYIEGPGHGGQVMVSNAYLDGSYTEIYPEVTQDEAGMQHLFKIFSFPGGIASHAAPETPGSIHEGGELGYSIAHGTGAVLDNPDVIAAVVVGDGEAETGPLAGSWFSNTFINPVNDGAVLPILHLNGAKISNPTILARKSDEDLTKYFEGMGWTPYFVEGDDPATVHPQMARALDRAVEQIKAIQTKARQGKADEAVMPHWPVLIVRTPKGWTGPKIWEGEPIEGGFRAHQVPIPVNAHQMEHVDALIDWLKSYKPEELFDESGRIKAEIQELAPKGQQRMAMNPITNGGIDPQPLKITDWRQHAIDIGVPGSTTAQDMMEFGKFARDLIVENPTNFRIFGPDEAKSNRLNHVFEVTNRQWLEPKQPNYDEWLSATGRVIDSQLSEHQAEGFLEGYVLTGRHGFFASYESFLRVVDSMITQHFKWTRKSKELPWRHAYPSLNLIASSTVFQQDHNGYTHQDPGIMTHIAEKKAEFVRVYLPADANSLMAVMAETFQTEEQINLIVSSKHPRPQFYTAEEAEILVKDGLKIIDWASTDQGEPDLVIAAAGTEPNLEALAAVSLLNEAFPELKIRFINVVDLLKIRHPDVDPRGLTDEEFEAYFTKDKPIIFAFHGYEGLIRDIFFGRKNQRLHIHGYRENGDITTPFDMRILSELDRFHLAKDGAEWVYGEQAADFAQRMTETVAYHYDFIRENGYDIAEVQDWQWKPLK

SEQ ID NO: 497 - protein, 790 aa, Enterococcus faecium Com12
MLRMDYSSKEYFDKMTAWWRAANYLSVGQIYLKDNPLLRRTLKPEDVKKHPIGHWGTIPGQNFIYVHLNRVINKYDLNMFYIEGPGHGGQVMVSNAYLDGSYTEIYPEVTEDETGMQKLFKRFSFPGGIASHAAPETPGSIHEGGELGYSLSHGVGAVLDNPEVISAVVIGDGEAETGPLAGSWFSNVFINPVTDGAVLPILHLNGAKIANPTILARKSDGELANYFNGLGWEPFFIEGNDPEKLNPVMAEKMDQAIEKIKSIQKEARLKTAADAMMPKWPVLIVRTPKGWTGPEEWDGEPIEGTFRAHQVPIPVDQEHMDHADALLRWLKSYEPEKLFDAQGRILEEIREIAPTGDHRMAKNPITNGGMDPKPLIMPDWKRYTLQFEKPGSVTAEDMTELGKFVREIIEKNPENFRIFGPDETKSNRLNQVFKTTNRQWMEKIEPENDEWLSPSGRVIDSQLSEHQDEGFLEGYVLTGRHGFFASYESFLRVVDSMLTQHFKWMRKSRDLSWRNNYPSLNLIASSTVFQQDHNGYSHQDPGILTHLAEKKAEFIREYLPADANTLLAVMDKAFRSSEKINLIISSKHPRAQFYSAEEAAVLVNEGLKIIDWASTAKEEEPELVIAAAGTESNLEALAAVTLLLEEFPKLKIRFINVVDLLKLRHPSQDPRGLSDEEFDKYFTKDKPILFAFHGYETLIRTIFFDRHNHHLMIHGYKENGDITTPFDMRVVNELDRYHLAKDAALKIKGSQAEDFAKKMDQKLQEHQNYIRENGIDLPEVLDWKWKNLDQ

SEQ ID NO: 498 - protein, 792 aa, Mycoplasma fermentans PG18
MNKKEFDSKEYLEKVDAWWRAANYLSVGQIYLRNNPLLKHPLTSDDVKVYPIGHWGTISGQNFAYAHLNRVINKYDLNMFYIEGPGHGGQVMTSNSYLDGSYTELFPHVTQDEAGMQHLFKYFSFPGGTASHAAPETPGSIHEGGELGYSISHATGAILDNPDVIAATIVGDGEAETGPLATSWFSNSFINPVNDGAVLPILHLNGGKISNPTILSRKSNEELQQYFRGMGWEPHFVEGDKPEVMHELMAKTLDSVIEEIQSIQTKARKKPADKAKRPVWPMIVLRTPKGWTGPKSWNKEAIEGSFRAHQVPLPINAENMEHADALEKWLRSYRPEELFDKKGKLVKEIAAIAPKGKRRMGMNPITNGGINPKVMKLGDWRKFALHFDRPGSVVAQDMVELGTYFADLVKRNPENFRIFGPDETKSNRLYNLFKVTNRQWMERIDSKLDEALSPVGRIIDSQLSEHQAQGFLEGYVLTGRHGIFASYESFLRVVDSMVTQHMKWLRKAKEINWRKDYPSLNIMATSTAFQQDHNGYTHQDPGIIGHMADKRPELIREYLPADTNTLLAVMDKAFTERNVINLIVSSKQPRHQFYSVEEAETLVEKGLDIIDWASTCSRNETPDLVVVASGTEPNLEALATISILNKEYPSMKIRFVNVVDLLKLRHPKIDPRGLSDEEFDEIFTKDKPVLFAFHGFEGILRDIFFDRHNHNLIAHGYRENGDITTSFDIRQLSHMDRFHMASDAAAAVFGSSKAKEFMDKMEETIQFHNKYIREVGTDIPEVKNWKWEGLIK

SEQ ID NO: 499 - protein, 793 aa, Mycoplasma arthritidis 158L3-1
MKKTNYDSNEYFNLIDKWFRAANYLSVGQIYLRNNPLLKTKLVADDVKIYPIGHWGTIPGQNFIYAHLNRVINKYDLEMFYIEGPGHGGQVMISNSYLDGSYTEIYPEITEDEAGLKTMFKRFSFPGGTASHAAPETPGSIHEGGELGYALSHATGAILDNPNVIAATVIGDGEAETGPLAAGWFSNSFINPVNDGAVLPIIHLNGAKISNPTILSRKSNQELENYFSGLGWEPLFVEGDDPKLMHPLMAKKLDEAIEKIQMIQASARKHKASEATRPVWPMLIVRTPKGWTGPKDWNGEVVEGSFRAHQVPIPVNALNMTHIDKLEAWLTSYHPEELFDKNGKILEEIRALAPKGLKRMAVHPITNGGINPRTLKLSSWEKFATKFETPGQIKGQDMIELGKYFAEIITLNKDNFRIFGPDETKSNRMNAVFNVTKRQWLEKIAPTYDEWMSPEGRVIDSQLSEHQAEGFLEGYVITGRHGVFASYEAFLRVVDSMLTQHMKWMKKSLELPWRKDFPSLNVIATSTAFQQDHNGYTHQDPGLLGHLADKRPELIREYLPADTNCLLATMEKALKDRNVINLIVASKQPREQFYSVEEASELVQKGYKIINWASNVSKNEEPDVVFAAAGVEPNLEALAAISILNKEFPNLKIRFVNVLDLLKLKSPKHDPRGISDEEFDQIFTKNKPIIFAFHGYEGLLRDIFFDRHNHNLITHGYRENGDITTSFDIRQLSHMDRFHIAKDAAIAALGKDGEMFAKKMDSKLQEHTSYVREYGYDLPEVVNWKWTNLKPIK

SEQ ID NO: 500 - protein, 795 aa, Mycoplasma agalactiae PG2
MKKSHDFDSKEYLNLVDAWWRAANYLSVGQMYLRNNPLLKIPLTSNDVKIYPIGHWGTVPGQNFIYAHLNRIINKYDLNMFFISGPGHGGQVIASNTYLDGSYTELFPHVTKDIKGMTHLFKYFSFPGGTASHAAPECPGSIHEGGELGYSLSHAAGAVLDNPDVIAATVIGDGESETGPLSAGWFINSFINPANDGAVLPILHVNGGKISNPTIWSRRSNEELVSYFTGAGWKPFIVEGNEPEYMHHEMAKALDASVELIKQYQAEARKNGANKAKRPQWPMIVLKSPKGWTGPKEWNHEAIEGSFRAHQVPVPVSAEKMQHIDALENWLRSYRPEELFDENAQLKPEIAAIAPKGDRRMGKNPIANGGINPRAINVGDWTKFALDIKQPGKVINQDMVTLGSYLGELSLLNKDNFRVWGPDEHKSNRLYEMFKVTDRQWLDRIDEKYDEFLSSVGRIIDSQLSEHQAEGMLEGYVLTGRHGVFASYESFLRVVDSMLTQHMKWVKKALDIPWRNDYPSLNVIATSNAFQQDHNGYTHQDPGLIGHLADKRPELIREYLPADTNTLLATMAKALQDRNVINLIISSKQPRHQFFSIEEATELVEKGIKIIDWASNIKPNEEPDLVVAASGTESTIESLATITYLRAHFPELKIRFVNVLDLLKLRHPSIDPRGLSDSEFDSIFTKDKPILFAFHGYEAILRDIFFLRSNHNIITHGYRENGDITTAFDIRLLSEMDRFHMTANVAKKLAPVVGESKANELVKLMEDKIKEHRAYIKEYGTDLPEVKEWEWTPYK

SEQ ID NO: 501 - protein, 795 aa, Lactobacillus casei BL23
MDQTIEKTIDYSSKEYLNEVDKYWRAANYLSVGQLYLKDNPLLKRPLKATDVKVHPIGHWGTIAGQNFIYAHLNRVINKYNLNMFYIEGPGHGGQVMVSNSYLDGSYTELYPKISQDEQGLQRLFKQFSFPGGVASHADPKTPGSIHEGGELGYSILHGAGAVLDNPDLIAAVVVGDGESETGPLATSWQVNKFLNPITDGTVLPILNLNGFKIANPTVLARESHEELVDYFKGLGWDPHFVEGSDPDKMHPQMAAEMDKIVEEIESIRKNAKDNNDESRPVWPMLVLRAPKGWTGPKTWDGEPIEGSFRAHQIPIPVDQKDMEHADDLVAWLESYKPKELFNDDGTLKADIEAIIPKGSLRMAMNPVTNGGILAKHLEKPNPSDYAVDNKDHGANEAQDMTVLGAYIRDLIKLNDKNRNFRGFGPDETLSNRLNKVFEATNRQWMEPIHKPYDALLASHGRIIDSMLSEHMDEGMLEGYTLTGRYGFFASYESFLRVVDSMLTQHFKWLRNAHEEADWRADVPALNVIASSTAFQQDHNGYSHQDPGVISHLAEKKTKYIRAYLPADANTLVRVFDKSVDAKQVINLIVSSKHPRPQWFTDSEAKSLVEKGLGIIDWASTDQGAEPDLVIAAAGSEPTLESLAAISILHKALPSLRIRFINVVDLLKLKKDDPRGLSDEEFDMYFTKDKPVIFAYHGYDDLIKDIFFDRHNHNVRVHGYREEGDITTPFDMRVRNKLDRFNLVKEAVLDVPEFTEKGAHLIQDMDDELQKHHDFIREEGTDLPEVEEWKWEPLK

SEQ ID NO: 502 - protein, 803 aa, Lactobacillus plantarum WCFS1
MQRSCKIMSEAIKSKTVDYSSDEYLKRVDEYWRAANYISVGQLYLLNNPLLREPLKATDVKVHPIGHWGTIAGQNFIYAHLNRAINKYGLNMFYIEGPGHGGQVMVSNSYLDGTYTETYPKITQDKAGMKRLFKQFSFPGGVASHADPKTPGSIHEGGELGYSILHGAGAVLDNPGLIAATVVGDGESETGPLATSWQVNKFLNPITDGTVLPILNLNGFKISNPTVLSRESHEELEDYFKGLGWDPHFVEGTDPAKMHKIMAEELDKVIEEIHAIRKNAKDNNDESRPKWPMIVFRAPKGWTGPKSWDGEPIEGSFRAHQIPIPVDRNHMEHADKLVDWLKSYKPEELFDENGTLKPEIAAIIPEGQARMAANPVTNGGKLTKDLITPNIDDYALDNKSHGKEDGSDMTELGKYIRDLIELNKDNKNFRGWGPDETLSNKLGAAFEDTKRQWMEPIHEPNDALLAPQGRIIDSMLSEHMDEGMLEAYNLTGRYGFFASYESFLRVVDSMLTQHFKWLRNSHEETPWRADVPSLNVIASSTAFQQDHNGYSHQDPGIISHLAEKKTEYVRAYLPGDANTLIATFDKAIQSKQLINLIIASKHPRPQWFTMDEAKRLVRDGLGVVDWASTDHGEEPDVVFATAGSEPTTESLAAVSILHARFPEMKIRFINVVDLLKLKKDDPRGLSDAEFDAFFTKDKPVIFAYHAYDDLVKTIFFDRHNHNLHVHGYREEGDITTPFDMRVRNELDRFHLVKAALLATPAYAEKGAHVIQEMNSILDKHHDYIRAEGTDIPEVENWKWTALK

SEQ ID NO: 503 - protein, 809 aa, Lactobacillus salivarius ATCC 11741
MKTLLYNCKYFAKKRQGDANIMTINYSSKEYLELVDRYWRAADYVSVGQLYLKDNPLLDRPLVPTDVKVHPIGHWGTISGQNFIYAHLNRVINKYDLDMFYIEGPGHGGQVMVSNSYLDGSYTETYPEITQDKAGMQKLFKRFSFPGGVASHADPKTPGSIHEGGELGYSLLHGAGAILDNPNLIAATVIGDGEAETGPLATSWQVNKFINPINDGTVLPILDLNGFKISNPTVLSRMSHEELTSYFKGLGWNPHFVEGTDPKELHVKMADELDSIIEEIMAIRENAVKNNDESRPAWPMLVFRAPKGWGGPKEWDGDMIEGSFRAHQIPIPVDQNHTEHLDSLVSWLKSYKPEELFDEKGVLLDDIKAIIPDKDHRMASNPVTNGGKLSKPLILPDPADFEFKTDHGTEDGSDMTELGKYIKAVFELNKDNKNFRGWGPDESLSNKLSAVFEETNRQWLEPIHDGSDALLAPHGRMIDSMLSEHMDEGMLEAYTLTGRHGFFASYESFLRVVDSMLTQHFKWLRNSHEETPWREDVPSLNIISTSTAFQQDHNGYSHQDPGIVTHLAEKKTKYIREYFPADANTLIAAFDKSLQTKQVINLIVASKHPRLQWYSAAEAKELVNNGLKIIDWASNVPEGEEPDVVFASAGSEPNLESLAAISILRKQAPSLKIRYVNVVDLLKLKKDDPRGLSDAEFDAYFTKDKPVIFAFHGYVDILKDIFFDRHNHNLHLHGYKEEGDITTPFDMRVRNELDRFHLVKDALEVVPGVSEKYATVLQDMDLLLQKHHDYIRSEGDDIEEVRTWKWDLD

SEQ ID NO: 504 - protein, 788 aa, Leuconostoc mesenteroides subsp. mesenteroides ATCC 8293
MNIDSTDYLNNLDAYWRATNYLSVGQLYLLDNPLLKEKLTAEQVKIHPIGHWGTIPSQNFIYAHLNRAINKFNLNMFYIEGPGHGGQVMISNAYLDGSYTEAFPEITQDEAGMQKMFKRFSFPGGVASHADPKVPGSIHEGGALGYSILHGAGAVLDNPDLIAAVVVGDGEAETAPLATSWHVNKFLNPKNDGTVLPILNLNGFKIANPTVLSRESDETLTDYFHSLGWHPYFVSSFDKPIMQVHEEMAKTMDTVFTEIKDIREKAVQQTNEEITRPLWPMIVLRSPKGWTGPKTWDDKPIENSFRAHQIPIPADQNHPEYIPQLVDWLQSYKPDELFDENGQLTQSIQEVLPKKELRMANNSVTNAGIIKPLILPDIDNYLVENNQPDNNLAQDAILLGDYLRDIIKLNPTNFRGFGPDETASNRFQDIFETTNRQWLLPIKEPNDQFMAPEGRIIDSMLSEHYDEGMLEAYTLTGRHGFFASYEVFIREVDDMIVQHFKWLNHSHDVSWRKDVPALNIIADSTVFQQDHNGYSHQDPGVTTMLYEKQPDFIREFFPADANSLVATFEHAAQATQQINYIVASKHPRLQWFSPTEAKQLVTQGLRVIDWASTDKGEKPDIIITSAGSEPTTESLAAIQILHEHIPSLKIRYINVLDLFKLRADASYGLSDDEFDAYFTTDTPVLFAFHGYEPMIESIFFKRHNHHLAVHGYREVGDITTPFDMRVLNKIDRFNLVKAAINLLPENIRTKQAALVQEMTDKLDLHVAYTRSKGTDLPEVEDWRWRPLK

SEQ ID NO: 505 - protein, 819 aa, Lactobacillus brevis ATCC 367
MAVDYDSKSYLEKVDAWWRATTYLSGGMIFLKSNPLFSVTNTPIQKDDVKVKPIGHWGTISGQTFLYAHANRLINKYGLNMFYIGGPGHGGQVMVTNSYLDGTYTDAYPEITQDLEGMSRLYKRFSFPGGIGSHMTAQTPGSLHEGGELGYSLSHATGAVLDNPDQIAFTVVGDGEVETGPAMTAWNSIKFLNPKNDGAVLPILDLNGFKISNPTIFSRMSDDKIAKFFEGLGWSPRFLENDDIHDYMTYHEKAAKLFDQAIADIKQIQKDARENGKYEDGTIPAWPVVIARLPKGWGGPKKNLDGDPIEGSFRAHQVPLGLSQNNFKELPEFEEWMNSYKPAELFNTDGSLKAEVADFAPKGDKRMAANPVANGGRARGEKPETLDLPNWKDYANDINESNRGTLLPDGNKNMDMNVLSTFFAGVATKNPSSFRIFGPDETMSNRLWEMFKITNRQWMSKVKEPNDQYEAPEGRILDAQLSEHQAEGWLEGYTLTGRTGVFTSYESFLRVVDSMTTQHFKWIRQAAAEPWRNDYPSLNLVSTSTVFQQDHNGYTHQDPGMLTHLAEKKSDFIRQYLPADGNTLLAVFDRAFKDRQKVNHIVASKQPRQQWFSIDEAEELATKGLKTIDWASTVAEGEDADIVFASAGVEPTIETLAAVDLINDAFPAVKMRYVNVVELERLQKKNGPLNDDRALSDSEFSSFFGESGTPVVFGFHGYEDLIESFFYERQHLGLHVHGYREDGDITTAYDMRVYSELDRFHQAKDAVNTLIAKGVIDEAAGKAFDKKMDDILAKHFKITRDEGRDIEEFTKWEWTPLKK

SEQ ID NO: 506 - protein, 819 aa, Weissella paramesenteroides ATCC 33313
MAVDFDSKAYLEKVDAWWRATNYLSAGMIFLKSNPLFSVTNTPLQADDVKVKPIGHWGTISGQTFLYAHANRLINKFDLNMFYIGGPGHGGQVMVTNSYLDGTYTENYPEITQDVEGMARLFKRFSFPGGIGSHMTAQTPGSLHEGGELGYSLSHATGAVLDNPDQIAFAVVGDGEAETGPSMTAWHSIKFLNPKNDGAVLPILDLNGFKISNPTIFSRMSDEEITKFFEGLGYSPRFIENDDIHDYMAYHELAAKVFDQAIEDIQAIQKAAREEGRYIDGEVAAWPVIIARLPKGWGGPTHNAAGEPIENSFRAHQVPLPLAQQKLDTLPEFEEWLNSYKPAELFNTDGSLKAEVAEMAPKGDKRMAANPVANGGRRRGEEPTDLALPNWKDFTNEVTADNRGTELSDGNRNMDMNVLSTYFAAVSKLNPTSFRIFGPDETMSNRLWEMFKITDRQWMEEVKEPNDQHEAHEGRILDAQLSEHQAEGWLEAYTLTGRVGVFASYESFLRVVDSMITQHFKWLRHASEQPWRNDYPSLNLISTSTAFQQDHNGYTHQDPGILTHLAEKKADFIRQYLPADGNTLLAVFGRAFTERHKINHIVASKQPRQQWFSVAEAEELATEGVKVIDWASTVAEGEDADIVFASAGVEPTIEVLAALHLINEAFPAVKMRYVNVVELHRLLNKNGKMNHERALSDDKFTALFGESGTPVMFGFHGFEDLIESIFYERQHLGAHVHGYREDGDITTTYDMRVYSELDRFHQAKEAANILADKGVINADEAKAFDEKMDAILAKHFDVTRNEGRDIEEFTDWKWTALNK

SEQ ID NO: 507 - protein, 817 aa, Leuconostoc citreum KM20
MADFDSKEYLELVDKWWRATNYLSAGMIFLKSNPLFSVTNTPIQAEDVKVKPIGHWGTISGQTFLYAHANRLINKYDLNMFYIGGPGHGGQVMVTNAYLDGEYTEDYPEITQDLEGMSRLFKRFSFPGGIGSHMTAQTPGSLHEGGELGYSLSHAFGAVLDNPDQIAFAVVGDGEAETGPSMTSWHSTKFLNAKNDGAVLPILDLNGFKISNPTIFSRMSDEEITKFFEGLGYSPRFIENDDIHDYAAYHELAAKVLDQAIEDIQAIQKDARENGKYEDGTIPAWPVIIARLPKGWGGPTHDEDGNPIENSFRAHQVPLPLAQNKLETLSQFEDWMNSYKPEELFNADGSLKDELKAIAPKGDKRMSANPIANGGRRRGEEATDLTLPDWRQFTNDITNENRGHELPKVTQNMDMTTLSNYLEEVAKLNPTSFRVFGPDETMSNRLWSLFNTTNRQWMEEVKEPNDQYVGPEGRIIDSQLSEHQAEGWLEGYTLTGRVGIFASYESFLRVVDTMVTQHFKWLRHASEQAWRNDYPSLNLIATSTAFQQDHNGYTHQDPGMLTHLAEKKSNFIREYLPADGNSLLAVQDRAFSERHKVNLIIASKQPRQQWFTADEADELANEGLKIIDWASTAPSGDVDITFASSGTEPTIETLAALWLINQAFPEVKFRYVNVVELLRLQKKSESHMNDERELSDAEFNKFFQADKPVIFGFHAYEDLIESFFFERKFKGDVYVHGYREDGDITTTYDMRVYSKLDRFHQAKEAAEILSANSTIDQAAADTFIEKMDATLAKHFEVTRNEGRDIEEFTDWNWSALK

SEQ ID NO: 508 - protein, 813 aa, Leuconostoc mesenteroides subsp. mesenteroides ATCC 8293
MADFDSKEYLELVDKWWRATNYLSAGMIFLKSNPLFSVTNTPIKAEDVKVKPIGHWGTISGQTFLYAHANRLINKYGLNMFYVGGPGHGGQVMVTNAYLDGAYTEDYPEITQDIEGMSHLFKRFSFPGGIGSHMTAQTPGSLHEGGELGYSLSHAFGAVLDNPDQVAFAVVGDGEAETGPSMASWHSIKFLNAKNDGAVLPVLDLNGFKISNPTIFSRMSDEEITKFFEGLGYSPRFIENDDIHDYATYHQLAANILDQAIEDIQAIQNDARENGKYQDGEIPAWPVIIARLPKGWGGPTHDASNNPIENSFRAHQVPLPLEQHDLATLPEFEDWMNSYKPEELFNADGSLKDELKAIAPKGDKRMSANPITNGGADRSDLKLPNWREFANDINDDTRGKEFADSKRNMDMATLSNYLGAVSQLNPTRFRFFGPDETMSNRLWGLFNVTPRQWMEEIKEPQDQLLSPTGRIIDSQLSEHQAEGWLEGYTLTGRVGIFASYESFLRVVDTMVTQHFKWLRHASEQAWRNDYPSLNLIATSTAFQQDHNGYTHQDPGMLTHLAEKKSNFIREYLPADGNSLLAVQERAFSERHKVNLLIASKQPRQQWFTVEEAEVLANEGLKIIDWASTAPSSDVDITFASAGTEPTIETLAALWLINQAFPDVKFRYVNVVELLRLQKKSEPNMNDERELSAEEFNKYFQADTPVIFGFHAYENLIESFFFERKFTGDVYVHGYREDGDITTTYDMRVYSHLDRFHQAKEAAEILSANGKIDQAAADTFIAKMDDTLAKHFQVTRNEGRDIEEFTDWTWSPLK

SEQ ID NO: 509 - protein, 822 aa, Lactococcus lactis subsp. lactis
MTEYNSEAYLKKLDKWWRAATYLGAGMIFLKENPLFSVTGTPIKAENLKANPIGHWGTVSGQTFLYAHANRLINKYNQKMFYMGGPGHGGQAMVVPSYLDGSYTEAYPEITQDLEGMSRLFKRFSFPGGIGSHMTAQTPGSLHEGGELGYVLSHATGAILDQPEQIAFAVVGDGEAETGPLMTSWHSIKFINPKNDGAILPILDLNGFKISNPTLFARTSDVDIRKFFEGLGYSPRYIENDDIHDYMAYHKLAAEVFDKAIEDIHQIQKDAREDNRYQNGEIPAWPIVIARLPKGWGGPRYNDWSGPKFDGKGMPIEHSFRAHQVPLPLSSKNMGTLPEFVKWMTSYQPETLFNADGSLKEELRDFAPKGEMRMASNPVTNGGVDYSNLVLPDWQEFANPISENNRGKLLPDTNDNMDMNVLSKYFAEIVKLNPTRFRLFGPDETMSNRFWEMFKVTNRQWMQVIKNPNDEFISPEGRIIDSQLSEHQAEGWLEGYTLTGRTGVFASYESFLRVVDSMLTQHFKWIRQAADQKWRHDYPSLNVISTSTVFQQDHNGYTHQDPGMLTHLAEKKSDFIRQYLPADGNTLLAVFDRAFQDRSKINHIVASKQPRQQWFTKEEAEKLATDGIATIDWASTAKDGEAVDLVFASAGAEPTIETLAALHLVNEVFPQAKFRYVNVVELGRLQKKKGALNQERELSDEEFEKYFGPSGTPVIFGFHGYEDLIESIFYQRGHDGLIVHGYREDGDITTTYDMRVYSELDRFHQAIDAMQVLYVNRKVNQGLAKAFIDRMERTLVKHFEVTRNEGVDIPEFTEWVWSDLKK

SEQ ID NO: 510 - protein, 817 aa, Oenococcus oeni PSU-1
MAANAPAVDYDSTEYLELVDKWWRATNYLSGGMIFLKNNPLFSITKTPLKSEDVKFKPIGHWGTISGQTFIYAHENRLINKYGLNAFYVEGPGHGGQVMVTNSYLDGSYTEDYPEITQDLKGMSKLFKRFSFPGGIGSHATAQTPGSLHEGGELGYSLSHGIGAILDNPDQVGFVTVGDGEAETGPAMTAWHGIKFINPKTDGAVLPILDLNGWKISNPTIFSRMSDEQIAKFFEGLGWSPRFLENDEIHDFMTYHKKAAKLFDQAIEDIKQIQKDARENNKYQDGTIPAWPVIIARLPKGWGGPKFDEDGNPIENSFRAHQVPLNFSAEHMEELPQFEEWMNSYKPEELFNEDGSLKAEISAIAPKGSKRMAANPLANAGVDNSDLKLPDWKEYSTGVTPENRGTEMKDANMNMDMVTLSGFLAGVAKLNPTRFRFFGPDETMSNRLWKLFDKTPRQWMSKIKFPNDALLAPEGRIIDSQLSEHEAEGWLEGYTLTGRVGMFASYESFLRVVDSMINEYFKWIRQADAEPWRNKYQSLNLISTSTVFQQDHNGYTHQDPGMLTNLAEKKQNYIRQYLPADGNELLAVASRALVDRQKINHIVASKQPRQQWFTAEEAEKLVNNGLGIVDWASTSPDGDVDITFASAGTEPTIETLAALWLVNQSFPDVKFHYVNVVELGRLQKKVGPLNDDRSLSDEEFDKFFPAGKPVVFGFHGFEDLIEAIFYERNHHNLHAHGYREDGDITTQYDMRVYSHLDRFHQAIDAVSALKDEGVIDGEKADSFIDDMNKILDKHFEVTRNEGRDIEEFTDWNWTALK

SEQ ID NO: 511 - protein, 791 aa, Clostridium butyricum 5521
MTNINYSSESYLKKVDAYWRATNYISVGQLYLKGNPLLREPLKPEHVKNAVFGHWGTIAGQNFIYAHLNRVINKYDLSMLYISGPGHGGQVMVSNSYLDGSYSEVYPEITQDLEGLSKLYKQFSFSGGIGSHATPQAPGSIHEGGELGYSLVHGFGAILDNPDLIATVVVGDGEAETGPLATSWQLNKFINPVTDGVVLPILYLNGFKISNPTIMAKMTDEELQKYFEGLGWDPIFVEGDEPEVMHQLMAEKMDEAIEKILTIKKRAVEENDMSRPKWPVILNRTPKGWTGPKELDGKPIEGSFRAHQVPIPFDSKHMECADDFVKWMNTYGPEELFTEDGKLVEEIAEIIPKGDRRMSCNPATNGGKIMKGLRLPDYREYAIDNKEKGKNVAQDMLILGKYVRDVMKLNDKERNFRVFSPDEAASNRLYAMFEETKRQWVGEIDEPYDEFLAPDGRILDSMLSEHIAEGALEAYLLTGRHGFIHSYESFLRVVDSMITQHFKWLNQCEDIPWRADIPSLNLINTSHIWQQDHNGYTHQDPGMLGHLADKNSGLIHEYLPADANTLLVTFDKCIRSINQVNVMTASKHPRQQWFTIEEAEYLVNKGLGIVDWASTDKNGETDIVFAMAGDTPTLEGLAAVQLLHDYLPDLKIRFVNIVDLLKLQSPEVYEHGISDEEFNMIFTKDKPIIFGFHGYENLVDTLFFKRDNHNVSVHGYRDKGEITTGFDMRVMNELDRFNLVKDAIYHLPQLANKGAHIIREMNEKLEIHTKFVHENGIDLPEIANWRWKGLK

SEQ ID NO: 512 - protein, 797 aa, Clostridium carboxidivorans P7
MKVITTKEHTGEGNITPEYLKKVDAYWRAANYLSAAQLYLLDNPLLKEPLKPEHLKGKVVGHWGTIPGQNFIYAHLNRVIKKYDLDMIYVSGPGHGGQVMVSNSYLDGTYSEVYPNVARDIPGLKKLCKQFSFPGGISSHMAPETPGSIHEGGELGYSLAHSFGAVFDNPSLITACVVGDGESETGPLATSWQANKFLNPITDGAVLPILHLNGYKISNPTILSRIPNEELKKFFEGNGWKPYFVEGEDPKTMHELMANTLDIVTEEILKIQENARKNNDATRPRWPMIVLRTPKGWTGPKMVDGVPNEGSFRAHQVPLPVDRCHTEHLDDLVKWLKSYKPEELFDENGRLVPELQELTPKGNKRMASNPHTNGGLLLKELRTPDFRDYAVDVPTPGATTSQDMIELAKYLRDVVKLNEENRNFRIFGPDETMSNRLWALFEGTKRQWLPEINEPNDEFLAHDGRIVDSMLSEHLCEGWLEGYLLTGRHGFFSSYEAFLRIVDSMITQHGKWLKVTSELPWRKDIASLNLIATSNVWQQDHNGYTHQDPGLLGHIVDKKPEIVRAYLPADANTLLAVFDHCLHTKHKINVLVTSKHPRQQWLTMEQAVKHVEQGASIWDFASNDQGQEPDVVIGTCGDTPTLEGLAAVTILREHLPELKVRFVNVVDMMKLMPENEHPHGLSEQDYNTLFTTDKPIIFAFHGYAHLVNQLTYHRANHNLHVHGYQEEGTITTPFDMRVQNKLDRFNLVKDVVQNLPQLGNRGAHLVQLMNDKIVEHNKYIRDFGEDLPEVAKWQWHV

SEQ ID NO: 513 - protein, 796 aa, Clostridium acetobutylicum ATCC 824
MQSIIGKHKDEGKITPEYLKKIDAYWRAANFISVGQLYLLDNPLLREPLKPEHLKRKVVGHWGTIPGQNFIYAHLNRVIKKYDLDMIYVSGPGHGGQVMVSNSYLDGTYSEVYPNVSRDLNGLKKLCKQFSFPGGISSHMAPETPGSINEGGELGYSLAHSFGAVFDNPDLITACVVGDGEAETGPLATSWQANKFLNPVTDGAVLPILHLNGYKISNPTVLSRIPKDELEKFFEGNGWKPYFVEGEDPETMHKLMAETLDIVTEEILNIQKNARENNDCSRPKWPMIVLRTPKGWTGPKFVDGVPNEGSFRAHQVPLAVDRYHTENLDQLEEWLKSYKPEELFDENYRLIPELEELTPKGNKRMAANLHANGGLLLRELRTPDFRDYAVDVPTPGSTVKQDMIELGKYVRDVVKLNEDTRNFRIFGPDETMSNRLWAVFEGTKRQWLSEIKEPNDEFLSNDGRIVDSMLSEHLCEGWLEGYLLTGRHGFFASYEAFLRIVDSMITQHGKWLKVTSQLPWRKDIASLNLIATSNVWQQDHNGYTHQDPGLLGHIVDKKPEIVRAYLPADANTLLAVFDKCLHTKHKINLLVTSKHPRQQWLTMDQAVKHVEQGISIWDWASNDKGQEPDVVIASCGDTPTLEALAAVTILHEHLPELKVRFVNVVDMMKLLPENEHPHGLSDKDYNALFTTDKPVIFAFHGFAHLINQLTYHRENRNLHVHGYMEEGTITTPFDMRVQNKLDRFNLVKDVVENLPQLGNRGAHLVQLMNDKLVEHNQYIREVGEDLPEITNWQWHV

SEQ ID NO: 514 - protein, 791 aa, Coprococcus comes ATCC 27758
MEDNKLCLEKQPLSDELLNKMNAYWRAANYLSAGQLYLLDNPLLKKPLTMDQIKKKIVGHWGTVPGQNFIYVHCNRVIKRYDLDMILLSGPGHGGNFLIANTYLEGSYSEVYPNISQNEEGMKKMFKQFSFPCGVPSHCAPETPGSINEGGELGYSIAHGFGAVLDNPDLIATVVVGDGEAETGPLATSWQSNKFLNPITDGAVLPILHLNGYKISNPTIFSRISHEEVENFFKGCGWKPYFVEGDDPMTMHRKMAETMDACIEEIKAIQKNARENNDPTRPFWPMIVLRTPKGWTGPKVVDGLQIEGSFRAHQVPLSMESPEHLDLLKEWLESYHAEELFDEKGRLIPELAELAPKGDARLGANPHANGGLLLKDLRLPDFRSYGIEVEPGKTKAQDMIELGGYIRDIFKLNEDSKNFRIFGPDESMSNRLYKVFEEQKRDWQADLLDTDDCLARDGRIMDGMLSEHMCEGWLEGYLLTGRHGFFASYEAFIRIVDSMAAQHAKWLKVCNQLSWRQPIASLNFILTSNVWQQDHNGFTHQDPGFLDHIANKKADVVRMYLPPDTNCLLSCFDHCIKSKNYVNAIVASKHPSCQWLTMEQAVKHCTQGIGIWEWASNDCGEEPDVVMACCGDTPTLEVMAAVTILRDEMPELKIRVVNVVDLFKLESDHKHPHGLSDAEYDAIFTKDKPVIFAFHGYPTLIHELTYERHNHNISVHGYQEEGTITTPFDMRVQNQIDRFNLVKDAIMHLPQLGNKGSFLIQKMNDKLVEHKQYIAEYGQDLEEIRNWEWHK

SEQ ID NO: 515 - protein, 791 aa, Ruminococcus sp. 5_1_39B_FAA
MEDNKLCLEKQPLNQEMLDKIDAYWRAANYLSAGQLYLLDNPLLREPLTMDQIKKKIVGHWGTVPGQNFVYAHCNRVIKRYDLDMILLSGPGHGGNFMIANTYLEGSYSEVYPNISQDEEGMKKMFKQFSFPCGVPSHCAPETPGSINEGGELGYSIAHAFGAVFDNPDLIATTVVGDGEAETGPLATSWQSNKFLNPITDGAVLPILHLNGYKISNPTIFSRLSHEELECFFKGCGWKPYFVEGDDPMTMHKKMAETMDTVIEEIKAIQKNARENNNPERPVWPMIILRTPKGWTGPKVVDGLQIEGSFRAHQVPITMEKPEHLELLKEWLESYRPQELFDKNGRLIPELAELAPKGNARLGANPHANGGLLLKDLRLPDFRDYGIEVQPGKTKAQDMIELGGYIRDIFKLNEENKNFRIFGPDESMSNRLYKVFEYQKRDWNAEMLDTDDCLARDGRIMDSMLSEHMCEGWLEGYLLTGRHGFFASYEAFIRIVDSMAAQHAKWLKVCNQLSWRQPIASLNFILTSNVWQQDHNGFTHQDPGFLDHIANKKADVVRMYLPPDANCLLSCFDHCIKSKNYVNAIVASKHPSCQWLTMEQAVKHCTQGIGIWEWASNDCGEEPDVVMACCGDTPTLEIMAAVTILRDEMPELKIRVVNVVDLFKLESDHKHPHGLSDAEYDAIFTKDKPVIFAFHGYPTLIHELTYERHNHNISVHGYQEEGTITTPFDMRVQNQIDRFNLVKDAIMHLPQLGNKGSFLIQKMNDKLVEHKQYIAEYGQDLEEIRNWEWHK

SEQ ID NO: 516 - protein, 819 aa, Roseburia intestinalis L1-82
MGNCPPKKDCLKYNKRDRKCFNKGGKSSMAEVNAVEKQPVTQEYLKKMDAYWRAANYLGAAQLYLLDNPLLREPLTMDHIKKKIVGHWGTVPGQNFVYVHLNRVIKKYDQDMILISGPGHGGNFFVANTYLEGTYSEVYPNIGEDMDGLKKLCKQFSFPGGISSHVAPETPGSINEGGELGYSLAHSFGAVFDNPDLVAACIVGDGESETGPLATSWQCNKFLNPKTDGAVLPILHLNGYKISNPTILARISREELEHFFDGCGWKPYFVEGDEPMDMHSKMAAALDQAMDEIKAIQKNARENDDLTRPKWPMIVLRTPKGWTGPKVVDGNQIEGSFRAHQVPIMMDKPEHLQMLKDWLLSYHPEELFDEDGKLIPELKALAPTGDRRIGSNPHANGGKLLRDLRLPDFKDYAVDVPKPGAVEAQDMIELGGFVRDIFELNEDAKNFRIFGPDETMSNRLGKVFEATNRDWNGEAYDTDEFLAHDGRVMDSMLSEHMCEGWLEGYLLTGRHGFFASYEAFIRVVDSMCAQHAKWLKVCNQLPWRQSIASLNLILSSNVWQQDHNGFTHQDPGFLDHIANKKSDVVRLYLPPDANCLLSCFDHCIRSRNYVNVLVTSKHPRQQWLTMEQAVKHCTQGIGIWEWASNDQGEEPDVVMACCGDTPTLETLAAVTILREALPEIKIRVINVVDLMKLEPNTKHPHGLSDAEYDALFTKDKPIIFAFHGYHTLIHELTYRRTNRNIHVYGYQEEGTITTPFDMRVQNEIDRFHLVKNVIKYLPQLGNRGSYLVQQMNDKLVEHKQYIHEYGQDLPEVRDWKWNL

SEQ ID NO: 517 - protein, 811 aa, Bacteroides capillosus ATCC 29799
MAKTAKPESKPVLKSAARMSKRGPLDQEQLRKMDAYWRAANYLSVGQLYLLDNPLLRQPLKPEHLKRHTVGHWGTAPGQNFIYTHLNRVITRNDLNMIYLAGPGHGGEAVVAQTYLEGTYSEVYPNVGQDEEGMKRLFRQFAFPGGIPSHVGPEAPGSINEGGELGYSLSHAFGAVMDNPDLIAACVVGDGEAETGPLAAAWQSNKLINPITDGAVLPIFHLNGFKSAGPSIFGRITHEELEMYFKGCGWEPRFVEGDDAPQMHQTMAAALDWAVREISRIQEHARTQNDPTRPRWPMIVFRSPKGWTCPVSLDGFPVEGTCLAHRIPFPADAAHPEYIALLESWMRSYHPEELFDENGRLIPELRELAPVGNRRMGSNPHANGGQVLRDLRRPDFRNYAVDVPSPGDHLGEDMHQLGKYMRDVVRLNMEARNFRIFAPDEAKSNGLEPVFEVTGRRWNTDFIDNDLNLDTEGRVMDAMLSEHMCQGWLEGYLLTGRHGAFVSYEAFIRIVDSMVSQHAKWLKVASQLPWRQDIASLNYVLASNVWQQDHNGFTHQDPGFLDHVANKKADVVRLYLPPDSNCLLSTFDHCIKSRNYVNVIIASKHPRPQWLTMDQAVKHCTQGIGIWQWASNDQGAEPDVVMACCGDTPTLETLAAVTILRKYLPELHIRVINVVDLMKLQPHTEHPHGLTDEDYDAYFTTDKPIIFAFHGYPTLVHELTYRRHNKKLHVRGYKEEGTITTPFDMRVQNDIDRYHLVMDTVKRLPQLGNRGAFLIQLMRDKLVEHRQYITTYGEDMPEIKDWKWNNGRGME

SEQ ID NO: 518 - protein, 835 aa, Phaeodactylum tricornutum CCAP 1055/1
MNEKTSYNETKTRRKTVPSAFLMVDRYWMASNYLVVGQIYLMDKNPLLKQPLKPDHVKSRLLGHFGTCPGQNFIYVHLNRIICERKLSMFYVCGPGHGGPAMFAQTYLEGSFTERYPDISKDEEGIGKLFKQFSFPGGFPSHAAPETPGSIHEGGELGYSLSHAFGAVFDKPDLIVACVVGDGEAETGPLATSWHSNKFLNPAKDGAVLPILHLNGFKIANPVVLARIPEEELLSLFRGYGYNPVIVEGSDPAEMHPKFAAELDYAVDTILSIQKEARTHLEEGLQLRRPTWPVILLKTPKGWTGPSEVDGVKIEGSYKSHQVPVSNPSENLEHLDILEKWLRSYQPENAFDDNGKLLPELQALVPPRHLRMGSNPYTNPVISPLLLPSYEAYGVKIDKNSRGKAKASDTFTLGTYLRDVIIKNVKHKNFRIFSPDETASNRLHAVYEATNKQWMGSLNSDDDTLADHGRVIEMLSEHQCEGWLEGYLLTGGHGLLNSYEAFIHIVSSMFNQHAKWLKICKETPWRNELSSLNILLSSHVWRQDHNGKAIPTVRCWIDSDALIQSYLLQFFVGFTHQDPGFLQHVASKKPGIIRIYLPPDGNCLLSVMDHCLSSRHYVNIVVAGKHPSHQWLTPAEASEHCTEGIGIWKWASNDIGREPDIIVACAGDVPTLEALAAVSIVRKKMPEFRIRFINVVDLMKLTNTSHHPHGLSNEKFDSLFTTDKPVLFDFHAYPELVEQLIFCRSNRNFTVRGYKEEGTMSTPFDGCVMNGVDRFHLVIDICNIIEHHCRTVTEKTRWLAPYVSQDMRQLLAKHKKYIHGNGVDLEEVADWEWEC

SEQ ID NO: 519 - protein, 784 aa, Rhodopseudomonas palustris BisB5
MFDVLSDDLMQKMDAYWRAANYLSVGQIYLQDNPLLEQPLRIEHIKPRLLGHWGTTPGLNLLYVHLNRLISAHDLDMIYIIGPGHGGPGLVANSYLEGSYTERYPAIERNRNGLQRLFRQFSWPNGVPSHVSPETPGSIHEGGELGYSLAHAYGAAFDNPDLIVACIVGDGEAETGALATSWHSNKFLNPARDGAVLPILHLNGFKIANPTILARIGRQELTDLMRGYGYEPIVVEGDDPKLVHHTLAAALERALADIRAIQAAARHQGVTVRPRWPMIILRTPKGWTGPKQVDGKQIEGTWRAHQVPIASFKDPTHVQLLETWLRSYRPEELFDASGKFRDDLAALAPTGHRRMSANPHANGGELLQPLSLPDFHDYAVTQSGPGTVKAEATRVLGAFLRDVMKSNLDAKNFRLFGPDETASNRLDAVLEVTDKEWMAEIEDVDVALGPDGRVMEVLSEHLCQGWLEGYLLTGRHGFFSCYEAFIHIVGSMFNQHAKWLKTCDAIPWRRPIASLNYLLTSHVWRQDHNGLSHQDPGFIDHVVNKKASVVRVYLPPDANCLLSVADHCLRSRNYVNLIVAGKQPEWQWLDIDSAVRHCSAGAGIWHWASNGEDDPDVVMACAGDVPTLETLAAVMLLREYVPDIRVRVVNVVDLMVLQPSSEHPHGLDDKRFDEIFTVDKPVVFAFHGYPWLIHRLTYRRRNHFNIHVRGYKEEGSTTTPFDMVVLNDLDRYRLALDAIRRIPRLAGEVEAATARYWATMQRHKLYIGEHGDDMPEVRDWSWQG

SEQ ID NO: 520 - protein, 784 aa, Rhodopseudomonas palustris HaA2
MSDVLSNDLMQKMDAYWRAANYLSVGQIYLQDNPLLEQPLQLEHIKPRLLGHWGTTPGLNLLYVHLNRLITEHDLDMIYIIGPGHGGPGLVANSYLEGSYTERYPAIERNRNGLQRLFRQFSWPHGVPSHVSPETPGSIHEGGELGYSLAHAYGAAFDNPDLIVACIVGDGEAETGALATSWHSNKFLNPARDGAVLPILHLNGFKIANPTVLARISRQELTDLMRGYGYEPIVVEGDEPALVHHALAAALDRALADIQAIQAAARHQGVTARPRWPMIILRTPKGWTGPKQVDGKQVEGTWRAHQVPIADFKDPAHVQLLETWLRSYRPEELFDANGKFRDELAALAPTGHCRMSANPHANGGELLQPLSLPDFRNYAVALSAPGAAKAEATRALGTFLRDVMRDNLETKNFRLFGPDETASNRLDGVLEVTDKQWMADIEDVDIALGPDGRVMEVLSEHLCQGWLEGYLLTGRHGLFSCYEAFIHIIDSMFNQHAKWLKACDAIPWRRPIASLNYLLTSHVWRQDHNGFSHQDPGFIDHVVNKKASVVRVYLPPDANCLLSVADHCLRSRNYVNLIVAGKQPEWQWLDIDAAVRHCTAGAGIWHWASNDDGDPDVVMACAGDVPTVETLAAVMLLREYVPDIRIRVVNVVDLMVLQPSSEHPHGLDDRRFDELFTVDKPVVFAFHGYPWLIHRLTYRRRNHFNIHVRGYKEEGSTTTPFDMVVLNDLDRYRLALDAIRRIPRLAGQVESATDRYWATMQRHKLYIGEHGDDMPEIRDWRWQA

SEQ ID NO: 521 - protein, 783 aa, Rhodopseudomonas palustris CGA009
MSDVLSNDLLQKMDAYWRAANYLSVGQIYLQDNPLLDQKLQLDHIKPRLLGHWGTTPGLNLLYVHLNRLITEHDLDMIYITGPGHGGPGLVANAYLEGTYTERYPAIERSRNGMQRLFRQFSWPHGVPSHVSPETPGSIHEGGELGYSLAHAYGAAFDNPNLIVACVVGDGEAETGALATSWHSNKFLNPARDGAVLPILHLNGFKIANPTVLARITPQELTDLMRGYGYEPHFVEGDDPAVVHQTLAATLERVLGEIRAIQDKARNHGDTERPRWPMIVMRTPKGWTGPKQVDGKPVEGTWRAHQVPIADFKNPEHLTLLEDWMRSYRPDELFDATGKLRDELQALAPTGRRRMSANPHANGGELLEPLSLPDFHDYAVTLTGPGALKAEATRVLGTFLRDVMKNSLESENFRLFGPDETASNRLDAVLQVSPKEWMAAIEDVDVDLSPDGRVMEVLSEHLCQGWLEGYLLTGRHGFFSCYEAFIHIIDSMFNQHAKWLKACATIPWRKPIASLNYLLTSHVWRQDHNGFSHQDPGFIDHVANKKSNVVRIYLPPDANCLLSVADHCLRSRNYVNLIVAGKQPEWQWLDIDAAVRHCTTGAGIWHWASDEGEPDVVMACAGDVPTVETLAAVKLLREYVPDIKIRVVNVVDLMVLQPSSEHPHGLDDRRFDELFTTDKPVIFAFHGYPWLIHRLTYRRRNHVNIHVRGYKEEGTTTTPFDMVVLNDLDRYRLALDAILRIPRLADQRDAATSRYWATMQRHKLYIGEHGDDLPEVRDWRWSA

SEQ ID NO: 522 - protein, 784 aa, Rhodopseudomonas palustris BisB18
MPDPLTSDLLEKMHAYWRAANYLSVGQIYLQDNPLLEVPLRLDHIKPRLLGHWGTTPGLNLLYVHLNRLIKQHDLNMIYIIGPGHGGPGLVAQSYLEGSYTERYPAIERSRNGMQRLFRQFSWPHGIPSHVSPETPGSIHEGGELGYSLAHAYGAAFDNPDLIVACIVGDGEAETGALASSWHSNKFLNPARDGAVLPILHLNGFKIANPTVLARIGRVELTELLRGYGYEPDFVEGDDPAIVHQLLAGTLDRILAQIRHIQDEARNHGVTARPRWPMIVLRTPKGWTGPKFVDNLPVEGTWRAHQVPIADFKAPEHLKLLEDWMRSYRPQDLFDDNGKLRDELVALAPTGHRRMSANPHANGGELLQPLSLPDFHDYAVTLPAPGAVRAESTRVLGKYLRDVMKANLESQNFRLFGPDETASNRLEAVFEVSGKEWMAEVEHVDINLSVDGRVMEVLSEHLCQGWLEGYLLTGRHGLFSCYEAFIHIIDSMFNQHAKWLKVCATIPWRKPIGSLNYLLTSHVWRQDHNGFSHQDPGFIDHVANKKADIARIYLPPDANCLLSVTDHCLRSRNYVNVIVAGKQPEWQWLDIDAAVRHCTAGAGIWRFASNDAGDPDVVMACAGDVPTVEALAAVKLLREYVPDIRVRVVNVVDLMVLQPRSEHPHGLDDRGFDELFTTDKPVIFAFHGYPSMIHKLTYRRHNHHNIHVRGYKEEGTTTTPFDMVVLNDLDRYRLTLDAILRIPRLSGQREAATARYWDSIQRHKLYIGEHGDDLPEIVDWRWTA

SEQ ID NO: 523 - protein, 790 aa, Polaromonas naphthalenivorans CJ2
MTTLTPDLLRKMHAWWRAANYLSVGQIYLHANPLLEEPLTLAHIKPRLLGHWGTTPGLNLLYVHLNRLIREHDLDMINVIGPGHGGPGLVASTYLEGTYTETYPDISRDRDGMRKLFRQFSWPGGIPSHVAPETPGSIHEGGELGYSLAHAYGAAFDNPDLIVACIVGDGEAETGALATSWHSNKFLNPARDGAVLPILHLNGFKIANPTVLARIGREDLTALLRGYGHEPHFVVGDDPMTVHQQLAQTLDAVLAQIHTIQAAARAPHAPIPASLPRWPMIVLQTPKGWTGPKEVDGLPVEGTWRAHQVPITQFTNAEHIRQLEDWMRSYAPQELFDANGRFREEFAALAPTGNRRMGANPHANGGALLAPLVMPDFRDFAVPVSVPGGTMGESTRVLGTFLAEVMRRNTGSANFRLFGPDETASNRLGAVVEVAGKAWMAGIDAVDLNLSADGRVMEVLSEHLCEGWLEGYLLTGRHGLFSCYEAFVHIIDSMFNQHAKWLEVCRQIPWRLPIASLNYLLTSHVWQQDHNGFSHQDPGFIDVVANKKADVVRIYLAPDANCLLSIADHCLRSRNYVNLIIAGKAPALQWLDIESAAHHCAVGAGIWPWASNDSGDAQGGPDVVMACAGDVPTLETLAAVALLRGYVPDIRIRVVNVVDLMALQPQSEHPHGLDDDAFDAMFTLDRPVVFAFHGYPGLIHRLTYRRHNHDNLHVRGYKEEGTTTTAFDMVVLNNIDRYQLALDAIRRIPRLAHLVDDATRRYEASITRHKAYISEHGEDLPEVRDWRWPA

SEQ ID NO: 524 - protein, 786 aa, Stigmatella aurantiaca DW4/3-1
MSGPLSEEELGKIDAYWRAANYLSVGQIYLKNNPLLERPLTLEDIKPRLLGHFGTTPGLNFIYVHLNRIIRLHQANMMYLIGPGHGAPGIIANTFLEGSYTETYPNIERNADGLKRLFRQFSWPYGVPSHDAPEVPGSISEGGELGYSLLHAYGAAFDNPGLIVACVVGDGEAETGPLAASWHSNKFLNPITDGAVLPILHLNGYKIANPTLLARIDPDELDALFRGYGYRPYFLEGDDPRTMHQQMAAVLDTLYAEIRALQHQAREQKDPSRPRWPMLILKTPKGWTCPRTVDGKPVEGTWRAHQVPLSEVHSNPEHLRLLEEWLRSYRPQELFDAHGTFREALADIAPKGRLRMGANLHANGGKLLVPLVLPNFRDYAVPLDVPGSVQLSATQVLGGYLRDVMRKNLGANNFRMFAPDENASNRLQAVYEASGKRWNARYEDVDESLSTEGRVMEVLSEHLCQGWLEGYLLTGRHGFFSCYEAFIHLIDSMFNQHAKWIKSAKELPWRAPIASLNYLLSSHVWRQDHNGFSHQDPGFIDHVANKKADTVRIYLPPDANTLLSVTDHCLRSKNYVNLIIAGKQAAPVWLDRESAVRHCAAGIGTWDWASHGEGEPDVVMACAGDVPTLETLAAVTVLREWAPELKVRVINVVDLFTLETVGEHPHGLNHEDFNRLFTLDKPVIFAFHGYPTIVHKLTYKRVNHGNIHVHGYKEEGTTTTPFDMTVLNDMDRYTLALDAIRQAPAARHRLDAAEQRYSEVSQRHKLYVSEHGEDMPEVKGWKWTAR

SEQ ID NO: 525 - protein, 791 aa, Pseudomonas putida F1
MSDFPGTEELESLDAYWRAANYLTVGQIYLQGNALLTRPLTLADVKPRLLGHWGTSPGLNLVYTHLNRLIHQYSLNVLFVTGPGHGGPALVAQAYLDGTYTELNPSVERNALGMARLFRQFSWPYGIGSHVGPHVPGSIHEGGELGYSLAHAYGAALDNPQLIVACVIGDGEAETGPLAASWHCNKFLNPARDGAVLPILHLNGYKIANPSVLSMISEEELTSLMYGYGYDPYFVEGDEPMEVHRALARTLDVIYEKISQIQRLARYAEDPQVVDRPLWPVLILRTPKGWTGPRYVDGQRVEGTWRSHQLPLADLDKPPHLMQLQQWLESYRPHELFDAQGTLLPELAALTPTGRRRMSANPHANGGLLLRALDLPHYADYCVPMPGPGQVRAEATRVLGGYVRDVMKNSLASQNFRLFGPDETASNRLDAVFEVTDKVWLDARASDDRHLSAQGRVMEILSEHICEGWLEGYLLTGRHGLFSCYEAFIHIVDSMINQHAKWLKTAAEVPWRKPIASLNILLTSHVWRQDHNGFSHQDPGLLDLLANKKANLARIYLPPDANCLLSVAEHCLRSRGYINVIVAGKQMEWQWLDCEAAAVHCQSGIGRWGWACHDDEMPEVVLACAGDVPTLEVLAAVTLLQEQAPDVRVRVVNVVDLMALQLSQQHPHGLSDSDFNGLFTEDRPVIFAFHGYPALIHRLIYKRANPQRFHVRGFREEGATTTPFDMAVINNLDRYQLLLDVFERVPRLQPQLEQARARYWATMEKHKLYLIEHGEDMPEVAQWRWTSASRA

SEQ ID NO: 526 - protein, 811 aa, Arthrobacter sp. FB24
MANALGGDTVSDTTTNDVRTEVDSSDLGLVHRWWRAANYLSVGQIYLRSNPLLREPLRAEDTKSRLLGHWGTTPGLNFVYAHLNRVIRRDRQEMLFIAGPGHGGPAVVANAWLEGTYSEIYSNVGNDEAGLAELFRQFSYPGGIPSHAAPETPGSISEGGELGYSLAHAYGSVFDNPKLITAVVIGDGEAETGPLAASWHSHNFLDPVADGAVLPILHLNGYKIANPTVLARMPEAQLEQLLRGYGHTPHFVTVEDPDDFEGAHRDFAAAVDTCLAEIRAIQAERRAAGTPSADEAGAPQWPMIVLRSPKGWTGPKQVDGKQVEGTWRSHQVPLSEVRTNPEHLAQLEQWLQSYRPEELFDDGGRLRPDVAQNAPAGELRMSATPYANGGILLRDLKLPDYRKHAVEVPRPGVERVSAMLTLGGWMRDVIVQNPETFRLFGPDETASNRLQDVYDVTDKVWQYRIDDADEHLARAGRVMEVLSEHLCQGWLEGYLLTGRHGVFSCYEAFIHIVDSMFNQHAKWLKVHRELAWRQPVASLNYVLSSHVWQQDHNGFSHQDPGFIDHAVNKKAEVIRVYLPPDANTLLSVMEHCLASRDYVNIVVSGKQPSPTWLGPADAAHHCQRGLGIWEFAGSEVPGEEPDVVLACAGDVPTVETVAAAELLKNGAPGLKIRVVNVVDLMRLQDASEHPHGLTSRDFDGIFTADKPVIFAYHGYPSLIHRLAYRRTNQEGLHVRGYKEEGTTTTAFDMAMLNGIDRFQLAIDAIDRVPGLAERHSLLRQSLQDSRIRAHNHTRSHGEDQAEISDWTLGGG

SEQ ID NO: 527 - protein, 820 aa, Arthrobacter chlorophenolicus A6
MTGSTGNDVKGNGNAGQATAEQGTLGRGELELVDRWWRAANYLSVGQIYLRSNPLLREPLKPEDTKSRLLGHWGTTPGLNFVYAHLNRVIRRDAAEMLFIAGPGHGGPAVVANAWLEGTYSEIYGHVGNDEAGLAELFRQFSYPGGIPSHAAPESPGSISEGGELGYSLAHAYGSVLDNPQLVTAVVIGDGEAETGPLAASWHSHNFLDPAADGAVLPILHLNGYKIANPTVLARMPQEQLEQLLRGYGHEPYFVTVQDPGKTGQAHQDFAGVLDQCLADIRAIQAEHRGAGDVHNGAGDGTSGDHPGHRWPMIVLRSPKGWTGPRTVDGLQVEGTWRAHQVPLSEVRTNGEHLKQLEEWLQSYRPEELFDGDGRLRAAVAEAAPTGDFRMSATPHANGGVLRRALKLPPYRDYAVEVEAAGTERVSPMITLGSWIRDVIAQNMENFRLFGPDETASNRLQNVYEVTDKVWQYRIDDADEHLARSGRVMEVLSEHLCQGWLEGYLLTGRHGVFNCYEAFIHIVDSMFNQHAKWLKVHRRLPWRQPVPSLNYLLSSHVWQQDHNGFSHQDPGFIDHAVNKKAEVIRVYLPPDANTLLSVMEHCLASTDCVNVVVSGKQPSPTWLGPADAANHCRRGLGIWTFAGSEVAGGEPDVVLACAGDVPTVETVAAAELLRNGVPGLKVRVVNVVDLMRLQDESEHPHGLPGRDFDGIFTTDKPIIFAYHGYPALIHRLAYKRTNQEGLHVHGYQEEGTTTTPFDMAMLNGIDRFTLAIDAIDRVPGLAEKYSLLRQELQDRRDSAREHTRTHGEDPEEIRNWKLGG

SEQ ID NO: 528 - protein, 841 aa, Sanguibacter keddieii DSM 10542
MEIVMSRSAHGETTRTNTHALSDAWRPRPDEPLDDETLRRIDGWWRAANYLSIGQIYLLSNPLLRTELTRDDVKPRLLGHWGTTPGLNFLYAHLNRAIRERSLSTMYITGPGHGGPGLVANSYLEGTYTETYPDITQDDEGLRRLFRQFSFPGGIPSHVAPETPGSIHEGGELGYALSHAYGAAFDNPDLLVATVVGDGEAETGPLATSWHSNKFVNPVKDGVVLPILHLNGYKIANPTVLARISDDELESLMVGYGHKPHVFVGGFDDEDHVSVHRRFAVLLDEVLDEIAAIKARAADGDDSRPMWPMIVFRTPKGWTCPPEIDGKKTEGSWRAHQVPLASARDTPEHLEVLRGWLETYRAHELFDEDGRLVDDVAALAPEGALRMSANPHTNGGLLLKDLRLPDFRDFAVEVENPGGSITEATKVLGQWLTEVVRLNPDNFRIFGPDETASNRLQPVFEVTDKQWNADYLPEDLDDHLARAGRVMEMLSEHQCQGWLEGYLLTGRHGLFSCYEAFIHIIDSMFNQHAKWLKITREIPWRQPVASLNYLLSSHVWRQDHNGFSHQDPGFIDHVVNKKAEIVRVYLPPDANTLLSTYDHCLRSRDYVNVVVAGKQPAPTFLTMDQAIAHCTRGLGIWEWAGSEVEGEDPDVVLGCAGDVPTLEVLAAADLLRQHLPELKVRVVNVVDLMRLQDEKEHPHGLSDRDFDTLFTTTKPVVFAYHGYPWLIHRLTYRRAGHSNIHVRGYKEEGTTTTPFDMVMLNDLDRFHLVIDVIDQVPHLGSRAAVLRQQMVDARLRARQYTRDHGEDLPEVRDWVWPDAGDTATQVGGPQAATAATGGDNE

SEQ ID NO: 529 - protein, 824 aa, Beutenbergia cavernae DSM 12333
MTTTADPATAWRLGSGEGVSEETLERVDRWWRAANYLSVGQIYLLANPLLRTPLTRDDVKPRLLGHWGTTPGLNFLYAHTNRAIVERDLDAIYIAGPGHGGPGLVANTYLDGTYSEVYSHITPDEEGLRQLFRQFSFPGGVPSHVAPETPGSIHEGGELGYALSHAYGAVFDNPELLVLAVVGDGEAETGPLATSWHSNKFVNPARDGVVLPVLHLNGFKIANPTVLDRITDDELVALMRGYGHEPYLFVGGFDDEDHLTAHARFATLLDEVLDDIARIKERARAGDLTRPRWPMIIFRTPKGWTCPPEIDGKQTEGSWRAHQVPLANARDTPEHLDVLRGWLESYRAEELFDATGRLEPDIAQLAPHGERRMGANPHANGGLLTRDLRLPDFRGFAVDVPTPGGAIAEATKVLGEWLREVIRANPDNFRIFGPDETASNRLSAVYDTTSKQWNAEYRPIDDDDHLAPEGRVMEMLSEHQCQGWLEGYLLTGRHGLFTSYEAFIHIVDSMFNQHAKWLKVTQRIPWRRPIPSLNYLLSSHVWRQDHNGFSHQDPGFIDHVMNKKAEIVRVYLPPDANTLLSTYDHCLRSRDYVNVVVAGKQPAPQFLTMEQAVAHCTRGLGIWEWAGTEVDGEDPDVVLGCAGDVPTLETLAAADLLRRNIPDLKVRVVNVVDLMRLQDEREHPHGLSDRDFDGLFTDDKPVVFAYHGYPWLIHRLTYRRAGHANIHVRGYKEEGTTTTPFDMVMLNDLDRYHLVIDVIDRVPGLGSQYAGLRQRMVDARLAARQYTREHGEDIPEVRDWVWPDAGDAVGQEAAAALDTGGDNE

SEQ ID NO: 530 - protein, 810 aa, Jonesia denitrificans DSM 20603
MSELTDETLTIIDRWWRAANYLSVGQIYLLDNPLLRTPLSRDDVKPRLLGHWGTTPGLTFLYAHLNRVIKERQQSTLYITGPGHGGPGLVAGAYLDGTYSEIYSDITEDTEGLQKLFKQFSFPGGIPSHVAPETPGSIHEGGELGYALSHAYGAAFDNPDLLIAAVVGDGEAETGPLATSWHSNKFINPATDGTVLPILHLNGYKIANPTVLDRISRDELEALMVGYGHKPHFFEAGYDDEDASSFHRRFAELLDTVLDEIAAIKERAAQGDESRPQWPMIVFRTPKGWTGPATIDGKKTTGSWRAHQVPLASARDTDEHLQDLNAWLQSYRPDELFDENGKVAQDIASLTPKGDLRMSANPHANGGVLMKELRLPPIEDFAVDVPTPGSTISEAPRVLGSYLTEVIRRNPDNFRIFGPDETASNRLQGVYDVTDKQWNAEFFDGDTDEHMARKGRVVEMLSEHQCQGWLEGYLLTGRHGLMTSYEAFIHIVDSMFNQHAKWLKVTNHIPWRQPIPSLNYLLSSHVWRQDHNGFSHQDPGFIDHVVNKKAEVVRVYLPADANTLLSTYEHCLKSRQYVNVVVAGKQPAPNFLSMDEAKAHCERGLGIWEWAGTETPGQDPDVVLAAAGDVPTLEVLAAADILRRELPDLKVRVVNVVDLMRLQDENEHPHGLTDRDFDTIFTRNKPVIFAYHGYPWLIHRLTYRRNGHENIHVRGYKEEGTTTTPFDMVMLNDLDRFHLVIDVIDRVKGLGQKYAGLRQKMEDERIRARAYTREHGQDLPEVRNWVWPDAANQADGEKVDATLDTGGDNE

SEQ ID NO: 531 - protein, 828 aa, Xylanimonas cellulosilytica DSM 15894
MTSTTPATSSGWRATGVADLSTETLELIDKWWRAANYLSVGQIYLLDNPLLRKPLHRDDVKPRLLGHWGTTPGLTFLYAHLNRAIKEREQSTVYITGPGHGGPGLVAAAYLDGTYSEVYSDITKDDEGIRRLFKQFSFPGGIPSHVAPETPGSIHEGGELGYALSHAYGAAFDNPDLLVAAVVGDGEAETGPLATSWHSNKFVNPAQDGVVLPILHLNGYKIANPTVLARIPQDELKALMEGYGHKPHFFEVEDESTEDAASFHRRFATLLDEVLDEIAAIKARAAAGDESRPQWPMIVFRTPKGWTGPATIDGKKTTGSWRAHQVPLASARDTEEHLHDLETWLKSYGPEELFDEDGAVLPEITDALTPSGSLRMSDNPHANGGLLLKDLRLPDFRDFAVDVPTPGGAIAEAPRELGKFFTEVIRRNPDNFRIFGPDETASNRLQAVYEETDKQWNADFYGGDVDEHMSRAGRVVEMLSEHQVQGWLEGYLLTGRHGMMSSYEAFIHIVNSMFNQHAKWLKVTNEIPWRRPIASLNYLLSSHVWRQDHNGFSHQDPGFIDHVVNKKAEVVRVYLPADANTLLSTYDHCLRSRQLVNVVVSGKQPSPQWLTMDEAVEHCTRGLGIWEWAGTETDGEEPDVVLAAAGDVPTIEVLAAADILRQEVPGLKVRVINVVDLMKLQDPKEHPHGLSDKEFDGLFTTDKPILFAYHGYPWLIHRLTYRRNGHDNIHVRGYKEEGTTTTPFDMVMLNDMDRYHLVIDVIDRVPGMASRYAGLRQRMQDARIRARAYTREHGDDIPEVRDWVWPDAQNLASTSQVDATLFTGGDNE

SEQ ID NO: 532 - protein, 826 aa, Cellulomonas flavigena
MSTTTAATTAWQTGQGSQVSEETLGRIDKWWRAANYLSVGQIYLLDNPLLREPLTRDHVKPRLLGHWGTTPGLNFLYAHLNRAIAERSQSTIYVTGPGHGGPGLVASAYLDGTYSEVYSDITEDVEGMRRLFRQFSFPGGIPSHVAPETPGSIHEGGELGYALSHAYGAAFDNPDLLVAAVVGDGEAETGPLATSWHSNKFVNPAQDGVVLPILHLNGYKIANPTVLDRIGDDELRALMVGYGHKPYVFEGGYDTDEPMVEVHRRFAALLDEVLDEIAAIKARAAAGDLTRPAWPMIVFRTPKGWTGPDVIDGKKTTGSWRAHQVPLANARDTAEHLQVLEQWLESYGAADLFDATGRLDPDIRALAPSGDLRMSANPHANGGILLKDLRLPDFRDFAVDVPKPGGSISEAPRVLGEYLTEVIRRNPDNFRIFGPDETASNRLQAVYGVTDKQWNAELLGPEVDEHLARAGRVMEMLSEHQCQGWLEGYLLTGRHGLFTSYEAFIHIVDSMFNQHAKWLKVTNDIPWRRPIASLNYLLSSHVWRQDHNGFSHQDPGFIDHVVNKKAEVVRVYLPPDANTLLSTYDHCLRSRQYVNVVVSGKQPAPNFLTMEQAVAHCTRGLGIWEWAGSEAPDEEPDVVLAAAGDVPTLEVLAAVDILRRELPQLKVRVVNVVDLMRLQDAREHPHGLTDAEFDTIFTADRPIVFAYHGYPWLIHRLTYRRNGHANLHVRGYKEEGTTTTPFDMVMLNDLDRYHLVIDVIDHVHWLRASQAGLRQRMVDARLRAREYTRAHGEDLPEVRDWVWPDAQDLSDSGQVAATVATGGDNE

SEQ ID NO: 533 - protein, 823 aa, Mycobacterium gilvum PYR-GCK
MTTATTAERKPLSDQDVDRLDRWWRAANYLSVGQIYLLDNPLLRTPLTREDVKPRLLGHWGTTPGLNFLYAHLNRAIAQRQQSTIYVTGPGHGGPGLVANAYLDGTYSEIYSDITQDDEGLRRLFRQFSFPGGIPSHVAPETPGSIHEGGELGYALSHAYGAAFDNPDLLVAAVVGDGEAETGPLATSWHSNKFVNAAKDGAVLPILHLNGYKIANPTLLARIPTDELRALMVGYGHHPYFFEVPDDEGGPGVDHADAHRRFAALLDDVLDEIDDIKTRAREGDESRPAWPMIVFRTPKGWTGPDYIDGKKTTGSWRAHQVPLSNARDTKEHLAVLSDWLSSYRPDELFDADGRLLPEIAELAPSGQLRMSDNAHANGGLLLKDLRLPDFREYAVDVPAPGATVAEATRVLGQWLTEVIRLNPDNFRIFGPDETASNRLQAVYDATDKQWNAEFFGAEVDEHLARAGRVVEMLSEHQCQGWLEGYLLTGRHGLFNCYEAFIHIVDSMLNQHAKWLKVTNHIPWRRPIASLNYLLSSHVWRQDHNGFSHQDPGFIDHVVNKSAKVVRVYLPPDANTLLSTYDHCLRSRQYVNVVVSGKQPSPNFLTMEQAVAHCTRGLGIWEWAGSEELGTDPDVVLASAGDIPTLEALAAADILRQHLPDLKVRFVNVVDLMRLQDSTEHPHGLPDRDFDMIFTTDRPIIFAYHGYPWLIHRLTYRRAGHDNLHVRGYKEEGTTTTPFDMVMLNDLDRYHLVMDVIDRVPSLGSTCATLRQQMADKRIAAREYTRAHGEDIPEVKDWVWPAARESGFGTAGADGASSTGGDNE

SEQ ID NO: 534 - protein, 832 aa, Mycobacterium vanbaalenii PYR-1
MTTTTTAEQSPTTSWRTGDRRPLADAEIDQLDRWWRAANYLSVGQIYLLDNPLLRTPLTRDDVKPRLLGHWGTTPGLNFLYAHLNRAIKERGQSTIYLTGPGHGGPGLVANAYLDGTYSEIYSDITQDAEGMRRLFRQFSFPGGIPSHVAPETPGSIHEGGELGYALSHAYGAAFDNPDLLVAAVVGDGEAETGPLATSWHSNKLVNAGKDGVVLPILHLNGYKIANPTLLARIPTEELRSLLTGYGHHPYFFEVPDDAAQADHADAHRRFATLLDDVLDEIADIKARASAGDESRPSWPMIVFRTPKGWTGPAYIDGKKTTGSWRAHQVPLANARDTAEHLGVLADWLGSYRAEELFDTDGKLLPDIASLAPAGPLRMSDNPHANGGLLLKDLRLPDFREYGVDVPAPGATIAEATRVLGQWLTEVIRLNPDNFRIFGPDETASNRLQAVYDATDKQWNAEFFGPEVDEHLARAGRVVEMLSEHQCQGWLEGYLLTGRHGLFNCYEAFIHIIDSMLNQHAKWLKVTNGIPWRRPIASLNYLLSSHVWRQDHNGFSHQDPGFIDHVVNKSAKVVRVYLPPDANTLLSTYDHCLRSRQYVNVVVAGKQPSPNFLTMEQAVAHCIRGLGIWEWAGSEQLGTDPDVVLAAAGDIPTLEALAAADILRRHLPDLKLRFVNVVDLMRLQDRTEHPHGLSDRDFDMIFTTDRPIIFAYHGYPWLIHRLTYRRAGHANLHVRGYKEEGTTTTPFDMVMLNDLDRYHLVMDVIDRVPSLGSTCATLRQQMADKRIAAREYTRAHGDDIPEVKDWVWPAARESGFGTAAADATAATGGDNE

SEQ ID NO: 535 - protein, 823 aa, Brachybacterium faecium DSM 4810
MTATASWPNSPSSAPTPEELARLHAWWRAANYLSVGQIYLKDNPLLRQPLQREHVKPRLLGHWGTTPGLTFLYAHANRAIRQRGLRAMYITGPGHGGPGLVASTYLEGTYSEVYPAVSEDEAGMKRLFTQFSFPGGIPSHVAPETPGSIHEGGELGYALSHAYGAMFDSPDQIAFTVVGDGEAETGPLATSWHSNKFVNPQQDGVVLPILHLNGYKIANPTVLARIGEDELEALLRGCGHTPLFFTGGFDDEDPLEIHERFAAVLDEALDQIAEIKQRAFEDAAAGRETERPAWPMIVLRTPKGWTGPKEIDGQQTEGSWRSHQVPLASARDTDEHLADLDAWLRSYRPEELFDEDGRLLEDIAAAAPSGALRMSANPSTNGGSVLTPLRLPDFRDYAVEVPSPGGTVAEATKVLGTWLRDVIRDNPRTFRLFGPDETASNRLQAVYEATDKQWNARLEEHDRTEHLARAGRVMEVLSEHQCQGWLEGYLLTGRHGMFSSYEAFIHIVDSMVNQHAKWLKVTNELEWRRPIASLNYLLSSHVWRQDHNGFSHQDPGFIDHMVNKKAEIVRVYLPPDANTLLSTYDHCLRSRQYVNVVVAGKQPGPTWLDMDEAIVHCTRGLGIWDWAGTEQPGREPDVVLAGAGDIPTIEVLAAAKILRTEIPELRVRVVNVVDLMRLQDDSEHPHGLSQRDFDGYFGQDVPVVFAYHGYPWLIHRLAYRHDRGSRIHVRGYKEEGTTTTPFDMLMLNDSDRYHLVMDVIDRVEGLGTRYAALRQRMVDTRLRARAFAYEHGEDVPEITRWQWGDGGDAAPAGAPADTGGDNE

SEQ ID NO: 536 - protein, 820 aa, Kytococcus sedentarius DSM 20547
MITVPAWPDDPATPLDDEEARRLHAWWRAANYLSVGQIYLLDNPLLREELAPEHVKPRLLGHWGTTPGLTFLYAHFNRAIRQRGLNACYVTGPGHGGPGLVAATYLEGTWTETYPDVGQDLDGLQRLCKQFSFPGGIPSHVAPEVPGSIHEGGELGYSLSHAYGAMLDNPDQIAFTVVGDGEAETGPLATSWHANKFSDPQHDGVVLPVLHLNGYKIANPTVLARIPEEELVSLMRGYGHTPLLFTAGFDDEDELSVHRRFAAVLDEALDLIAQIKADAGPDSPRPAWPMIVFRTPKGWTGPEQVDGKQTEGHWRSHQVPLANARDTPEHLEVLANWLRSYRPEELFAQDGALLPEIAAMAPQGEKRMSANPITNGGSVLRDLMLPDFRDHAVELTSPGQPFSEATSVLGGYLREVMRRNPETFRLFGPDETASNRLQAVYEVTDKQWNAEYHPSDAEDPMARAGRVLEMLSEHQCQGWLEGYLLTGRHGMLNSYEAFVHIVDSMVNQHAKWYKVTNQLEWRRPLASLNYLLSSHVWRQDHNGFSHQDPGFIDHVVNKKAEIVRVYLPPDANTLLSTVDHCLRSRQYVNVVVAGKQPNPTWLTMEEAIAHCVRGIGIWPWAGTESDGDDPDVVLGCAGDIPTIEVLAAAKILREEVPGLTFRVVNVVDLMRLQDEKAHPHGLSETQFHTLFPAGTPVVFGYHGYPWLIHRLVYRHDTASHFHVRGYTEEGTTTTPFDMVMRNQLDRYQLVVDVIDRVPALGSRYARLRQRMEDKRLQARAHAYEHGEDLPEVAQWQWGDAQDEADAQQGSVRQDTGGDNV

SEQ ID NO: 537 - protein, 812 aa, Clavibacter michiganensis subsp. michiganensis NCPPB 382
MASDPAPRDPAAPLYLDVVDGWWRAANYLSVGQIYLLDDPLLERPLTRDDIKPRLLGHWGTTPLLNFVYAHLNRAIIERDLDMIYIAGPGHGGPGMVANAYLDGTYSELFSAATPDRAGMRHLFRQFSFPGGVPSHAAPETPGSINEGGELGYSLVHAFGAALDNPDLVVACVIGDGEAETATLASSWHLDKFLDPETDGAVLPILNLNGWKIANPTILARIPEEELLALFTGYGYSPRIVSGGFDGEDHAAVHERFALALGEALDDISRIQLAARTGGSEERPAWPMLILRTPKGWTGPKEVDGKQVEGTWRAHQVPLSGVRDDPDHLRQLQEWLESYRPHELFDRDGRLTPALQPNRPEGDRRMSANPHANGGLLRRDLRLPPLEVNAIDLSDGRGVIAEPTRVLGGWLRDVIARNPLDFRIFGPDETASNRLDDVYEVTAKAWQGEVLPVDEHLAHEGRVIEILNENITQGLLEAYLLTGRHGLFTSYEAFIHVVDSMFNQYAKWLESSSKVEWRRPVASFTYLLSSHVWRQDHNGFSHQDPGFLDHVVNKRAEIVRVYLPFDANSLLVTMDHCLRGTDLINVVIAGKQPTASLLSLEEARAHGARGVGVWEWAGTEVPGLEPDVVVACAGDIPTVEAMAAVQILKREIPQLRVRFVNVVDLMRLQDSTQHPHGLDDGSFDALFTRDKPVVFAFHGYPSLIHRLTYKRHNHENMHVRGFVEQGGTTTPFDMLMLNDLDRFRLVMDVIRRVPHLETTYAGLSQRMDDERIAHRVFTREHGEDMADVSGAEGLPFADPTRQTAIDTGDDNA

SEQ ID NO: 538 - protein, 800 aa, Salinispora tropica CNB-440
MNIATAQHNPLTEDELRRLDAYWRAANYLTVGQIYLRSNPLLREPLTVEHVKPRLLGHWGTSPGLNLLYAHLNRVIVARDLNAIYITGPGHGGPAIVANTWLEGTWSERYHGTCQDEAGMAQLFCQFSFPGGIPSHVAAEVPGSIHEGGELGYALSHAYGAAFDNPDLLVACVIGDGEAETGPLAGSWLSNVFLNPARDGAVLPILHLNGYKIANPTVLSRIPESDLLDLMRGYGHEPYLVAGDDPATVHQTLAATMDRALDEIAAIQQRARSGGPVERPRWPMIVLRTPKGWTGPREVDDKQVEGTFRAHQVPLSQVRQNPQHLAELERWLRSYRPEELFDATGAPIAELLELPPKGDRRMSANPVANGGQVLRDLVLPDFRDYAVDVPRPGTAVTSATGTLGNWIRDVIAANPETFRLFGPDEVASNRLGAAFEVTDRAWVAATTSGDENLSPDGRVMEVLSEHLCQGWLEGYLLTGRHGLFTSYEAFIHIVDSMVNQHAKWLKVTRDIPWRQPVASLNYLLSSHVWRQDHNGFSHQDPGFIDHVVNKKAEVVRVYLPPDGNTLLSTLSHCLRSRHYINVVVAGKQPTPSWLSMDEAVLHCRRGIGIWNWASSDDGAEPDVVLACAGDVPTLETIAAADLLHQHLPELKVRVVNVVDLMRLQPSSEHPHGLPDSEFDTIFTTDKPVIFAYHGYPWLIHRLTYRRTNHPNLHVRGYKEEGTTTTPFDMVMLNDLDRFHLVIDVIDRVPGLAARAAHLRQEMVDARQSCRDHTRKHGADDPRVTQWRWIRETDAGLSDDR

SEQ ID NO: 539 - protein, 800 aa, Salinispora arenicola CNS-205
MDSATAQDRPLTETELRRLDAYWRAANYLTVGQIYLRSNPLLREPLTPEHVKPRLLGHWGTSPGLNLLYAHLNRVIVARDLNAIYITGPGHGGPAIVANTWLEGTWSELYHGTGRDEAGMAQLFCQFSFPGGIPSHVAAEVPGSIHEGGELGYALSHAYGAAFDNPDLLVACVIGDGEAETGPLAGSWLSNVFLNPARDGAVLPILHLNGYKIANPTVLDRIPESELLDLLRGYGHHPYLVAGEDPATVHQALAATLDRALDEIAAIQRRARSGGPVERPRWPMIVLRTPKGWTGPREVDNTPVEGTYRAHQVPLSQVRSNPQHLAELERWLRSYHPEELFDATGAPVAELIALPPKGDRRMSANPVANGGQVLRDLVLPDFRDYAVDVPRPGEPVTSATGALGTWIRDVIAANPESFRLFGPDEVASNRLGAAFEVTDRAWVAETVPGDDHLSPDGRVMEVLSEHLCQGWLEGYLLTGRHGLFTSYEAFIHIVDSMVNQHAKWLKVTRGIPWRQPLASLNYLLSSHVWRQDHNGFSHQDPGFIDHVMNKKAEVVRVYLPPDGNTLLSTLNHCLRSRHYINVVVAGKQPTPNWLPMDEAILHCRRGIGIWGWASNDGDSEPDVVLACAGDVPTLETLAAADLLHQHLPDLKVRVVNVVDLMRLQPSSEHPHGLPDTEFDTIFTTDKPIIFAYHGYPWLIHRLTYRRTNHPNLHVRGYKEEGTTTTPFDMVMLNDLDRFHLVIDVIDRVPGLAARAAHLRQAMVDARQSCRDYTRAHGADDPRVAQWRWTRGTDADDSDDR

SEQ ID NO: 540 - protein, 729 aa, Micromonospora sp. ATCC 39149
MDTVVDLHGPLTDDELRRLDAYWRAANYLTVGQIYLLDNPLLREPLRPEHVKPRLLGHWGTGPGLNLVYAHLNRVIVNRKLPTIFITGPGHGGPALVANTWLEGTYSELYHSASRDETGMQQLFRQFSFPGGIPSHVAPEVPGSIHEGGELGYALSHAYGAAFDNPDLLVACVIGDGEAETGPLAGSWLSNVFLNPARDGAVLPILHLNGYKIANPTVLDRIPADDLLDMMRGFGYQPYVVAGDDPATVHQTLAATLDRAVDEIAGIQRRARSGAPVERPRWPMIILRTPKGWTGPTVVDGKQVEGTYRAHQVPIAEVRDNPEHLAELERWLRSYRPQELFDPTGAPVAELAALPPTGDLRMSANPVANGGRVLRDLDLPDFRRYAVDVKQPGAPAVGATGVLGAWVRDIITANPHTFRLFGPDEVASNRLGAAFEVTDRVFVADRVDGDEHLSPDGRVMEVLSEHLCQGWLEGYLLTGRHGIFTSYEAFIHIVDSMVNQHAKWLKVTRGIPWREPVASLNYLLSSHVWRQDHNGFSHQDPGFIDHVVNKKAEVVRVYLPPDGNTLLSTMDHCLRSRHYINVVVAGKQPAPNWLTMDEAIQHCRRGLGIWDWASTDDRREPDVVLGCAGDVPTMETLAAADLLRQRLPELKVRVVNVVDLMRLQPPSEHPHGLPDNEFDTIFTRDKPIIFAYHGYPWLIHRLTYRRASHDNLHVRGYKEEGTTTTPFDM

SEQ ID NO: 541 - protein, 790 aa, Mycobacterium smegmatis str. MC2 155
MSDATTSPALTDSELELLDAYWRAANYLSVGQIYLLDNPLLAEPLAAEHVKPRLLGHWGTTPGLNLIYAHLNRIIRERDANVIYITGPGHGGPGLVANAYLEGTYSEVYTGIGQDVDGMRKLFRQFSFPGGIPSHVAAETPGSIHEGGELGYALVHAYGAAFDNPDLVVACVVGDGEAETGPLAASWHSNKFLNPVTDGAVLPILHLNGYKIANPTVLSRIPQEELESLFLGYGYRPITVAGDDPANVHQQLAIAMDEAFDQIAAIQRAARLDDESGRPLWPMIIMRTPKGWTGPATVDGKKVEGTWRSHQVPLSETRTNPDHMAQLEEWLRSYRPHELFDGTGALRPELRALAPAGDRRMSANPHANGGLLLRDLDLPDFTDYAVPVDRPATTSVQATQVLGEFLRDVIARNPDRFRVMGPDETASNRLSAVFEATDKTWLAETGPDDEHLAPDGRVMEVLSEHLCQGWLEGYLLTGRHGLFSCYEAFVHIVDSMLNQHVKWLTSSAALTWRRPIASLNYLLTSHVWRQDHNGASHQDPGFIDHVANKRPEAVRVYLPPDANTLLSVADHCLRSRHYVNVVVAGKQPALSYLTMDEAIAHCTRGLGIWDWASSDTSGEPDVVLACAGDIPTLETLAAADILRRRLPDLKVRVVNVVDIMRLQPESEHPHGLSERDFDSVFTTDRPIIFAYHGYPWLIHRLTYRHANHAQLHVRGFKERGTTTTPFDMVMLNDLDRFHLVMDVIDRVEGLGTRAAALRQEMADARLAARRYTREHGEDDPAISEWTWQAD

SEQ ID NO: 542 - protein, 806 aa, Mycobacterium sp. MCS
MSETTLAPTLSDEELRLIDAYWRAANYLSVGQIYLLDNPLLREELRAEHVKPRLLGHWGTTPGLNLVYAHLNRIIRERDADVIYITGPGHGGPGLVANAYLEGTYSEVYSNIGEDADGLRKLFRQFSFPGGIPSHVASETPGSIHEGGELGYALVHAYGAAFDNPDLVVACVVGDGEAETGPLAASWHSNKFLDPVTDGAVLPILHLNSYKIANPTVLARIPQEELESLFYGYGYRPITVAGDDPDNVHQQMAAALDECFDQIAAIQRAARLDSEPGRPLWPMIILRTPKGWTGPREVDGKKVEGTWRSHQVPLSETHTNADHMAQLEQWLRSYRPEELFDDDGRLILEVKALAPEGTRRMSDNPHANGGLLLRDLDLPDFRDYAVPVEEPGSQSAEATRVLGTFLRDVIVRNQDRFRIMGPDETASNRLSPVFEATGKAWMAEISPDDENLEPSGRVMEVLSEHLCQGWLEGYLLTGRHGLFNCYEAFVHIVDSMLNQHAKWLSSSAHLSWRRPIASLNYLLTSHVWRQDHNGASHQDPGFIDHVANKRPEVVRVYLPPDANTLLSVADHCLRSRQYVNVIVAGKQPALTYLTMDEAVAHCTRGLGIWEWASTTTGEPDVVLACAGDIPTLETVAAADILRRRLPDLKVRVVNVVDIMRLQPESEHPHGLSDREFDSIFTTDKPVIFAYHGYPWLIHRLAYRHANHEQLHVRGFKERGTTTTPFDMVMLNDLDRFHLVMDVIDRVESLGTKAAGLRQEMADARLAARAYTREHGEDDPAISEWSWDSGYRADGTQSMAQDTGDNE

SEQ ID NO: 543 - protein, 800 aa, Mycobacterium kansasii ATCC 12478
MSPVSPETPTTATLSDDELARIDAYWRAANYLSVGQIYLLDNPLLAKPLSAEHVKPRLLGHWGTTPGLNLVYAHLNRVIRNRDANVIYVTGPGHGGPGLVANAYLEGTYSEVYTGIGEDAEGLRRLFRQFSFPGGIPSHVAAQTPGSIHEGGELGYALVHAFGAAFDNPDLVVACVIGDGEAETGPLAASWHSNKFLNPAIDGAVLPILHLNGYKIANPTVLARIPHDELASLLRGYGYRPIAVSGDDPLRVHRQLAGALDDAFDDIAAIQHAARSGENSARPVWPMIVLRTPKGWTGPKVVDGMKVEGTWRSHQVPLADTHDSAERRRQLEEWLRSYRPDELFDDNGTLRAELRALAPTGDRRMSANPHANGGLLLRDLDLPDFRDYAVPVARPACETHEATRVLGTYLRDVIRRNPDRFRLMGPDETASNRLSAVFEATGRTWLSETSADDDHLSAAGRVMEVLSEHLCQGWLEGYLLTGRHGMFDCYEAFVHIVDSMFNQHTKWLSTSRELPWRRPIASLNYLLSSHVWRQDHNGASHQDPGFIDLVANKRPEVVRVYLPPDGNTLLSVADHCLRSRDYVNVIVAGKQPALSYLAMDEAVAHCTRGLGIWQWASTATGEPDVVLACAGDVPTLETLAAADILRRELPGLGVRVVNVVDIMRLQPESEHPHGLADKEFDAVFTRDKPVIFAYHGYPWLIHRLAYRRANHPRIHVRGFKERGTTTTPFDMVMLNDLDRFHLVMDVIDRVDGLASRAAVLRQRMADARLSARLYTREHGADDPRIAGWAWESSERNERSG

SEQ ID NO: 544 - protein, 800 aa, Mycobacterium marinum M
MSPENRATSEPAPLSDDDLALIDAYWRAANYLSVGQIYLLSNPLLAEPLVPTHVKPRLLGHWGTTPGLNLIYAHLNRIIRERDANVIYVTGPGHGGPGLVANAYLEGTYSEVYSAIAENTDGMRRLFRQFSFPGGIPSHVAAQTPGSIHEGGELGYALVHAYGAAFDNPDLVVACVVGDGEAETGPLATSWHSNKFLNPAIDGAVLPILHLNGYKIANPTVLARIPHDELESLLRGYGYRPITVAGDDPPRVHQQLAGALDEAFDEIAAIQLAARTGGDIKRPVWPMIVLRTPKGWTGPKVVDGKKVEGTWRSHQVPLADTHDNAQHRDQLEEWLRSYRPHELFDDHGKLRAQLRAMAPSGNRRMSANPHANGGLLLRDLDLPDFRDYAVQVNSPGTEIHEATRVLGTFLRDVIRRNPDRFRLMGPDETASNRLSAVFEATGRTWLSETTADDDHLSAEGRVMEVLSEHLCQGWLEGYLLTGRHGMFDCYEAFVHIVDSMFNQHTKWLSTSRELPWRRPIASLNYLLSSHVWRQDHNGASHQDPGFIDLVANKRPEVVRVYLPPDGNTLLSVADHCLRSRNYVNVIVAGKQPALAYLDMDEAIAHCTRGLGIWQWASTASGEPDVVLACAGDIPTLETLAAADILRRELPDLGVRVVNIVDIMRLQPESEHPHGLPDREFDALFTRDKPVIFAYHGYPWLIHRLAYRRANHARIHVRGFKERGTTTTPFDMVMLNDLDRFHLVIDVIDRVVGLSSRAAVLRQRMADARLAARQYTREHGEDDPRIADWAWEPSEQSELGE

SEQ ID NO: 545 - protein, 804 aa, Mycobacterium avium subsp. paratuberculosis K-10
MSLETSTTTPAGSPLSDRELDLIDKYWRAANYLSVGQIYLLDNPLLKEPLSAEHVKPRLLGHWGTTPGLNLVYAHLNRIIRNRDADVIYVTGPGHGGPGLVANAYLEGTYSEVYTGIEEDAEGLRKLFRQFSFPGGIPSHVAAQTPGSIHEGGELGYALVHAYGAAFDNPYLVVACVIGDGEAETGPLAAGWHSNKFLNPVTDGAVLPILALNGYKIANPTVLARIPHTELEALLRGYGYRPITVAGDDPTDVHRQLAAALDEAFDGIAAIQGAARGGGEVQRPVWPMIVLRTPKGWTGPKVVDGKRVEGTWRSHQVPLAETHDNPEHRAQLEEWLRSYGPEQLFDDDGRLRAELRALAPTGDRRMSANPHANGGLLLHDLDLPDFRDYAVPVSRPGSVTHEATRVLGTFLRDVIARNKDRFRMMGPDETASNRLDAVYGATEKVWLSATEPDDEHLAPDGRVMEVLSEHLCQGWLEGYLLTGRHGLFNCYEAFVHIVDSMLNQHAKWLATSRELPWRRPIASLNYLLTSHVWRQDHNGASHQDPGFIDLVANKRAELTRVYLPPDGNTLLSVADHCLRSRDYINVIVAGKQPALAYLDMDAAIAHCTRGLGIWDWASTARSIGAEPDVVLACAGDIPTLETLAAADILRRELPDLAVRVVNVVDLMRLQPDSEHPHGLPDREFDALFTRDRPVIFAYHGYPWLIHRLTYRRANHAQLHVRGFKERGTTTTPFDMVMLNDLDRFHLVIDVLDRVEGLASRAAMLRQRMVDARLAARMYTREHGEDDPAIANWTWEPSERNSRSE

SEQ ID NO: 546 - protein, 787 aa, Mycobacterium intracellulare ATCC 13950
MTHATALSDDELALIDKYWRAANYLSVGQIYLLDNPLLTEPLTIDHVKPRLLGHWGTTPGLNLVYAHLNRVIRHRDADVIYVTGPGHGGPGLVANAYLEGTYSEVYTGIEEDTEGLRKLFRQFSFPGGIPSHVAAQTPGSIHEGGELGYALVHAYGAALDNPYLVVACVVGDGEAETGPLAASWHSNKFLNPVTDGAVLPILALNGYKIANPTVLARIPHAELESLLRGYGYRPITVAGDDPADVHRQLAAALDDAFDDIAAIQSAARGGNGVERPVWPMIVLRTPKGWTGPKMVDGKKVEGTWRSHQVPLAATRDNPEHRAQLEEWLRSYGPGELFDENGRLRPELRALAPSGDRRMSANPHANGGLLLHDLDLPDFRDYAVAVERPAAVTHEATRVLGGFLRDVIARNKDRFRLMGPDETASNRLDAVYGSTDKVWLSEIEPDDEHLAPDGRVMEVLSEHLCQGWLEGYLLTGRHGLFNCYEAFVHIVDSMLNQHAKWLATSRELPWRRPIASLNYLLSSHVWRQDHNGASHQDPGFIDLVANKRPELTRVYLPPDGNTLLSVADHCLRSRDYINVIVAGKQPALAYLDMDEAVAHCTRGLGIWEWASTATDDPDVVLACAGDIPTLETLAAADILRSELPELAVRVVNVVDLMRLQPDTEHPHGLPDREFDALFTPDRPVIFAYHGYPWLIHRLTYSRTNHAHMHVRGFKERGTTTTPFDMVMLNDLDRFHLVMDVIDRVDGLASRAAMLRQRMVDARLAARMYTREHGEDDPKISGWTWGPSD

SEQ ID NO: 547 - protein, 806 aa, Mycobacterium abscessus
MNTALSVTDSQIPTYPRPLSAEEVRQIDAYWRAANYLSVGQIYLLDNPLLRDPLTASHIKPRLLGHWGTTPGLNIIYAHLNRIIRQRDTNVMLVTGPGHGGPGVVANTYLEGSYSRFYAHIGQDLDGLRKLFRQFSFPGGIPSHTAPETPGSIHEGGELGYALAHAYGAALDNPDLVVACVIGDGEAETGPLAASWHSNKFVNPATDGAVLPILHLNGYKIANPTVLARIPEDDLTALLTGYGHDPRIVVGDDPAEVHQQLAAACDWAFDRISHIQQEARQERAAHLPRWPLIVLRTPKGWTGPKMVEGVPVEGTWRSHQVPLAECRTNPSQLMQLANWMHSYRPEELFDDRGVLRPEVAGLAPRTEKAIGSNPHANGGLLIRELDLPEVDQYAVPVGSPGAMTAEATKVLGAYLRDVIDLNPNNFRLMGPDETASNRLSTVYERTDKVWLERSETTDEHLGPEGRVMEVLSEHLCQGWLEGYLLTGRHGLFNCYEAFAHIVDSMLNQHAKWLSSSSEVPWRQPIPSLNYLLTSHVWRQDHNGASHQDPGFIDHVANKRPEVVRVYLPPDANTLLAVTDHCLRSRHCVNVVVAGKQPALTYLSMEAARAHCARGLGIWDWASNAPNEPDVVLACAGDVPTLETLAAADILRRRLPELAVRVINIVDIMRLQPASEHPHGLPHTDFDALFTPDKPIIFAYHGYPWLIHRLAYRHTNHDRMHVRGFKDRGTTTTPFDMVMLNDLDRFHLVMDVIDRVEGLGSRAANLRQEMVDDRIAACRYTREHGRDDPVIADWVWEHELGSLSGSR

SEQ ID NO: 548 - protein, 797 aa, Janibacter sp. HTCC2649
MNVGGMTTLAPAPAAALTDLEGVDSWWRAANYLSVGQIYLRDNPLLREPLAAEHIKPRLLGHWGTSPGLNLLWAHLNRAIRRHAAPTVFIAGPGHGGPAVVANAYLDGTYSDLFPSITGDTAGLTRLFRQFSSPGGIPSHASPHTPGSLHEGGELGYSLAHAYGVAFDNPDLTVACVIGDGEAETGALSASWQSTAFINPARDGAVLPILHLNGYKIANPTVLARQPESVLRSLLIGHGHDPLFVEGDDPVAVHEALADALDTAYLRLAELRGTGAGHPLQWPMIVLRTPKGWTGPATVDGHTVEGSFRSHQVPIAAPRTNPEHLRLLEDWLRSYRPEELFDEVGAVRAEIRALAPAPELRMSASVHANGGVVLRDLVLPAHRDYQVPVGEPARELRSATGALGPWLRDVVRDNPHNFRVMGPDETASNRLQAIFEQSGRAWALPIRAGDDHLDVDGRVMEVLSEHLCQGWLEGYLLSGRHGLFNCYEAFIPIVDSMLNQHAKWLKVSAEVPWRRPIASLNYLLTSHVWRQDHNGFSHQDPGFLDHVVNKKAQTVRVYLPPDANTLLSVAEHCLRSRSLINVIVAGKQPALTFLDPVQADAHCARGLGLWEWASTDGGANPDVVLACAGDVPTLEILAAADILRHRLPDLRVRVVNVVDLMRLEPDSEHPHGLSDRDFDALFPPDCPVIFAFHGYPGLIHRLTYRRHAHPQIHVRGYKEEGTTTTPFDMVMLNDLDRFHLVMDVIDRVPQLSEVSAGLRQEMADARLAARDYTRVHGEDHPAIANWSWPATSTSVQE

SEQ ID NO: 549 - protein, 792 aa, Thermobifida fusca YX
MTSTESVPRQALTVTELQEIDRYWRAANYLSVGQIYLQDNPLLREPLVPEHIKPRLLGHWGTTPGLNFIYAHLNHQIRSRGTEMMWIVGPGHGGPSPVATAWLDGVYSQIYPDVGRNAEGMRRLFRQFSFPGGVPSHAAPETPGSIHEGGELGYALAHAFGAAFDNPDLVVAAVVGDGEAETGALSGSWQSIRFLNPARDGAVLPILHLNGYKIAGPTVLARIPEEDLLAQMRGHGYEPHVVAGDDPDTVHQLMAGTLASCLERIDTIRFRARQEDGDIANVRWPMIILRTPKGWTGPRAVDGKPVEDTWRSHQVPLAATRENPEHLRLLEEWLRSYRPEELFDEHGAPRPETTTVVPPPDCRISSSPHANGGLLLRDLLLPDFRDYAVEVERPGVDMVEATRVLGGFLRDVVAANPHNFRIMGPDETQSNRLGAVFESTDRAWTTERLPVDQQLSPDGRVMEVLNEQLCQGWLEGYLLTGRHGLFNSYEAFIHIVDSMVNQHAKWLKVSRELPWRRPISSLNYLLSSHVWRQDHNGFSHQDPGFIDHVVNKKPEIIRVYLPPDCNTLLCTMDHCLRSRNFINVVIAGKQPQLTYLPMEAAIAHCTRGAGIWEWASSDEGAEPDVVLACAGDVPTLETLAAADLLRRHLPELRVRVVNVVDLMRLSNEGEHPHAMTDREYDTLFTRDKPVIFAFHGYPWLIHRLTYRRAGHPNLHVRGYKEEGTTTTPFDMVMLNDLDRFHLVMDVIDRVPGLGVRAAGLRQHMQDERLRCRAYTRQYGEDAPDIRNWVWEP

SEQ ID NO: 550 - protein, 792 aa, Thermomonospora curvata DSM 43183
MTDTAVPVHPTAPTDAEVRLLDAHWRAANYLSAGQIYLLDNPLLREPLQPGHIKPRLLGHWGTTPGLNFCYTHLNRVIRTRDQNMIYIMGPGHGGPAAVANAWLEGTYSEVYPEVSWDETGMARLFRQFSFPGGVPSHVAPETPGSIHEGGELGYALVHAFGAAFDNPDLVVACIVGDGEAETGPLAAAWHSNKFLDPVRDGAVLPILHLNGYKIANPTVPARIPERELLALFEGYGYRPYVVAGDDPAVMHRKMAETLDRVMDEITAIQRNAREGGNKGRPRWPMIILRTPKGWTGPKEVDGVPVEGTWRSHQVPLPGVRENPEHLALLERWLRSYRPWELFDGTGRPVPQVLAQTPRGERRMSANPHANGGLLLRPLRLPDFRDYAVPVDRPATTFAEPTRVLGALLRDVIAANPDNFRIMGPDETASNRLNAVFEVTDRTWQAERLPTDDHLAPSGRVMEVLSEHLCQGWLEGYLLTGRHGLFNCYEAFIHIVDSMFNQHAKWLKVTRALPWRRPIASLNYLLSSHVWRQDHNGFTHQDPGFLDVVMNKKPEIIRVYLPPDANTLLAVTDGCLRSRDCINVIVAGKQPVLNLLPMDDAVVHCARGIGIWEWAGTDAGAEPDVVLACAGDVPTLETLAAADLLRRHLPQLRVRVVNVVDLMRLQPPTEHPHGLTDPEFDALFTTDKPIIFAFHGYPYLIHRLTYRRHGHGNLHVRGYKEEGTTTTPFDMVMMNDLDRFHLVMDVIDRVPGLGVRAGHVRQLMADERIRHRAYTREHGEDPADITEWVWPH

SEQ ID NO: 551 - protein, 771 aa, Streptosporangium roseum DSM 43021
MDALAHVDAYWRAANYLSVGQIYLLDNPLLAEPLAPEHIKPRLLGHWGTTPGLNFCFAHLNRIITERDQDMIYIVGPGHGGPAAVAHAWLEGSYTEKYPDIGQDAVGMQRLFRQFSFPGGIPSHVAPEVPGSIHEGGELGYSLAHAYGAAFDNPHLVVACVIGDGEAETGPLAAGWHSGKFLNREHDGVVLPILHLNGYKIANPTVLARIPEEELVKLIEGYGYRPHIVSGDDPAVMHGLMAETLEVVFDEIAEFKDGRAERPPMIVLRTPKGWTGPREVDGLPVEGTWRAHQVPLSAVRQNAEHRAMLEEWMRSYRPAELFDDRGRPVAEILRTVPQGPRRMSANPHANGGELLKPLALPDFRDHAVEVKAPAAQSSEPTKVLGQFLRDVIAANPDNFRLMGPDETASNRLSAVFEVTDRVWDAETLPTDENLGPDGRVMEVLSEHLCQGWLEGYLLTGRHGLFNCYEAFIHIVDSMFNQHAKWLESSHKITWRRPVASLNYLLSSHVWRQDHNGFSHQDPGFIDVVMNKKASVVRIYLPPDANTLLSVGDHCLRSRDYVNLVVAGKQPVLDLFTMEEAIAHCTRGLGILEWASTDAGAEPDVVLACAGDVPTLETLAAAALLREHLPELKVRVVNVVDLMRLQPPSEHPHGMSDAEFDTLFTADKPIIFNFHGYPWSIHRLTYRRRGHHNIHVRGYKEEGTTTTPFDMVMLNDIDRFHLVMDVVDRVPGLGAKAAHLRQQMVDERLRARAHTREYGEDPAEIRDWTWPY

SEQ ID NO: 552 - protein, 782 aa, Nocardiopsis dassonvillei subsp. dassonvillei DSM 43111
MALQEDELRGVDAYWRAANYLSVGQIYLLDNPLLREELRPEHIKPRLLGHWGTTPGLNFCYAHLNRAIRDRDLEMMYVMGPGHGGPAAVANAWLEGTYSEVYRHVNQDVEGMRRLFRQFSFPGGVPSHVAPETPGSIHEGGELGYSLAHAQGAAFDNPDLVVACVVGDGEAETGPLAGSWRGNAFLDPVHDGAVLPILHLNGYKIANPTVLARIPERELLSYFEGLGYRPLLVSGEDPEYMHRRMAEAVDEALEEIARIQHRARVSGVRGRAVWPVVILRSPKGWTGPAEVDGVPVEGTWRSHQVPLGQVRSDEGHLRQLEEWMRSYRPEELFEESGAPVAEVRAQAPEGERRMSASPHANGGVLRRELVLPDFRGYAVDVGRNGTQTGEATRVLGRFLRDVIRSNPRTFRLMGPDETASNRLDAVFEASDKEWQAERLATDEHLGPGGRVMEVLSEHLCQGWLEGYLLTGRHGLFGCYEAFVHIVDSMFNQHAKWLKVSRDLPWRRPISSLNYLLTSHVWRQDHNGFTHQDPGFLDVVLNKPAEVVRVYLPPDANTLLSVADHCLRSSDYVNVVVAGKQPGLGYLSMEEAVAHCARGIGIWEWASTDGGADPDVVLACAGDVPTLEVLAAADLVRRWLPGVRVRVVNVVDLMRLLPDSDHPHGLPDAEYDALFTTDKPVVFAFHGYPWLVHRLTYRRAGHANLHVRGYRERGTTTTPFDMVMLNDLDRFHLVMDVIDRVPGLGQRSAQVRQRMVDERLRHRAHTREFGEDPAEIREWVWRY

SEQ ID NO: 553 - protein, 798 aa, Stackebrandtia nassauensis DSM 44728
MSKLEQLEQPALTDDELAAVDAYWRAANYLSVGQIYLLDNPLLTEPLRPEHIKPRLLGHWGTTPGLNFCYAHLNRAIKALDLDMMFVTGPGHGGPALLANSWLEGSYSQAYPAVARDGKGMRTLFRQFSFPGGVPSHVAPEVPGSIHEGGELGYSLAHAYGAAFDNPDLIVACVVGDGEAETGPLATSWHANKFCDPVGDGAVLPILHLNGYKIANPTVLARIPRDELDALLRGYGHKPYYVEGHDPEAMHQAMAEVVDAAIADIRAIQRQARDGGPSRRPRWPMVVLRTPKGWTGPGSVDGVPVEGTWRSHQVPLSGVRDNPDHLRQLEEWLRSYRPGELFDGDGAPVARLGELVPDGQRRMGANPHANGGLLLRDLELPDFRDYAVAVDQPGVTSSEPTRVLGRFLRDVLRDNADTANFRLFGPDETASNRLDAVYEVTGKAWQSPIVDTDENLSAHGRVVEVLSEHVCQGWLEGYLLTGRHGLLSCYEAFVHIVDSMFNQHAKWLKVSRGLPWRRPVASLNYLLTSHVWRQDHNGFSHQDPGFIDHVVNKKADIIRVYLPPDTNTLLSVGDHVLRSKNYVNVIVAGKNDSPNWLSVDEAVLHCARGAGIWDWAGTEAEGEEPDVVLGCAGDAPTLEVLAAASLLRRHLPSLRVRVVNVVDLMRLQSATEHPHGMTDREYDTLFTADRPVIFAYHGYPWLIHRLTYRRNGHDNLHVRGYKEEGTTTTPFDMLVLNDMDRFQLVTDVIDRVPGLGRRAAGVRQSMQDNRTRHRYWVRQHGEDLPEVRDWEWSDGRTG

SEQ ID NO: 554 - protein, 789 aa, Actinosynnema mirum DSM 43827
MSAQTGTTGADLKLIDAYWRAANYLSAGQIYLLDNPLLGTPLEAANIKPRLLGHWGTTPGLNFVYAHLNRVIKQREAEVLFITGPGHGGPALLANTWLEGTYSETYAEVPQDARGMAKLFRQFSFPGGVPSHVAPEVPGSIHEGGELGYSLAHAFGAAFDNPDLVVACVIGDGEAETGPLAASWHANKFLNPAQDGAVLPILHLNGYKIANPALLARIPHEELDSLLRGYGYAPVYVEGHEPEVMHAAMAEALDGVFDAIERIQARARSGEDTTRPAWPMIVLRSPKGWTGPSEVDGLQIEGTWRAHQVPLSGVRDNPEHLRMLEQWLRSYRPEELFDANGAPVPELGELVPPGHLRMGATPHANGGTLLRDLRMPALSEHAVAVPEHGGSTSEPTRVLGRLLRDVVELNDAQRNFRLFGPDETASNRLDAVYEVTGKQWQGETLPVDDHLVRAGRVVEVLSEHLCQGFLEGYLLTGRHGLFNCYEAFTHIVDSMFNQHAKWLGTHRKLGWRRPIASLNYLLSSHVWRQDHNGFSHQDPGFIDHVMNKKAEVVRVYLPPDTNTLLSVADHCLRSRDHVNVVVAGKNQTPDWLGPQEAALHCARGLGIWEWAGNDDGVEEPDVVMACAGDAPTVEVMAAVSLLREHLPSLRVRVVNVVDLMRLQPESEHPHGLSDHEFDAIFTTDRPVLFAYHGYPWLIHRLTYRRTNHNNIHVRGYKEEGTTTTPFDMLVLNDMDRYRLVMDVIDRVPGLGPRTARLRQLMTDQRTRHNAWIREHGEDLPEVRDWSWRS

SEQ ID NO: 555 - protein, 817 aa, Streptomyces coelicolor A3(2)
MCTGTPCPRAPTGCPDTEGPPMSVDTQQAPPEPTDEELAGLDAHWRAANYLAVGQIYLMANPLLTDPLRPEHVKPRLLGHWGTSPGLNLVHTHLNRVIKARDLDALCVWGPGHGGPAVLANAWLEGSYTETYPDITRDAAGMARLFKQFSFPGGVPSHVAPETPGSIHEGGELGYALSHAYGAAFDHPDLVVACVIGDGEAETGPLATSWHSNKFLDPVHDGAVLPILHLNGYKIANPTVLARLPETELDELLRGYGHDPVHVTGDDPAAVHRATARAMDTALDRIAAIQRAAREEGATGRPRWPMIVLRTPKGWTGPAEVDGLPVENTWRAHQVPLSAVRTNPEHLAQLERWLRSYRPEELFDDAGAPRPAVLAAIPEGPRRLGATPYANGGLLLRELPVPPLEKYAVPVGEPGASTHEPTRVLGDLLRDVMAATTDRRDFRLVGPDETASNRLQAVYAATGKAWQERTLPVDEDLDRHGRVMEILSEHTCQGWLEGYLLTGRHGLFSCYEAFVHIVDSMVNQHVKWLRVTRRLPWRAPIASLNYLLTSHVWRQDHNGFSHQEPGFVDHILNKSPEAVRVYLPPDANTLLSVADHALRSRDYVNVIVAGKQPCFDWLTMDQAKAHCARGAGIWDWAGTEDGSREPDVVLACAGDVPTLEILAAAQLIRHHLPELAVRVVNVVDIARLLPSGEHPHGMSDFEYDGLFTADKPVIFAYHGYPWLIHRLAYRRTGHAHLHVRGYKEIGTTTTPFDMVVGNDLDRYRLVMDVIDRVPGLAVRAAAVRQRMEDARQRHHDWIREHGVDLPEVADWTWEAPR

SEQ ID NO: 556 - protein, 834 aa, Streptomyces ambofaciens ATCC 23877
MTRTALSGTRALRSGLGWARGTPVHAGPTAVPKRKGPRMSVDTQQAPAELTDEELAGLDAHWRAANYLSVGQIYLMANPLLTEPLRPEHVKPRLLGHWGTSPGLNLVHTHLNRVIKARELDALCVWGPGHGGPAVLANAWLEGSYTETYPDVTRDAAGMARLFKQFSFPGGVPSHVAPETPGSIHEGGELGYALSHAYGAAFDHPGLVVACVIGDGEAETGPLATSWHSNKFLDPVEDGAVLPILHLNGYKIANPTVLARLPESELDELLRGYGHDPLYVTGDEPAAVHRAMARAMDTALDRIAALQRAAREQGAGERPRWPMIVLRTPKGWTGPAEVDGLPVENTWRAHQVPLSAVRTDPDHLRQLEQWLRSYRPEELFDDAGGPRPSVLACVPAGARRLGATPFANGGLLLRELPLPPLEKYAVPVERPGASAHEPTRVLGDLLRDVMDATADRRDFRLVGPDETASNRLQAVYAASGKAWQERTLPVDEDLDRHGRVMEILSEHTCQGWLEGYLLTGRHGLFSCYEAFVHIVDSMVNQHIKWLRVTRRLPWRAPIASLNYLLTSHVWRQDHNGFSHQDPGFVDHILNKSPEAVRVYLPPDANTLLSVADHALRSRDYVNVIVAGKQPCFDWLSMEEARVHCARGAGIWEWAGTEDGSREPDVVLACAGDVPTQEVLAAAQLIRRHLPDLAVRVVNVVDIARLLPSGEHPHGMSDFEYDGLFTADKPVVFAYHGYPWLIHRLAYRRTGHAHLHVRGYKEIGTTTTPFDMVLGNDMDRYRLVMDVIDRVPGLAVRAAAVRQRMEDTRLRHHDWIREHGVDLPEVADWSWDGSP

SEQ ID NO: 557 - protein, 794 aa, Streptomyces griseoflavus Tu4000
MSVDTHQASAPPTDEELRTLDAHWRAANYLSVGQIYLMANPLLTEPLRPEHIKPRLLGHWGTSPGLNLVHTHLNRVVRSRGLDALCVWGPGHGGPAVVANSWLEGSYTETYPDVTRDEAGMARLFKQFSFPGGVPSHVAPETPGSIHEGGELGYSLSHAYGAAFDNPGLLVTCVIGDGEAETGPLAASWHSNKFLDPVHDGAVLPVLHLNGYKIANPTVLARLPEQELRALLEGYGHEPLYVTGDDPAAVHRTMAAAMDTALDRIAAIQRAAREEGATERPRWPVIVLRTPKGWTGPAEVDGLPVEGTWRSHQVPLSAVRDDPEHLRQLEQWLRSYRPGELFDEAGAPRPDVLACVPDGPRRLGATPYANGGRLLRQLPLPPLEQYAVPVDQPGTTLHEPTRVLGGLLENVMRGTAGRRDFRLVGPDETASNRLQAVYAASGKAWQAGILDVDEDLDRHGRVMEILSEHTCQGWLEGYLLTGRHGLFSCYEAFVHIVDSMVNQHIKWLRVSRRLPWRAPIASLNYLLTSHVWRQDHNGFSHQDPGFVDHILNKSPEAVRVYLPPDANTLLSVADHALRSRDYVNVIVAGKQPCFDWLTMEQAEAHCARGAGVWQWAGTETGDREPDVVLAAAGDVPTQEVLAAAQLLRGRLPDLAVRVVNVVDIARLLPSEEHPHGMTDFEYDGLFTRDKPVIFAYHGYPWLIHRLAYRRTGHRNLHVRGYKEVGTTTTPFDMVVRNDLDRYRLVMDVVDRVPGLAVRGANLRQEMADTRLRHHDWIRAHGTDLPEVAEWSWHG

SEQ ID NO: 558 - protein, 812 aa, Streptomyces sviceus ATCC 29083
MINLLREGFVMPLGPNTETSLDTPDTPDPLDEEELSALDAHWRAANYLAVGQIYLMANPLLTEPLAPEHVKPRLLGHWGTSPGLNLVHTHLNRVVKARNLDAICVWGPGHGGPAVVANSWLEGSYTETYPDITRDTAGMARLFRQFSFPGGIPSHVAPETPGSIHEGGELGYSLSHAYGAAFDNPGLLVACVIGDGEAETGPLAASWHSNKFLDPVRDGAVLPILHLNGYKIANPTVLARIPEPELDSLLRGYGHEPLHVTGDDPHTVHQTMARAMDEALDRIAAFQHAARTEGAAERPRWPVIVLRTPKGWTGPAEVDGLPVEGTWRAHQVPLPAVRENPDHLRQLERWLRSYRPEELFDEHGSPREQVLACVPDGAHRLGANPHTNGGLLLRDLPVPSLERFAVPVDKPGATAHEPTRVLGDLLAQVMADTGERRDFRLVGPDETASNRLQAVYEASGKAWEAQVLSTDEHLERGGRVMEILSEHTCQGWLEGYLLTGRHGLFSCYEAFVHIVDSMANQHIKWLRVARRLPWRRPIASLNYLLTSHVWRQDNNGFSHQDPGFVDHVLNKSPEVVRVYYPPDANTLLCVSDHVLRSRDYVNVVVAGKQPCFDWLDLDAARAHCARGAGIWDWAGTETDLGEPDVVLACAGDVPTLEVLAAASLLRSHLPDLAVRVVNVVDIARLLPMEEHPHGMPDSEYDALFTPDKPVVFAYHGYPWLIHRLAYRRANHPHLHVRGYKEEGTTTTPFDMVVRNDLDRYRLVMDVIDRVPGLAVRAAALRQRMVDVRYRHHDWIRAHGADLPEVAEWTWSQ

SEQ ID NO: 559 - protein, 792 aa, Streptomyces scabiei 87.22
MTQVEHQNVTVLSDDELRTLDAHWRAANYLAAGQIYLRANPLLTEPLLPEHIKPRLLGHWGTSPGLNLVYTHLNRVISARDLDALCVWGPGHGGPSVLAGSWLDGSYSETYPDVTRDAPGMARLFRQFSFPGGVPSHVAPEVPGSIHEGGELGYSLAHAYGAAFDNPGLLVTCVIGDGEAETGPLAASWHSNKFLDPVHDGAVLPILHLNGYKIANPTVLSRLPQAELDALLRGYGHTPLHVTGDDPATVHRALAHAFDEALDRIARLQRTAREDGVAERAHWPMIVLRTPKGWTGPAEVDGLPVEGTWRAHQVPLAGVRENPEHLRQLETWLRSYRPQELFGPDGRPVADVLAHIPSGTRRLGATPHANGGLLLRDLPIRPLDDFAVPVDKPGTTLHEPTRVLGDLLARIMRDTRSRRDFRVVGPDETASNRLQAVFDASGKAWQAEHLPVDEHLDRHGRVLEILSEHLCQGWLEGYLLTGRHGLFSCYEAFVHIVDSMVNQHIKWLRTSRELSWRAPVASLTYLLTSHVWRQDHNGFSHQDPGFVDHVLNKSPEVVRVYLPPDANTLLSVADHALRSRDLVNVIVAGKQPCFDWLSMDQARAHCARGAGIWEWAGSENGGEPDVVLACAGDVPTQEILAAAQLLRRHLPQLAVRVVNVVDMTRLLPREEHPHGMSDFEYDGLFTTDKPVIFAYHGYPWLVHRLAYRRTGHRNLHVRGYKESGTTTTPFDMVVRNDLDRYRLVMDVIDRVPGLAVRAAAVRQQMADTRTRHHAWIREHGTDLPEVADWHWA

SEQ ID NO: 560 - protein, 793 aa, Streptomyces avermitilis MA-4680
MPQVEHQNSTVLTDDELRTLDAHWRAANYLAAGQIYLLANALLTEPLSPAHIKPRLLGHWGTSPGLNLVHTHLNRVIKARDLDALCVWGPGHGGPAVLANSWLEGSYSETYPDISRDAAGMGKLFRQFSFPGGVPSHVAPETPGSIHEGGELGYSLAHAYGAAFDNPDLLVACVIGDGEAETGPLAASWHSNKFLDPVHDGAVLPILHLNGYKIANPTVLSRIPEPELDELLRGYGHEPLHVTGDDPHQVHRALAEAFDRALDRVALMQRTAREEGATERIRWPMIVLRTPKGWTGPAEVDGRPVEGTWRAHQVPLPEVRENPEHLRQLEGWLRSYRPEELFDADGRPTADVLACVPHGARRLGATPHANGGLLLRPLPIPPLDRFAVAVDKPGATLHEPTRVLGDLLEQVMKDTSARRDFRLVGPDETASNRLDAVFDASGKAWQAQTLPVDEHLDRHGRVMEILSEHTCQGWLEGYLLTGRHGLFSCYEAFVHIVDSMVNQHIKWLKTSRELAWRAPIASLNYLLTSHVWRQDHNGFSHQDPGFVDHVLNKSPEAVRVYLPPDANTLLSVADHVLRSRDYVNVVVAGKQPCFDWLSMEQARAHCARGAGIWEWAGTQNDGEPDVVLACAGDVPTQEVLAASALLRRHLPALAVRVVNVVDMTRLLPREAHPHGMSDFEYDGLFTTDKPVIFAYHGYPWLIHRLAYSRTGHGNLHVRGYKEMGTTTTPFDMVVRNDLDRYRLVMDVVDRVPGLGVRAAAVRQTMADARTRHHAWIREHGTDLPEVANWTWEA

SEQ ID NO: 561 - protein, 792 aa, Streptomyces ghanaensis ATCC 14672
MPEAPDTRTVLSDEELRTLDAHWRAANYLAAGQIYLLANPLLTEPLRPEHIKPRLLGHWGTSPGLNLVYTHLNRVIAGRGLDALCIWGPGHGGPSVLANSWLEGSYGETYPDVGRDAAGMERLFRQFSFPGGVPSHVAPEVPGSVHEGGELGYSLAHAYGAALDHPGLLVACVIGDGEAETGPLAASWHSNKFLDPVHDGAVLPILHLNGYKIANPTVLARLPEDELDSLLRGYGHEPIHVSGDDPAAVHRAMAHAMDTALDRIAEVQRAAREDGVTERARTPVIVLRTPKGWTGPAEVDGKPVEGTWRAHQVPLAGVRDNPEHLRQLEAWLRSYRPEELFDDAGRPVADVLACLPEGDRRLGSTPYANGGLLVRELPMPALDDFAVPVDKPGTTLHEPTRILGGLLERIMRDTADRRDFRLVGPDETASNRLEAVYDASGKAWQAGTLDVDEHLDRHGRVMEVLSEHLCQGWLEGYLLTGRHGLFSCYEAFVHIVDSMVNQHIKWLKTSRELPWRAPIASLNYLLTSHVWRQDHNGFSHQDPGFVDHVLNKSPEVVRVYLPPDANTLLSVADHALRSRDYVNVVVAGKQPCFDWLSIDEARVHCARGAGIWEWAGTENGGAPDVVLACAGDVPTQEVLAAAQLLRRHLPELAVRVVNVVDIARLMPREEHPHGMTDFEYDGLFTADKPVIFAYHGYPWLIHRLAYRRNGHPNLHVRGYKESGTTTTPFDMVVRNDLDRYRLVMDVIDRVPGLAVRAAAVRQRMADARTRHHAWIREHGTDLPEVAEWSWNA

SEQ ID NO: 562 - protein, 795 aa, Streptomyces viridochromogenes DSM 40736
MPEAQRQHSSTAPTDEELRTLDAHWRAANYLAAGQIYLLANPLLTEPLRPEHIKPRLLGHWGTSPGLNLVHTHLNRVIKARDLDALCIWGPGHGGPSVLANSWLEGSYGEKYPDVTRDAQGMELLLRQFSFPGGVPSHIAPEVPGSIHEGGELGYSLAHAYGAALDHPGLLVACVIGDGEAETGPLAGSWHANKFLDPVHDGAVLPILHLNGYKIANPTVLSRLPEAELDALLRGYGHEPIHVGGDDPATVHRAMAQAMDTALDRIAEAQHAAREEGVTERPHWPVIVLRTPKGWTGPAEVDGEPVEGTWRSHQVPLAEVRDNPEHLRQLEAWLRSYRPEELFDAEGRPVADVLACVPEGTKRLGATPYANGGLLVRDLPVPSLDDFAVPVDKPGTTTHEPTRVLGDLLARVMRDTATRRDFRLVGPDETASNRLQAVYDASGKAWQAGTLPEDEHLDRHGRVMEVLSEHLCQGWLEGYLLTGRHGLFSCYEAFVHIVDSMVNQHIKWLRTSRRLPWRAPIASLNYLLTSHVWRQDHNGFSHQDPGFVDHVLNKSPEVVRVYLPPDANTLLSVADHALRSRDYVNVIVAGKQPCFDWLSMDEARVHCARGAGIWDWAGTEDGLREPDVVLACAGDVPTQEVLAAAHLLRRHLPELAVRVVNVVDLARLLPEKEHPHGMNDFEYDGLFTTDKPVIFAYHGYPWLIHRLAYRRAGHQNLHVRGYKESGTTTTPFDMVVRNDLDRYRLVMDVIDRVPGLAVRATAVRQRMADARTRHHAWIRERGTDLPEVAEWTWNA

SEQ ID NO: 563 - protein, 797 aa, Streptomyces hygroscopicus ATCC 53653
MADAATTAPNDLTEHELHALDAHWRAANYLAAGQIYLLANPLLKEPLRPEHIKPRLLGHWGTSPGLNLVHTHLGRVIKARDLDAICVWGPGHGGPAVLAGSWLDGSYAEVYPDVSRDGAGMARLFRQFSFPGGVPSHVAPETPGSIHEGGELGYSLAHAYGAALDNPDLLAVCVIGDGEAETGPLAGSWHANKFLDPVHDGAVLPILHLNGYKIANPTVLARLPEPELDDLLRGYGHEPIHVAARPGDDPLRTHRALARAMDQALDRITLLQRTAREEDAVERPRWPVIVLRTPKGWTGPAEVDGLPVEDTWRAHQVPLPAVRENPDHLRQLERWLRSYRPEELFDDEGRPRPDVLAFVPDGDRRLGANPHANGGLLLRDLPVPGLARYAVPVDKPGATLHEPTRVLGGLLEQIMEDTADRRDFRLVGPDETSSNRLDAVYRATGKAWQEEILVTDEHLNRHGRVMEVLSEHLCQGWLEGYLLTGRHGLFSCYEAFVHIVDSMVNQHIKWLKVARDLPWRRPIASLNYLLTSHVWRQDHNGFSHQDPGFVDHVLNKSPQAVRVYLPPDANTLLCVADHVLRSRDYVNVVVAGKQPCFDWLDLDQARVHCARGAGSWDWAGTETGTGEPDVVLAAAGDVPTQEVLAAAGILRRHLPDVAVRVVNVVDMTRLLPQDAHPHGMPDAEFDALFTRDRPVVFAYHGYPWLVHRLAYRRAVHPHLHVRGYRESGTTTTPFDMVVRNDLDRYRLVMDVIDRTPGLAVRAVSVRQRMQDARTRHHQWIREHGTDMPEIAEWSWTG

SEQ ID NO: 564 - protein, 795 aa, Streptomyces flavogriseus ATCC 33331
MTDARTPSGASAPSDAEIAALDAHWRAANYLAVGQIYLMANPLLEEPLAPEHIKPRLLGHWGTSPGLNLVHTHLNRIVRTRKRRAMCVWGPGHGGPAVLANSWLEGSYSETYPDVSRDRAGMGALFKQFSFPGGVPSHVAPETPGSIHEGGELGYALTHAYGAAFDHPELLVACVVGDGEAETGPLAASWHSNKFLDPVHDGAVLPVLHLNGYKIANPTVLARLPEDELDALLRGYGHDPVYVEGDEPAVVHRALAAAMDLAVDRIDGYQRAARSEGASARPRWPMIVLRTPKGWTGPEEVDGLPVENTWRAHQVPLPGVRDNPDHLRQLEEWMRSYRPEELFDSEGRPTAQVLECVPEGTARLGATPYANGGLLLRDLPLPPLENHAVRVDRPGTVLHEPTRILGGLLEDVMAATADRRNFRVVGPDETESNRLGALYEATGKAWQAEVLPTDEHLARDGRVMEVLSEHLCQGWLEGYLLTGRHGLFSSYEAFAHIVDSMVNQHIKWLRTSRRLHWRAPVASLNYLLTSHVWRQDHNGFSHQDPGFVDHILNKSPEVVRVYMPPDANTLLSTADHVLRSRDYVNVIVAGKQPGFDWLTLDEARAHCARGAGVWEWAGTEDGSREPDVVLACAGDVPTLETMAAAGLLRRHLPELAVRVVNVVDMTRLLPHEEHPHGMPDAEYDAVFTRDRPVIFAYHGYPWLVHRLAYRRAGHSHLHVRGYKEEGTTTTPFDMVVRNDLDRYRLVMDVLDRVPGLGVRAVAVRQAMADARTRHHAWIREHGTDMPEVADWAWEG

SEQ ID NO: 565 - protein, 795 aa, Streptomyces griseus subsp. griseus NBRC 13350
MSDTRTPSDPPVLSDDELSALDAHWRAANYLAVGQIYLMANPLLTRPLVPEDIKPRLLGHWGTSPGLNLVHTHLNRVIKDRDLNALCVWGPGHGGPAVLANSWLEGSYSETYPDVGRDAEGMGLLFKQFSFPGGVPSHVAPETPGSIHEGGELGYSLAHAYGAAFDHPDLVVACVIGDGEAETGPLAASWHGNKFLDPVHDGAVLPILHLNGYKIANPTVLARIPEDELDRLLRGYGHDPLFVTGDDPATVHRALAAALDTALDRIGAYQRAAREDSATERPDWPMIVLRTPKGWTGPEEVDGVPVENTWRSHQVPLPGVRENPEHLRQLEAWLRSYRPAELFDADGRPTERVLARVPEGAARLGSTPYANGGLLLRDLPLPDPADHAVRVDRPGTTLHEPTKVLGGLLESVMAATADRRDFRVVGPDETASNRLDALYRATGKAWQAGTLPTDEHLAHDGRVMEVLSEHLCQGWLEGYLLTGRHGLFSSYEAFAHIVDSMVNQHIKWLRTSRRLPWRRPIASLNYLLTSHVWRQDHNGFSHQDPGFVDHILNKSPEVVRVYLPPDSNTLLSVADHVLRSRDYVNVIVAGKQPTFDWLTPREARGHCARGAGAWEWAGTEDGSREPDVVLACAGDVPTQETLAAADLIRRHLPELALRVVNVVDIARMMPDTEHPHGMPDAEYDALFTRDRPVIFAYHGYPWLIHRLAYRRHGHAHLHVRGYKEEGTTTTPFDMVVRNDLDRYRLVMDVIDRVPGLGVRAVAVRQEMADARTRHHAWIREHGTDLPEVVDWTWGG

SEQ ID NO: 566 - protein, 793 aa, Streptomyces albus J1074
MSQAPDRTGGPSAEEIAALDAHWRAANYLAVGQIYLMDNPLLTRPLTPEDIKPRLLGHWGTSPGLNLVYTHLNRVIKDRDLTALAVWGPGHGGPAVVANSWLEGSWSEVYRDVPRDADGMARLFKQFSFPGGVPSHVAPDVPGSIHEGGELGYALTHAYGAAFDHPDLFVACVIGDGEAETGPLAASWHSDKFLDPVHDGAVLPILHLNGYKIANPTVLARLPEDELDALLRGYGHDPLHVEGDDPETVHRELALALDTALDRIAVIQERARVQGAVERPSWPMIVLRTPKGWTGPREVDGLPVENTWRAHQVPLPGVREDDDHRRQLEEWMRSYRPGELFDEDGRPRPEVLRYVPEGDARLGATPYANGGRLTRDLPLPGLAGHAVEVPAPGQSTSEPTQVLGGWLEELMAATAARRDFRLVGPDETASNRLDAVYGATGKTWEEKTYPTDEHLSRDGRVMEVLSEHLCQGWLEGYLLTGRHGLFSCYEAFAHIVDSMVNQHIKWLRASRRLDWRRPIASLNYLLTSHVWRQDHNGFSHQDPGFVDHILNKSPEAVRVYLPPDANTLLAAAEHVLGSRDYVNVIISGKQPTFDWLTLEQARAHCARGAGTWAWAGTEDGTREPDVVLACAGDVPTQEVLAAAGLLRRHLPELSLRVVNVVDVARLLPQGEHPHGMPDAEYDALFTRDKPVIFAYHGYPWLIHRLAYRRHGHDHLHVRGYKEEGTTTTPFDMVVRNDLDRYRLVMDVIDRVPGLGVRAVGLRQAMADARFRHHRWIREHGSDMPEVADWRWEG

SEQ ID NO: 567 - protein, 795 aa, Streptomyces sp. Mg1
MTALTAYSIPELDAHWRAANYLAVGQIYLMGNPLLAEPLRPEHIKPRLLGHWGTSPGLNLVYTHLNRVIRERAVEALCIWGPGHGGPAVLANSWLEGTYSETYPGVGRDADGMAELFRQFSFPGGVPSHVAPETPGSVHEGGELGYALSHAYGAAFDHPGLLVACVIGDGEAETGPLAASWHSNKFLDPVHDGAVLPILHLNGYKIANPTVLSRIPEAELDALLRGYGHDPLYVTGSDPAQVHPAMARALDHALDRISLIQQEARKAGTDPGREYARWPMIVLRTPKGWTGPATVDGDPVEGTWRAHQVPLAGVRENPAHLKQLEDWLRSYRPEELFDADGRPTARVLACVPEGERRLGAVPYANGGRLLRPLPLPTLDAHAVPVDKPGRTLHEPTRVLGQFLTQVMRETAGRRDFRVVGPDETASNRLDDLYQATGKAWQGITEATDRNLARDGRVMEILSEHVCQGWLEGYLLTGRHGLFSTYEAFAHIVDSMVGQHIKWLKTSRELSWRAPIASLNYLLTSHVWRQDNNGFSHQDPGFVDHVLNKSPEVVRVYLPPDANTLLAVADHALRSRDQVNVIVAGKQPCFDWLPIEEARTHVARGAGVWEWAGTDHGSGSGSGSREPDVVLACAGDVPTMEVLAAAALLREHLPSLAVRVVNVVDIARLMPHDEHPHGMTKAEYDALFTTDRPVIFAYHGYPWLIHRLAYRRTGHSQLHVRGYKESGTTTTPFDMVVRNDMDRYRLVMDVIDRVPGLASRAEGVRQAMADQRIRHHDWIREHGTDLPEVADWSWPY

SEQ ID NO: 568 - protein, 797 aa, Streptomyces sp. SPB78
MQEFTYETPAPVAPELSDAELEALLAHWRAANYLAVGQIYLMDNPLLREPLRPEQIKPRLLGHWGTVPGLNLVYTHVNRLIRLRRQPALCVWGPGHGGPGVLANSWLEGSYSDVYPDISRDERGMKRLFKQFSFPGGVPSHVSPELPGSIHEGGELGYSLLHAYGAAFDNPDLLVPCVIGDGESETGPLAGSWHSNKFLDPVHDGAVLPILHLNGYKIANPTVLARLPETELHDLLRGYGYRPIEVVGDDPAHVHRQMAGALAQAVGRIDEIQAEARRGRSTDRAHWPMIILRTPKGWTGPKLVDGLPVEGTWRAHQVPLAEVRTDPEHLRQLEEWMRSYRPEELFDEEGRPRARVLECVPEGDLRLGASPHANGGRLTRSLPAPPLEDFAVTVDRPGTSTHEPTRVLGQYLARIMELTADRRDFRLMGPDETASNRLNAVYDVTAKTWQEEILPVDEHLTRDGRVMEVLSEHMCQGWLEGYTLTGRHGMFSTYEAFAHIIDSMANQHIKWLGTARKLPWRRPVPSLNYLLSSHVWRQDHNGFSHQDPGFIDHVLNKSPEVVRVYLPPDANTALSTAEHVLQSREYVNVVMAGKQPSFDWLTLDEARGHCARGAGIWEWAGTEEGRLPDVVLACAGDTPTLEILAAAQILRQRLPELAVRVVNVVDLARLLPASEHPHGMPDADFDGLFTKDKPVIFAYHGYPWLIHRLAYRRAVHPHLHVRGYKERGTTTTPFDMVVLNDLDRYRLVMDVIDRVPGLAQRQAALRQEMADTRTRHRAWVREYGEDLPEVAQWHWEG

SEQ ID NO: 569 - protein, 792 aa, Kribbella flavida DSM 17836
MQQIDATPLSDEELQGLDAYWRAANYLSVGQIYLLANPLLKEPLGPDHIKPRLLGHWGTTPGLNLIYAHLNRVIRQRERDLMYVIGPGHGGPAIVANTWLEGSWTATYPNTTQDEPGMARLFKQFSFPGGIPSHVAPEVPGSINEGGELGYSLSHAYGAAADNPDLVVACVIGDGEAETGPLATSWHCNKFVDPRRDGAVLPILHLNGYKIANPAVLARIGDEELTALLRGLGHEPYLVEGSDPATVHQALAATLDRCLDRIDEIQLEARTAETPPGRSAWPMIVLKTPKGWTGPHTVDGEPVEDTWRSHQVPLSGVRSNDDHLRQLEDWLRSYRPEELFDADGRPVERLLELAPPPSLRMGSSPHANGGVLTRDLELPDPADHAVPVKAPGAEDGEPTKVFGQYLRDAFVLNEPHRNLRLFGPDETESNRLNAVYEVTGKAWVAERRDTDRNLAIDGRVLEMLSEHTCQGWLEGYLLTGRHGLFSSYEAFVHIVDSMVNQHAKWLKSINRLDWRRPVPSLNYLLTSHVWRQDHNGFSHQDPGFIDHVVNKKAEVVRVYLPPDANTLLSTMDHCLRTRNYINVVVAGKQPQPNWLDWESAALHCARGIGVWDFASNDDGEPDVVMACAGDVPTLETMAAVDLLREHLPQLKVRVVNVVDLMRLQDATEHPHGLTDPEFDALFTTDKPVIFAYHGYPWLIHRLTYRRRGHANLHVRGYIEEGTTTTPFDMVVLNNLDRYHLAMDVIDRVPSLGSRAASVRQHFSDQRVRHRAHTTTYGEDLPEVRDWRWGRPR

SEQ ID NO: 570 - protein, 822 aa, Nocardia farcinica IFM 10152
MTQMASAGGDTSADNVGAHGGRTVAPVPYELTEAAGPLDRAELAALDAWWRAANYLSVGQIYLMANPLLTEPLRPEHIKPRLLGHFGTVPGLNLVWTHANRVIRQRGLDAVFVAGPGHGGPGPNACAWLEGTYSELYSHIPRDGEGMAALFAQFSFPGGVPSHCAPETPGSFHEGGELGYSLLHAYGAALDNPDLTVFCVIGDGEAETGPLATSWHGNKFLNPGRDGAVLPILALNEYKIANPTLFARIPEPELINLLEGYGHEPIVVAGDDPGVVHQRLAAAMDTCMNRIAQIQRAARDGADGSRPAWPMIVLRTPKGWTCPPVVDGDRVEGTFRAHQVPLPAARTDDGHRAVLEQWLRSYRPEELFDDRGRPVPELLALAPEGDRRMSANPVANGGALVRDLRLPDWREFGVEVKTPGGSTHEATRVLGGWLREVTRLNPHNFLTFAPDELASNRLQDILEVTGRDWQAEVGEYDVALDRSGRVIEVLSEHICQGLLEGYLLTGRHGVFTCYEAFIHIVDAMFNQHAKWLDASAAVPWRRPLASLNYLLSSHVWRQDHNGFTHQDPGFLDVVLNKKPEIVRVYLPPDANTLLSTYDHCLRSRHYVNVVVAGKQPQEDWLSVEQAAVHCARGLGIWEWACHNDDPGTTPDVVLACAGDVPTLETLAAAAILRDRLPRLRVRVINVVDLMRLLPAEEHPHGLPDREFDTLFTTASPIIFAFHGYPWLIHRLTYRRTNHDGLHVRGYKEEGTTTTPFDMVMLNDLDRYHLVMDVIDRVPGLRETAAGLRQEMVDARWRARAWTREHGADIPVVADWTWPEPSR

SEQ ID NO: 571 - protein, 802 aa, Frankia sp. EAN1pec
MINVAEIGAESGVQSTGPLSTEELRLIDAYWRAANYLAVGQIYLLDNPLLTEPLRAEHIKPRLLGHWGTTPGLNLIYAHMNRVIRRNDLDAIYVIGPGHGGPGIVANTYLEGTYSEIYPSVTQDREGLRRLFRQFSFPGGIPSHVAPEVPGSIHEGGELGYALTHAYGAAFDNPGLVVAAVVGDGEAETGPLAASWHSNKFLDPVRDGAVLPILHLNGYKIAQPTILARIPESELDALMRGYGHEPLHVTGDDPADVHQQFARVLDTAVSRIFDIQDRARRGGDSSRPVWPMIVLRTPKGWTGPSTVDGRPVEGNWRSHQVPIAELHGNPEHLALLESWLRSYRPWELFDADGRLVPELAALAPVGTRRMSANPHANGGELLRDLTLPDFRDYAVDVPQPGVGSNEATRVLGGFLRDVMRSNPNTFRVMGPDETASNRLGALFETTSRAWNAETVPTDEDLAPDGRVMEVLSEHLCQGWLEGYLLTGRHGFFSCYEAFIHIVDSMVNQHAKWLKATRHIPWRRPIASLNYLLTSHVWRQDHNGFSHQDPGFIDHVVNKKAEIIRVYLPPDANTLLSVADHCLRSRHYINVIVAGKQPALNYLPMSDAIAHCTRGLGIWDWASNDHTEDGDGTPDVVMACAGDIPTLETLAAVDILRQNFPELKVRVVNVVDLMCLQAEAEHPHGMSDARFDALFTEDRPIIFAYHGYPWLIHRLTYRRRNHGNLHVRGYIEEGTTTTPFDMVMMNNLDRFHLVVDVIDRVASLGARAAHVRQRMIDARLAARAYTRDHGEDDPRIRDWTWPY

SEQ ID NO: 572 - protein, 802 aa, Frankia sp. CcI3
MTSVVDAERSGADPAAGPLSPAELDLIHAYWRAANYLSVGQIYLLDNPLLTEPLRPEHVKPRLLGHWGTTPGLNLIYAHLNRVIRAKDLNAIYIIGPGHGGPGIVANAYLEGTYSEVYPSIGRDVAGMRRLFRQFSFPGGIPSHVAPETPGSIHEGGELGYALTHAYGAAFDNPDLVVCAVVGDGEAETGPLAASWHSNKFLDPGRDGAVLPVLHLNGYKIANPTILARIPEQELTALLRGYGYHPYFVVGDDPAAVHQRMAGVLDAAVGEIHEIQDRARRHGRTERPTWPMIVLRTPKGWTGPATVDGLPVEGTWRSHQVPVAQLHDNPGHLAQLEAWLRSYRPEELFDAGGAPRAELAALAPRGPRRMSANPHANGGELLRDLTLPDFRDYAVDVTAPGTTLAEPTRILGAFLRDVVAANPSTFRVMGPDETASNRLGALFEVTDRVWNAGTEPTDEHLAVDGRVMEVLSEHLCQGWLEGYLLTGRHGFFSCYEAFIHIVDSMVNQHAKWLKTTRHIPWRRPIASLNYLLTSHVWRQDHNGFSHQDPGFIDHVVNKKAEVVRVYLPPDANTLLSVGNHCLRSRHYINVIVAGKQPALNYLSMPAAIAHCTRGLGIWDWASNDHDAPGDGLPDVVMACAGDIPTLETLAAVDLLRQHFPDLKVRVVNVVDLMSLQDEAEHPHGISHARFDALFTTDRPIIFAYHGYPWLIHRLTYRRHNHHNLHVRGYIEEGTTTTPFDMVMLNNLDRFHLVADVIDRVPSLGARAAHVRQQMIDARLAARTYTRDHGEDAPEIRNWTWPY

SEQ ID NO: 573 - protein, 800 aa, Catenulispora acidiphila DSM 44928
MTRLSRQSPRKSPLSAKDLDAVNAYWRAANYLSVGQIYLLDNPLMRRPLSLDDVKPRLLGHWGTTPGLNFIYAHMNRVIKARDLDAIYVAGPGHGGPGVLANVYLEGTYSEIYPGIGQDEDGMRKLFRQFSFPGGVPSHVAPETPGSIHEGGELGYSLAHAYGAAFDNPDLLVCAVVGDGEAETGPLAASWHSNKFVNPVRDGTVLPILHLNGYKIANPTVLSRIPQAELEQLMRGYGYEPFTVVSEEGADPLEAHQAMAATLDAMLDRIADIRTRALTGRDNGERPAWPMLILRTPKGWTGPKTVDGKRTEDSWRSHQVPMANVHTNPAHLKVLEEWMRSYRPEELFDPAGALMPELAALAPSGLRRMGANPHANGGVLLRDLKMPDFRDYAVEPAGHGVEHAESTKILGTFLRDIMSDNSGADNFRVFGPDETASNRLQALFEATGRMWNAETVPWDDEHLALDGRVLEPLSEHMCQGWLEGYLLTGRHGFFSCYEAFIHIVDSMFNQHAKWLKTTRHIPWRAPIASLNYLLTSHVWRQDHNGFSHQDPGFIDHVVNKKADVIRVYLPPDANTLLSVADHCLRSRDYVNVIVAGKQPQLQYLSMEEAIVHCTRGIGIWEWASSDGDGEPDLVMGCAGDVPTMETLAAVDILRQNFPDLKVRVVNVVDLMRLQGSDEHPHGLSDKEFDALFTTAKPVVFTYHGYPWLIHRLTYRRTNHGNLHVRGYKEEGTTTTPFDMAMLNDIDRYHLAIDAIDRVPGLAERAGHLRQQLLDARLKARQYTREFGEDDPAISGWAWPY

SEQ ID NO: 574 - protein, 797 aa, Acidothermus cellulolyticus 11B
MTEPTAGPGDAVLSDQELAAIDAYWRAANYLCVGQLYLLDNPLLREPLRPEHIKPRLLGHWGTTPGLNFIYTHMNRFIRRDDWNAIFITGPGHGGPAPVAQAYLEGTYSEIYPSITRDEEGLRRLFRQFSFPGGIPSHAAPETPGSIHEGGELGYSLAHAFGAVFDNPDLLAVCVVGDGEAETGPLATSWHSNKFLNPRHDGAVLPILHLNGYKIAGPTVLGRIPRSELLALFEGYGYRPLLVAGDDPAAMHQLMARTLEEALDDIREIQRRARSGVPGRPTWPMIILETPKGWTGPCEVDGRPVEGSFRSHQIPLTDPRGNAEHLAMLEAWMRSYRPEELFDAHGAVRPELTDLAPRGARRMSANPHANGGVLLRDLFLPDFTAYAVPVEKPATTTSEATRVLGRYLRDVLALNAESRNFRIFGPDETASNRLDAVFDVENRMLNADILPTDDHIAPDGRVMEVLSEHLCQGWLEGYLLTGRHGLFNSYEAFIHIVDSMFNQHAKWLKVTRSLPWRRPIASLNYLLSSHVWRQDHNGFSHQDPGFIDLVVNKKAEVIRVYLPPDTNTLLSVMDHCLRTRNYVNVVIAGKQPALNYLSMPDAIAHCTRGIGVWSWASNDMGDDGRGEPDVVMAAAGDVPTLEALAATALLREFFPDLRVRFINVVDLMRLQPSSEHPHGLTDAEFDALFTTDKPVIFAFHGYPWLIHRLTYRRTNHKNIHVRGYKEEGTTTTPFDMAMLNDIDRYHLVMDVIDRVPSLGTRAYHIRQRMADERLAKRRYTRDVGDDHPDVKNWVWPW

SEQ ID NO: 575 - protein, 798 aa, Nocardioides sp. JS614
MDASLDTLDRWWRAANYLSVGQIYLMDNPLLREPLVAEHVKPRLLGHWGTTPGLNFVYAHLNRAIMARQQQMIFITGPGHGGPGLVASSYLEGTYSEVYTDITQDAAGMQRLFKQFSFPGGIPSHVAPETPGSIHEGGELGYALSHAYGAAFDNPDLVVAAVVGDGEAETGPLATSWHSNKFLDPRRDGAVLPILHLNGYKIANPTVLARIPEDELVSLLRGYGYTPYVVAGSDAAQMHADFAGTLDRCLEEIAGIQGEARAASDPLPRPAWPMIVLRSPKGWTGPKEVDGKRVEDFWRSHQVPFANARSDDAHRAVLEEWLRSYRPEELFDESGAPAPDIAALHPGGELRMSASPHANGGLLLKPLRMPDFRDYAVEVDAPGTGSVEATRVLGGFLRDVMAQNMHNFRMFAPDENSSNRLQDVMEVTDRAWNAEILGYDDHLAPDGRIMEILSEHTCQGWLEGYLLTGRHGLFSCYEAFIHLIDSMFNQHAKWLESTRRIEWRRPVASLNYLLTSHVWRQDHNGFSHQDPGFIDHVVNKKANVVRVYLPPDANTLLSVGDHCLRSKHYVNVVVAGKQPALQYLSMDDAIVHCTKGAGIWDWASNDGDEGPDVVIACAGDVPTMEALAAVDLLREHLPDLRIRFVNVVDLMRLQPASEHPHGFSEADFDALFTTDRPVIFAYHGYPWLIHRLTYKRTNHANIHVRGYKEEGTTTTPFDMTVLNHMDRYNLAIDVIDRVPRLAATSSDAREEFKNALIRHRQYIRTYGEDLPEIRDWTWQGSFGPRYRTATPELDAPEG

SEQ ID NO: 576 - protein, 798 aa, Saccharopolyspora erythraea NRRL 2338
MTTTDTWSTSTDVAEHLGRDELERLQLWWRAANYLSAGQIYLMDNPLLEEPLRPEHVKPRLLGHWGTTPGLNFVYAHLNRAIRLRSLDMMYVIGPGHGGPALVAAAWLEGTYSEIYPDVAQDHEGLRRLVTQFSFPGGVPSHVAPETPGSIHEGGELGYSLSHAFGAAFDNPGLIVPCVVGDGEAETGPLATSWHSNKFLDPATDGAVLPILHLNGYKIANPAVWARIPEDELLSMLRGFGYEPYVVEGSSPLPMHHLFAATLDRCLDEIAAIQRRARGDGHPYRPKWPMIVLRTPKGWTCPATVDGKPLEGSWRSHQVPVSDPRNNPEHLRLLEEWLRSYRPEELFDAGGRPVETIREGNPVGERRMSASPHANGGHLLRGLRLPDFRDYAVPVQAPGADKAEGTRVLGRFLRDVLRLNSAQRNFRVFAPDENNSNRLDAVLEASPRAWVAETEPDDESLAPGGQVMEILSEHTCQGWLEGYLLTGRHGFFSCYEAFAHIVDSMVNQHAKWLKVSRHLPWRRPVASLNYLLTSHVWRQDHNGFSHQDPGFIDHVVNKKAEIVRVYLPPDTNTLLSVSDHCLRSRDYINLVVAGKQPEPQYLDMESAIVHCEKGIGIWDWASTDSGGDPDVVMACAGDVPTMETLAAVDILRGHFPDLRMRVINVVDLMRLQDEREHPHGLSDAEFDSLFTRDTPVIFNYHGYPWLIHRLTYRRHNHEGMHVRGYKEEGTTTTPFDMCVLNEIDRFHLAIDVIDRVPRLGPRAAYAREHLKGKLIEHRHHVRTHGEDMPEVRDWEWPS

SEQ ID NO: 577 - protein, 794 aa, Rhizobium leguminosarum bv. trifolii WSM2304
MEKHVSTAALTDAELTLTDRYWRAANYLSIGQIYLLANPLLREPLKPEHIKPRLLGHWGTTPGLNFIYAHLNRLIRARDLDVIYICGPGHGGPGMVANTYLEGSYSELYPDISEDAEGMRKLFRQFSFPGGIPSHAAPETPGSIHEGGELGYALVHAYGAAFDNPNLIVACVVGDGEAETGPLAASWQSNKFLNPARDGAVLPILHLNGYKIANPTILGRADGDDLKRLFEGYGYEPFFVEGHEPHDMHQQMAATMDEVFDRIRAIQKQARNGKAAEGCPRWPMIVLRSPKGWTGPKEVDGKKVEGFWRAHQVPVSNCRGDDGHRKILEDWMRSYDPEDLFGADGRLKPELQALAPVGKRRMGANPHANGGLLRKELDVPDISDYAVDIGKRGSAMVQSTEILGHYLRDTMKRNAETANFRIFGPDETESNRLGSVFEVTDRIWMEGIEPYDIHLSRDGRVMEVLSEHLCQGWLEGYLLTGRHGLFSCYEAFIHIIDSMFNQHAKWLKVTRELEWRKPISSLNYLLTSHVWRQDHNGFSHQDPGFVDLVANKKADIVRIYLPPDANTLLWVGDHCLRTYDRINVIVAGKQPEPQWLSMDEAVKHCEAGIGIWHWASNEEDTISPDLVMACAGDVPTMETLAAVDLLRKAIPELKIRTVNVVDLMALQSKDQHPHGLTDEAFDAIFTSDKPVIFAYHGYPYLIHRLTYKRTNHRNIHVRGFIEEGTTTTPFDMTVLNQLDRFHLAIEAIERVPGLKEKASDALTAFRGQLAKHHDYVREYGEDMPEVQSWTWPAA

SEQ ID NO: 578 - protein, 794 aa, Rhizobium leguminosarum bv. trifolii WSM1325
MEKHVSTAALTDAELTLIDRYWRAANYLSIGQIYLLTNPLLREPLKPEHIKPRLLGHWGTTPGLNFIYAHLNRLIRARDLDIIYMCGPGHGGPGMVANTYLEGIYSEIYPDISEDAEGMRKLFRQFSFPGGIPSHAAPETPGSIHEGGELGYALVHAYGAAFDNPDLIVACVIGDGEAETGPLAASWHSNKFLNPARDGAVLPILHLNGYKIANPTILGRASHEDLQSLFEGYGYEPFFVEGHEPRDMHQQMAATFDRVFDRIREIQEEARNGKAPDICPRWPMIVLRSPKGWTGPKEVDGKKVEGFWRAHQVPVSNCRENEGHRKILEDWMRSYDPKDLFGSDGRLKPELRALAPVGERRMGANPHANGGLLRKELDVPDIRDYAVDIGKHGSAMVQSTEILGHYLRDTMKRNADAANFRIFGPDETESNRLGSVFEVTDRVWMEGIEPYDVHLSRDGRVMEVLSEHLCQGWLEGYLLTGRHGLFSCYEAFIHIIDSMFNQHAKWLKVTRELEWRKPISSLNYLLTSHVWRQDHNGFSHQDPGFVDLVANKKADIVRIYLPPDANTLLWVGDHCLRTYDRINVIVAGKQPEPQWLSMDEAVKHCEAGIGIWHWASNEDDTILPDLVMACAGDVPTMETLAAVDLLRKAIPELKIRAVNVVDLLALQSRDQHPHGLTDEAFDAIFTADKPVIFAYHGYPYLIHRLTYKRTNHRNFHVRGFIEEGTTTTPFDMTVLNELDRFHLAIEAIERVPGLKEKAGEALAAFRGKLAEHHDYVREYGEDMPEVRNWTWPMA

SEQ ID NO: 579 - protein, 795 aa, Rhizobium etli CIAT 652
MEKHISTAAALTEAELGLIDRYWRAANYLSVGQIYLLANPLLREPLKPEHIKPRLLGHWGTTPGLNFIYAHLNRLIRGRDLDVIYICGPGHGGPGMVANTYLEGSYSEIYPDISEDAEGMRKLFRQFSFPGGIPSHAAPETPGSIHEGGELGYALVHAYGAAFDNPDLIVACVIGDGEAETGPLAASWHSNKFLNPARDGAVLPILHLNGYKIANPTILGRAADDDLRRLFEGYGYEPFFVDGHEPRDMHRQMAATLDLIFDRIRDIQQQARNGKAADGCPRWPMIVLRSPKGWTGPKEVDGKKVEGFWRAHQVPVSNCREDDGHRKILEDWMRGYDPEDLFDTGGRLKPELRALAPAGKRRMGANPHANGGLLRRELAVPDLRDYAVDIGRRGSVVAQSTQILGHYLRDTMKLNAETANFRIFGPDETESNRLGSVFEVTDRVWMEDIEPYDIHLSRDGRVVEVLSEHLCQGWLEGYLLTGRHGLFSCYEAFIHIIDSMFNQHAKWLKVTGELEWRKPISSLNYLLTSHVWRQDHNGFSHQDPGFIDLVANKKADIVRIYLPPDANTLLWVGDHCLRTYDRINVIVAGKQPEPQWLSMDEAVKHCEAGIGIWHWASNEEEAVAPDLVMACAGDVPTMETLAAVDLLRKAVPALKIRTVNAVDLLALQSSDQHPHGLTDEAFDAIFTSDKPVIFAYHGYPYLIHRLTYKRTNHENIHVRGFIEEGTTTTPFDMTVLNELDRYHLAIEAIERVPGLKEKAADALAAFHDKLAEHHAYVREYGEDMPEVRNWTWPTA

SEQ ID NO: 580 - protein, 795 aa, Rhizobium etli CFN 42
MEKHVSTAAALTDVELTLIDRYWRAANYLSVGQIYLLANPLLREPLKSEHIKPRLLGHWGTTPGLNFLYAHLNRVIRARDLDIIYICGPGHGGPGMVANTYLEGTYSEIYPDISEDTEGMRRLFRQFSFPGGIPSHAAPETPGSIHEGGELGYALVHAYGAAFDNPDLTVACIVGDGEAETGPLAASWHSNKFLNPARDGAVLPILHLNGYKIANPTILGRANDDDLRRLFEGYGYEPFFVDGHEPRDMHQQMAATLDQVFDRIREIQEQARSSKAAAGCPRWPMIVLRSLKGWTGPKEVDGKKVEGFWRAHQVPVSNCRENEGHRKILEDWMRSYDPEDLFDDEGRLNADLRALAPVGKRRMGASPHANGGLLRRELDVPDIGDYAVDVGKRGSVVAQSTEILGHYLRDTMKLNAKAANFRIFGPDETESNRLGSVFDVTNRVWMEDIEPYDVHLSRDGRVMEVLSEHLCQGWLEGYLLTGRHGLFSCYEAFIHIIDSMFNQHAKWLKVTRELEWRKPISSLNYLLTSHVWRQDHNGFSHQDPGFVDLVVNKKADIVRIYLPPDANTLLWVGDHCLRTYDRVNVIVAGKQPEPQWLSMEEAVKHCEAGIGIWRWASNEEDTISPDLVMACAGDVPTMETLAAVDLLRTAIPELKIRTVNVVDLLALQSRDQHPHGLSDEAFDAIFTADKPVIFAYHGYPYLIHRLTYKRTNHENIHVRGFIEEGTTTTPFDMTVLNELDRYHLAIEAIERVPGLKEKAKGAFAAFQGKLAEHHDYVREYGEDMPEVRNWTWPAA

SEQ ID NO: 581 - protein, 804 aa, Agrobacterium radiobacter K84
MEKQPAATFTHPLDDAELDLINRYWRAANYLSVGQIYLLDNPLLREPLKAEHIKPRLLGHWGTTPGLNFIYAHINRIIRNRDLDIIYICGPGHGGPGMVANTYLEGTYSEIYPDISTDTSGMHKLFRQFSFPGGIPSHAAPETPGSIHEGGELGYALVHAYGAVFDNPDLIAACVIGDGEAETGPLAASWHSNKFLNPARDGAVLPILHLNGYKIANPTILGRDTEEDLRHLFIGYGYEPFFVEGSDPHQMHQAMAATFEQVFDRIRAIQAEARTGMPGNFCPRWPMIVFRSPKGWTGPKEVDGKKVEGFWRAHQVPVSNCRKDANHRQILEDWMRSYDPQDLFDTDGRLKEELRALAPTAKRRMGANPHANGGLLRRELIVPNIRAYAVAVKERGRTMAQSTEVLGHYLRDILTLNSDHTNFRIFGPDETESNRLGSVFEVTDRVWMEEIKPYDVSLAPDGRVMEVLSEHLCQGWLEGYLLTGRHGLFSCYEAFIHIIDSMFNQHAKWLKVSRELPWRKPISSLNYLLTSHVWRQDHNGFSHQDPGFIDLVANKRADTVRIYLPPDANTLLWTGDHCLKTYDRINVIVAGKQPEPQWLSMDEAIKHCEAGIGIWEWAGNEQGAVEPDVVMACAGDVPTMEMLAAVDLLRQNIPELSIRVVNVVDLMALQSKEQHPHGLADAVFDKLFTPDRPVIFAYHGYPYLIHRLTYRRTNHGNIHVRGFIEEGTTTTPFDMTVLNELDRYHLAIEAIERVPGLREKAMNVIKLFRDKLEEHGRYIRQYGEDMPEISNWKWPYDSNGYRLS

SEQ ID NO: 582 - protein, 792 aa, Brucella sp. 83/13
MSTVPAKGPLTPQQLSLINRYWRAANYLSVGQIYLMKNPLLREPLQLEHIKPRLLGHWGTTPGLNFIYAHLNRIIQQRNANVIYICGPGHGGPGMVANTYLEGTYSEIYPAISEDEAGMEKLFRQFSFPGGIPSHAAPETPGSIHEGGELGYALVHAYGAAFDNPDLVVACVVGDGEAETGALATSWHSNKFLNPARDGAVLPILHLNGYKIANPTVLARLSDNDLDNLFRGYGYEPFFVEGSEPADMHQKMAATLDTIFQRIEDIKKNADVHSPERPRWPMIILRSPKGWTGPKTVDGLVVENYWRAHQVPVANCRENDAHRKILEDWMKSYDPSDLFDEKGALKPELRALAPKGEARMGANPHANGGLLRKELHMPDFRQYAVNVTEPGAIEAQSTKILGDFLRDVMKLNETEKNFRIFGPDETASNRLGSVFEATNRVWMAETLDMDDHLAADGRVMEVLSEHLCQGWLEGYLLSGRHGFFSCYEAFIHIIDSMFNQHAKWLQVARELEWRKPVSSLNYLLTSHVWRQDHNGFSHQDPGFVDLVANKSADIVRVYFPPDANTLLWVGDHCLKTWNRVNVIVAGKQPEPQWLTMAEAEKHCEAGLGIWEWAGTEDGLEPDIVMACAGDVPTMETLAAVDLLRQSLPHLHIRVVNVVDLMVLQSPHQHPHGISDEEFDRIFTTNRPVIFAYHGYPYLIHRLVYKRTNHSNFHVRGFIEQGTTTTPFDMTVLNELDRFHLAMEAVERLPLGESVAKPLIDNFTEKLALHKDYIRQHGEDMPEIRNWKWTWPR

SEQ ID NO: 583 - protein, 829 aa, Ochrobactrum intermedium LMG 3301
MLPTRNRLSPPKRWTLFGTPQLQRPPHLRNHPRRRQRMTKAPAQGPLAPQQLALIDRYWKAANYLSVGQIYLMDNPLLRKPLEPEHIKPRLLGHWGTTPGLNFIYAHLNRIIRERNANIIYICGPGHGGPGMVANTYLEGSYSEIYPGVSEDEAGMRKLFRQFSFPGGIPSHVAPETPGSIHEGGELGYALVHAYGAAFDNPDLVVACVVGDGEAETGTLAASWHSNKFLNPARDGAVLPILHLNGYKIANPTILARLSDDDLTSLFRGYGYEPFFVEGSEPEAMHQQMAATLDAIFARVETIKRSADVKSPERPRWPMIILRSPKGWTGPKEVDGLIVENYWRSHQVPVANCRENDAHRKILENWMKSYDPEDLFDEKGALKPELRALAPQGERRMGAGPHANGGLLRKELHTPDFRQYAVEVTEPGALEGQSTKILGEYLRDVLKLNEREKNFRVFGPDETASNRLGAVFDASDRVWMAETLDIDDHLSADGRIMEVLSENLCQGWLEGYLLTGRHGFFSCYEAFIHIVDSMFNQHAKWLQVARELKWRKPISSLNYLLTSHVWRQDHNGFSHQDPGFVDLVANKSADIIRVYFPPDANTLLWVADHCLKTWDRINVIVAGKQPEPQWLSIDEAVRHCEAGLGIWDWAGTEDGLEPDIVMACAGDVPTMEVLAAVSLLRQSLPHLRIRVVNVVDLMVLQSPQHHPHGIADDEFDRIFTTNRPVIFAYHGYPYLIHRLVYKRTNHSNFHVHGFIEQGTTTTPFDMTVLNELDRFHLAMAAVRRLPIGNDVAGPLIATFEEKLVLHKRYVREHGEDMPEIRDWKWDARL

SEQ ID NO: 584 - protein, 795 aa, Ochrobactrum anthropi ATCC 49188
MNNQTGAQPLTPDQLKLTDRYWRAANYLSVGQIYLMQNPMLREPLKPDHVKPRLLGHWGTTPGLNFIYVHLNRIIKERNKDVLYVCGPGHGGPGMVANTYLEGTYTETYPDITEDVEGMQKLFRQFSFPGGIPSHVAPETPGSIHEGGELGYALVHAYGAAFDNPDLVVACVVGDGEAETGPLAAAWHSNKFLNAKRDGAVLPILHLNGYKIANPTLLARMSDEDLHSLFTGYGYEPFFVEGHEPEKMHQLMAATFDMAFDRIKTIKEQADLKSPERPRWPMIILRSPKGWTGPKVVDGKMVENHWRSHQVPVANCRADDAHRKILEDWMRSYEPEDLFDESGKLKPELRAIAPDGEKRMSAIPHSNGGLLRKELNTPDFRKYAVNVTEPGAVEEQTTKILGDYLRDVIRLNDEEKNFRVFGPDETASNRLGSVFEATDRVWMAETLGSDDHLAADGRVMEVLSEHLCQGWLEGYLLTGRHGFFSCYEAFIHIVDSMFNQHAKWLQVARELPWRKPVASLNYLLTSHVWRQDHNGFSHQDPGFVDLVANKSADIVRVYFPPDANTLLWVGEHCLKTWNRVNVIVAGKQPSPQWLTMDEAEKHCEAGLGKWDWAGSEDGMEPDLVMACAGDVPTMETLAATAMLREALPHLRIRVVNIVDLMALQSPQHHPHGIADSEFDALFTTDRPVIFAYHGYPYLIHRLVYKRANHPNFHVRGFIEKGTTTTPFDMAVMNELDRYHLAIEALHRLPLAADIAEPLITSLNEKLQKHHDYVREHGEDMPEVHDWKWPHSGVVA

SEQ ID NO: 585 - protein, 825 aa, Bradyrhizobium sp. ORS278
MVLRYSPVRSRRREAEGKRGPMQSSPHPTSPADDLDLLDRYWRAANYLSVGQIYLLDNPLLREPLKPEHIKPRLLGHWGTTPGLNFIYAHLNRAIAAQDLDVIYVCGPGHGGPGMVANTYLEGSYTEFYPDITRDVDGLRKLFRQFSFPGGIPSHAAPETPGSIHEGGELGYALVHAYGAAFDNPDLIVACVVGDGEAETGPLAASWHSNKFLNPAHDGAVLPILHLNGYKIANPTVLGRMGDAEIKCLFEGYGYAPLFVAGDEPEAMHRQMADALDVALASIRSIRQNARQPDAAIQRPRWPMIILRSPKGWTGPKEVDGLKVEGFWRAHQVPIANPRGKPEHLALLEAWMKSYQPETLFDAQGRLVPELQALAPKGRRRMGANPHANGGLLKRELKLPDYRAFAVEVRSPGETIAEATRELGKFLREVITLNADHKNFRIMGPDETASNRLDAVFEVTERVWMEGIEPYDVHLAHNGRVMEVLSEHLCQGWLEGYLLTGRHGVFSCYEAFIHIIDSMFNQHAKWLKVSRHLPWRRPIASLNYLLTSHVWRQDHNGFSHQDPGFVDLVANKKADIVRIYFPPDANTLLWISDHCLRTYNRINVIVAGKQPSPQWLSMPEAAVHCDAGIGIWPWAGTERGGAEPDVVMACAGDIPTIETLAAVDLLRRALPDLRIRVVNVVDLMTLQPDTEHPHGLSDRDFDSLFTTSKPVIFAYHGYPHLIHRLTYSRANHAGMHVRGFIEEGTTTTPFDMVVLNELDRFHLAIEVIERVPGLSVSAAQVKQSFRDALIAHARYVREHGEDMPEVRDWIWPNSAGGTTPAQAAD

SEQ ID NO: 586 - protein, 805 aa, Bradyrhizobium sp. BTAi1
MQTTSPQQTHTADDLDLLDRYWRAANYLSVGQIYLLDNALLREPLQPQHIKPRLLGHWGTTPGLNFIYAHLNRAIRMQDLNVIYVCGPGHGGPGMVANTYLEGSYSEIYPDITRDADGLRKLFRQFSFPGGIPSHAAPETPGSIHEGGELGYALVHAYGAAFDNPDLIVACVVGDGEAETGPLAASWHSNKFLNPAHDGAVLPILHLNGYKIANPTVLGRMSDAEIKCLFEGYGYAPLFVAGDEPQAMHRQMADALDVALASIRSIQQNARLPDAVIHRPRWPMIVLRSPKGWTGPKEVDGLKVEGFWRAHQVPIANPRGKPEHLALLEAWMKSYQPETLFDTQGRLVPELQALAPKGTRRMGANPHANGGLLKRELKLPDFRAFAVALRAPGETIAEATRELGKFLREVITLNADARNFRIMGPDETASNRLDAVFDVTERVWMEGIEPYDVHLAHDGRVMEVLSEHLCQGWLEGYLLTGRHGLFSCYEAFIHIIDSMFNQHAKWLKVSRHLPWRRPIASLNYLLTSHVWRQDHNGFSHQDPGFVDLVANKKADIVRIYFPPDANTLLWIADHCLRTYDRINVIVAGKQPSPQWLTMQEAATHCDAGIGIWSWAGTEPADAAPDVVMACAGDIPTLETLAAVDLLRKALPELKIRVVNVVDLMTLQPDTEHPHGLSDRDFDSLFTTDKPVIFAYHGYPHLIHRLTYSRTNHAGMHVRGFIEEGTTTTPFDMVVLNELDRFHLAIEVIERVPGLSVSAAHVKQTFRDALIEHTRYVREHGEDMPAIRDWVWPNSTGGTTPAEAGD

SEQ ID NO: 587 - protein, 801 aa, Bradyrhizobium japonicum USDA 110
MKVGRNMTNQQQSAAASSDLDLLDRYWRAANYLSVGQIYLLDNPLLREPLRAEHIKPRLLGHWGTTPGLNFIYAHLNRVIRALDLNVLYVCGPGHGGPGMVANTYLEGSYSEIYPNIARDADGLRKLFRQFSFPGGIPSHAAPETPGSIHEGGELGYALVHAYGAALDNPDLVVACVVGDGEAETGPLAASWHSNKFLNPAHDGAVLPILHLNGYKIANPTVLGRMSDSEIRDLFRGFGHEPLFVEGDDPKLMHRIMADALDVAFASIRSIQQHARDGRKNIERPRWPMIVLRSPKGWTGPKEVDGKKVEGFWRAHQVPVASCRENPAHLKVLEDWMRSYEPEKLFDASGALVPELQALAPEGNRRMGANPHANGGLLKKELKLPDFRSFAVEVPQPGAVTGEATRELGRFLRDVIRLNAQERNFRIMGPDETASNRLDAVFETTERVWMEPIEPYDVHLAQDGRVMEVLSEHLCQGWLEGYLLTGRHGFFSCYEAFIHIVDSMFNQHAKWLKVTRHLPWRRPIASLNYLLTSHVWRQDHNGFSHQDPGFVDLVANKKADIVRIYFPPDANTLLWIADHCLRTYNRINVIVAGKQPAPQWLSMQDAATHCDVGIGIWTWAGTEDAGGEPDVVMACAGDVPTLETLAAVDLLRKALPDLNIRVVNVVDLMTLQPQDQHPHGLSDRDFDSLFTRDKPVIFAYHGYPHLIHRLTYNRTNHAGLHVRGFAEEGTTTTPFDMVVLNELDRYHLAIEAIERVPGLATRAAQVKQQLRDKLLEHSRYVREHGEDMPEIRDWVWPGKPG

SEQ ID NO: 588 - protein, 802 aa, Nitrobacter hamburgensis X14
MEMAAPHNQASSNDLDLLDRYWRAANYLSVGQIYLLDNPLLHEALRPEHIKPRLLGHWGTTPGLNFIYAHLNRAIRAFDLNVIYICGPGHGGPGMVANTYLEGTYSEIYPNISRDTDGLRKLFRQFSFPGGIPSHAAPETPGSIHEGGELGYALTHAYGATFDNPDLIVACVIGDGEAETGPLAASWHSNKFLNPIHDGAVLPILHLNGYKIANPTVLGRMGDEEIRQLFTGYGHAPLFVEGDEPTLLHRQMADATKQAIESIRAIQRTARDGRKTTDLPKWPMIVLRSPKGWTGPKEVDGLKVEGFWRAHQVPIANPRGNPEHLNLLEQWMRSYQPELLFDENGCLQPELQALAPRGGRRMGANPHANGGLLKRELKLPDFHDYAVKVPHPGGTVAEATRVMGQFLRDVLRLNAETRNFRIMGPDETASNRLDAVFEATERVWMESTEPYDVHLAQDGRVMEVLSEHLCQGWLEGYLLSGRHGFFSCYEAFIHIVDSMFNQHAKWLKVSRGLPWRRSIASLNYLLTSHVWRQDHNGFSHQDPGFVDLVVNKKADIVRVYFPPDANSLLWITDHCLRTYDRINVIVAGKQPAQQWLTMQQTATHCDAGIGIWRWAGTEVDGTEPDVVMACAGDVPTLETLAAVNLLREGLPDLKIRVVNVVDLMTLQPREAHPHGLSNRDFDGMFTHDKPVIFAYHGYPNLIHRLTYNRTNHAGMHVRGFKEEGTTTTPFDMVVRNELDRFHLAIEVIERVPGLSTAAAHLKQQFRDALIEHALYICQHGEDMPRIRDWTWPYGHYVATDTA

SEQ ID NO: 589 - protein, 811 aa, Methylobacterium extorquens AM1
MTEPTNPQGRTAPSSATLGGEELALIDRYWQAANYLSVGQIYLLDNPLLREPLQPQHIKSRLLGHWGTTPGLNFIYVHLNRLIKARDLDAIYICGPGHGGPGIVANTYLEGTYSEVYPDIAQDTEGMRRLFRQFSFPGGIPSHVAPETPGSIHEGGELGYAIVHAFGAVFDNPDLIAACVIGDGEAETGPLAASWQSNKFLSPVTDGAVLPILHLNGYKIANPTVLGRMRDDELESLFTGFGYEPFFVEGDQPEPMHRAMAEALDRAVARIKDIQAEARGGGMGFRRPRWPMIVLRSPKGWTGPKTVDGKRVEGFWRAHQVPVGNARTDDGHRQILEDWMRSYRPETLFDETGRLRPELAALAPEGNRRMSANPHANGGLLRRELRCPRWQDFALTVSKPGAEIGEATRTLGRYLRDVIRLNAEARNFRIMGPDETASNRLDAVFEATDRVWIENIEPYDVSLAHEGRVMEVLSEHLCQGWLEGYLLTGRHGLFSCYEAFIHIVDSMFNQHAKWLKVSRELGWRRPISSLNYLLTSHVWRQDHNGFSHQDPGFIDHVANKKSDIVRVYLPPDANTLLWVADHCLQTYDRINVIVAGKQPQPQWLSAHEAGLHCEAGIGIWSWAGTDETGLEPDVVMACAGDVPTLETLAAVDLLKQAVPGLRIRVVNVVDLMTLQSNRDHPHGLTDAAFDSLFTRDKPVIFAYHGYPYLIHRLTYSRANHANMHVRGFIEEGTTTTPFDMVVLNELDRFHLAIEAIDRVPGLVTRAAGAKQAFRDRLTAHKLYIREYGEDMPEIQGWKWPYETRQETGTPH

SEQ ID NO: 590 - protein, 800 aa, Mesorhizobium sp. BNC1
MDVAKTDVGTPSLSEFEAIDRYWRAANYISVGQIYLMDNPLLREPLTAEHVKPRLLGHWGTTPGLNFVYVHLNRVIRARDLNVIYVCGPGHGGPAMVANTYLEGTYSEIYPDVPQDAEGLRRLFRQFSFPGGVPSHAAPETPGSIHEGGELGYALAHAYGAAFDNPDLLVACVVGDGEAETGPTAAAWHSNKFLNPARDGAVLPVLHLNGYKIANPTILGRMEDEELRALFTGYGYEPFFVEGSEPAEMHPLMARTLDTALDRISAIQQQARDPAWSGERLRWPMIVLRSPKGWTGPKEVDGKKVEDFWRSHQVPVANARGNDEHRRVLQDWMLSYKAQELFDESGRLRPELAALAPSGNKRMGANPHANGGLLKRDLVLPDWKAYALDVRQPGGLKGEATRVMGTYLRDVMKLNVDNFRLMGPDETSSNRLDAVFDVTDRVWMERIEPYDVHLTRDGRVMEVLSEHLCQGWLEGYLLTGRHGLFSCYEAFIHIVDSMVNQHAKWVKVSRELSWRKPIASLNYLLTSHVWRQDHNGFSHQDPGFADFVANKKADTIRLYFPPDANTLLWVTDHCLKTYNRINVITAGKQPAPQWLSADEAEIHCRAGAGVWEWAGTVARDEEPDVVMACAGDVPTLETLAAVDILRTDFPDLKIRVVNVVDLMTLQSATEHPHGLDDQGFDALFTTDKPVIFAYHGYPYLIHRLTYKRANHDNMHVHGFREEGTTTTPFDMVVMNSLDRFHLAIAAATRVTRLDVKADELVARLNDKLVEHAAYIRQHGEDMPEIRDWGWPYKTAAEAGD

SEQ ID NO: 591 - protein, 802 aa, Mesorhizobium opportunistum WSM2075
MNDKAGATPRAIGLERIDLMDRYWRAANYISVGQIYLLDNPLLREPLKAEHVKPRLLGHWGTTPGLNFLYLHLNRVIRERELDILFICGPGHGGPAMVANTWLEGTYSEIYPDIGQGEDGLRKLFRQFSFPGGVPSHAAPETPGSIHEGGELGYALVHAFGAAFDNPDLVVACVVGDGEAETGPLAASWHSNKFLNPASDGAVLPILHLNGYKIANPTILGRMDDQELRNLFAGYGYEPFFVEGHEPLAMHQSMAGTLDTVLDRIRSVQEQARSPGWRGGRPLWPMIVLRSPKGWTGPKKVDGEKVEGFWRAHQVPVSNARGNEEHRKILETWMRSYEPEKLFDRNGHLLPELAALAPTGSKRMGASPYANGGLLKRDLVLPDWKGLALEVPRPGGVVAEATRICGSYLRDVFRLNAKAQNFRLMGPDETSSNRLDDVFEATDRVWMEGIEPYDVHLSRDGRVMEVLSEHLCQGWLEGYLLTGRHGLFSCYEAFIHIVDSMVNQHAKWLKTSGELAWRKPIASLNYLLTSHVWRQDHNGFSHQDPGFADLVANKKADTVRLYFPPDANTLLWITDHCLRTYNRINVITAGKQPTPQWLSVEEAEAHCKAGAGIWEWAGTLAKGEEPDVVMACAGDVPTLETLAATDILRSAIPDLKIRVVNVVDLMTLQSNTEHPHGLADQAFDALFTKTRPVIFAYHGYPYIIHRLTYRRANHDNMHVHGFREEGTTTTPFDMVVLNELDRYHLALAAIERVPGLAERTEGLAGELHDRLVKHKAYVREHGEDMPEIQKWSWPANAAKVRQ

SEQ ID NO: 592 - protein, 795 aa, Nitrobacter winogradskyi Nb-255
MAELDDTQLGLMNLYWRAANYVSVGQIYLMDNPLLRKPLKAEDVKPRLLGHWGTTPGLNFIYVHLNRVIRERGTDVLYICGPGHGGPAMVANTYLEGSYSEIYPGITQDEAGLQKLFRQFSFPGGVPSHVAPETPGSIHEGGELGYALVHAFGAAFDNPDLTVACVVGDGEAETGPLAAAWHSNRFLNPQVDGAVLPILHLNGYKIANPALLARMSEAELSDLFRGYGYEPLFVEGHEPIPMHRTMAESLDLAMDRIRDIQREARKEGWSGERPRWPMIILRSPKGWTGPKEVDGKKVEDFWRSHQVPVSNARGDATHRKILEEWLRSYRPQELFDGKGRFLPEIAALAPEGAKRMGALPHANGGLLKKDLILPDWKSLALDIGQPGETIAEATRLMGAYLREVIRLNAEARNFRLMGPDETASNRLDAVFEVTNRVWMEKIESYDVHLACEGRVMEVLSEHLCQGWLEGYLLTGRHGVFSCYEAFIHIVDSMVNQHAKWLKVSAELPWRKPIASLNYLLTSHVWRQDHNGFSHQDPGFADFVANKKADIVRLYFPPDANTLLWVTDHCLRTWNRINVITAGKQPQPQWLTAEQAERHCEAGAGIWEWACTCPADEEPDVVMACCGDVPTLEILAAVGLLRRELPDLRIRVVNVVDLMTLQSHTTHPHGFTDDEFDALFTKEKPVIFAYHGYPYLIHRLTYKRTNHANFHVHGFQEEGTTTTPFDMAVMNELDRFHLVIAAVRRLPNLGMGGERVIGRCEQALAEHASYARQYGEDMPEIREWSWPYKTAAEAGD

SEQ ID NO: 593 - protein, 860 aa, Methylobacterium radiotolerans JCM 2831
MVGVRFSSYREADLDATHGAKERHQGGHRDEAQGLAFVPGPLGPGNLRRIDAYWRAANYLSVGQIYLMANPLLREPLKPEHVKPRLLGHWGTTPGLNFIYAHLNRAIRQRDLDMIAVWGPGHGAPGLVANAYLEGTYSEIYPNVAQDLDGMARLFRQFSFPGGIPSHASPELPGSIHEGGELGYSLAHAFGAALDNPGLIVACVVGDGEAETGPLAASWHSNKFLNPTTDGAVLPILHLNGYKIANPTLLARMPTDELRSLLVGYGYEPSFVEGDEPAAMHQAMATALDAVLDEIAAIRHSARCGELRRPRWPMIVLRSPKGWTGPKDVDGKPVEGTWRSHQVPVAATRENPEHRAILEAWMRSYRPEELFAEGGSLVPELAALAPKGPRRLSANPHANAHGTRPLRLPDLRQLAVAVSEPGRSQGEATRALGRYLREVLTLNADSRNFRLMGPDETASNRLDAAFEVTGRAWQEEILPGDDHLARDGLVMEVLSEHLCEGWLEGYVLTGRHGLFATYEAFAHVVDSMVNQHAKWLKSSRDLPWRRPVPSLNILLSSHVWRQDHNGFSHQDPGFIDFVANKRGDTARIYLPPDANCLLCVTDHCLRTYDRINVVVAGKQPAPQWLSLDEAVTHCAAGVGVWEWASNEGEAEPDVVMACAGDVPTQETLAAVDWLRRHVPEMRVRVVNVVDLMTLPAPETHPHGLDDPTFDSLFTRDRPVVFAYHGYPWLIHRLTYKRTNHGNFHVHGFIEEGTTTTPFDMCVLNRLDRFHLAQAAIRAVPRLGARAEHAEEALRDALAAHREHVRRTGDDLPEVRDWTWSGRHAPGDHDRRIEGDIMQCGPTDADGPGRSGTVDGCTVVT

SEQ ID NO: 594 - protein, 851 aa, Methylobacterium radiotolerans JCM 2831
MDARREPTKTRQERRDGGRADDGHDLTFVPGPLGPDSLQRIHAYWRAANYLSVGQIYLMANPLLREPLKPEHVKPRLLGHWGTTPGLNFIYAHLNRIIRQRALNMIAVWGPGHGAPGLVANAYLEGTYSEIYPDVARDAEGMERLFRQFSFPGGIPSHASPELPGSIHEGGELGYSLAHAFGAALDNPGLIVACVVGDGEAETGPLAASWHSNKFLNPTTDGAVLPILHLNGYKIANPTLLARMPADELRSLLVGYGYEPTFVEGDEPAAMHQAMAAALDAVLDEIAAIRHSARCGKVRLPRCPMIVLRSPKGWTGPKAVDGKPVEGTWRSHQVPVAATRENPEHRAILEDWMRSYRPEELFAEDGSLVPELAVLAPKGPRRISANPHANAHKSASLRLPDLRDCAVPVPGPGRSRAEATRTLGGYLREVLSLNKDARNFRIMGPDETVSNRLDAVFDVTGRAWQEAMLPGDDHLLRDGRVMEVLSEHLCEGWLEGYVLTGRHGLFATYEAFAHVVDSMVNQHAKWLKSSRDLPWRRPVPSLNILLSSHVWRQDHNGFSHQDPGFIDFVANKRGDTARIYLPPDANTLLCVTDHCLRTYDRINVVVAGKQPAFQWLTLDEAVTHCAAGVGIWEWASNEGETEPDLVMACAGDVPTQETLAAVDWLRRHVPELRIRVVNVVDLMTLPAPETHPHGLDDPTFDSLFTRDRPVVFAYHGYPWLIHRLTYKRTNHGNFHVHGFIEEGTTTTPFDMCVLNRLDRFHLAQAALRAAPRLGARGEHAEEALRDALAAHRAYVRQTGDDLPEVRDWTWPERHAPGDHDRRIEGDIMQCGPTDTAKPGQAGTVDGWAVVN

SEQ ID NO: 595 - protein, 861 aa, Methylobacterium extorquens DM4
MDARRDARNHREDRYDGGHRDDGHGLAFVPGPLGPDSLKRIDAYWRAANYLSVGQIYLMANPLLREPLRPEHVKPRLLGHWGTTPGLNFIYAHLNRVIRERDLDMIAVWGPGHGAPGLVANAYLEGTYSEIYPDVALDIDGMARLFRQFSFPGGIPSHASPELPGSIHEGGELGYSLAHAFGSALDNPGLTVACIVGDGEAETGPLAASWHSNKFLNPRSDGTVLPILHLNGYKIANPTLLARMPEDELRSLLVGYGYEPTFVEGDEPAPMHQAMAAALDAAFDAIAEIRASARRGETGRPRWPMIVLRSPKGWTGPESVDGKPIEGTWRSHQVPVAAVREDPEHRAILEAWMRSYRPEELFAEDGSLVPDLTALSPKGPRRISANPHANAHKSAPLRLPDLRRLAVAVPEHGRTTAEATRALGAYLRDVMTLNAEARNFRIMGPDETASNRLDAVFEVTNRTWQEEILPGDDHLARDGRVMEVLSEHLCEGWLEGYVLTGRHGLFATYEAFVHVVDSMVNQHAKWLKSSRDLPWRRPVPSLNILLSSHVWRQDHNGFSHQDPGFIDFVANKRGDTARIYLPPDANTLLCVTDHCLRTYDRINVVVAGKQPALQWLSLDEAARHCAAGAGIWEWASNEGDAEPDVVLACAGDVPTQETLAAVDWLRHHVPELRVRVVNVVDLMTLPGRETHPHGLDDPTFDSLFTRDRPVVFAYHGYPWLIHRLTYKRTNHANFHVHGFVEEGTTTTPFDMCVLNRLDRYHLAQAALRSAPRLGARGEHAEEALRDALARHREHVCRTGDDLPVVRDWTWPERLARSPAPGTRPDDGRVLLATTVADEVMLDEYEQGGRGESAELGPRSAS

SEQ ID NO: 596 - protein, 848 aa, Methylobacterium extorquens AM1
MDATHGSREHHDGECRDDGDGLAFVPGPIGPDGLRQIDAYWRAANYLSVGQIYLMANPLLREPLKPEHVKPRLLGHWGTTPGLNFIYAHLNRVIRERDLDMIAVWGPGHGAPGLVANAYLEGTYAETYPDVAHDLDGMARLFRQFSFPGGIPSHASPELPGSIHEGGELGYSLAHAFGAALDNPGLTVACVVGDGEAETGPLAAAWHGNKFLDPRSDGTVLPILHLNGYKIANPTVLARIPREELRSLLVGYGYEPTFVEGDEPAIMHQAMAAALDAAFDAITEIRIRARRGEAGRPRWPLVVLRSPKGWTGPGSVDGKPVEGTWRSHQVPVAAVRENPEHRAILERWMRSYRPEELFTPDGSLVPDLAALPPRGPRRLSANPHANAHRGAPLRLPELRRLAVTVPERGRTKAEATRALGVYLRDVLTLNAEARNFRIMGPDETASNRLDAVFEVTSRAWQEEILPEDDHLGRDGRVMEVLSEHLCEGWLEGYVLTGRHGLFATYEAFAHVIDSMVNQHAKWLKSARDLPWRRPVPSLNILLSSHVWRQDHNGFSHQDPGFIDFVANKRGDTARIYLPPDANCLLCVMDHCLRTYDRINVVVAGKQPALQWLDMDAAARHCAAGVGIWDWASNEGEAEPDVVMACAGDVPTQETLAAVDWLRRYVPELKVRVVNVVDLMTLPARETHPHGLDDPTFDSLFTRDRPVMFAYHGYPWLIHRMTYKRTNHGNFHVHGFIEEGTTTTPFDMCVLNRLDRYHLAQAALRAVPGLGARGEHAEEALRDALAAHRVHVCRAGDDLPEVKDWSWPDRHGDEHPDRRRIEADIMQCDTAGAEEPRPARTADDRACNA

SEQ ID NO: 597 - protein, 832 aa, Methylobacterium nodulans ORS 2060
MTVLTGSSRNDARAARQDAGDGFVPGPLGPQELAGLDAYWRAANYLSVGQIYLLDNPLLREPLAPAHVKPRLLGHWGTTPGLNFIYAHLNRVIRRRDLDMIAVWGPGHGAPGLVANAYLEGTYSEVYPDVAPDAEGMRRLFRQFSFPGGIPSHASPELPGSIHEGGELGYSLAHAFGAALDNPDLIVACVVGDGEAETGALAASWHSAKFLDPRTDGTVLPILHLNGYKIANPTILARMPEAELMSLLTGYGYDPIVVAGEEPAPMHQAMAAALDRALDRIAQIRREAGCERPRWPMIVLRSPKGWTGPKVVGGLPVEGTWRSHQVPVAATRENPEHLAILERWMRSYRPETLFDAAGRLVPDLAALAPAGERRLSANPQANGGRHAQPLRRPPIADHAVSVEAPGAATAEATRVLGAYLRDVVTLNTASRNFRIMGPDETASNRLDAVLSVTNRVWQEEILPGDDHLGRTGRVMEVLSEQLCEGWLEGYLLTGRHGLFASYEAFIHVVDSMVSQHAKWLKSSRALPWRRPVPSLNLLLSSHVWRQDHNGFSHQDPGFIDFIANKRGDVARVYLPPDANCLLWVMDHCLGTHDRINVVVAGKQPAPQWLAPDAAARHCAAGIGVWDFASNEGEGEPDVVMACAGDVPTMETLAAVDWLRRAVPDLRMRVVNVVDLMTLPSPDMHPHGIEDAAFDGLFTKDRPVIFAYHGYPWLIHRLTYRRTNHANFHVHGFQEEGTTTTPFDMAVMNRLDRHHLAIAALRRVPRLGARADRAVHALEERLAVHRAHVCRTGEDLPEIRDWRWPQPGMAKPEESGARIQEPDREALKAGGSS

SEQ ID NO: 598 - protein, 833 aa, Methylobacterium nodulans ORS 2060
MTVLTGSPRNDAHPAQPDARDDFVPGPLGPQELVGLDAYWRAANYLSVGQIYLLDNPLLREPLAPAHVKPRLLGHWGTTPGLNFIYAHLNRVIRRRDLDMIAVWGPGHGAPGLVANAYLEGTYSEVYPDVAPDAEGMRRLFRQFSFPGGIPSHASPELPGSIHEGGELGYSLAHAFGAALDNPDLIVACVVGDGEAETGALAASWHSAKFLDPRTDGTVLPILHLNGYKIANPTILARMPGAELTSLLVGYGYDPIVVAGEETAPMHQAMAAALDRALDRIAQIRREAGCERPRWPMIVLRSPKGWTGPKVVGGLPVEGTWRSHQVPVAAMRDNPEHLAILERWMRSYHPETLFDAAGRLMPDLAALAPAGERRLSANPQANGGRHAQPLRRPPIAAHAVAVEAPGAATAEATRVLGAYLRDVVTLNAASRNFRIMGPDETASNRLDAVLSVTNRVWQEEILPGDDHLARSGRVMEILSEQLCEGWLEGYLLTGRHGLFASYEAFIHVVDSMVSQHAKWLKSSRALPWRRPVPSLNLLLSSHVWRQDHNGFSHQDPGFIDFIANKRGDTARVYLPPDANCLLWVMNHCLGTHDRINVVVAGKQPAPQWLALDAALRHCEAGIGVWDWASSEGEGEPDVVMACAGDVPTMETLAAVDWLRRVVPDLRVRVVNVVDLMTLPSPDLHPHGLDDATFDGLFTRDRPVVFAYHGYPWLIHRLTYRRTNHANLHVHGFMEEGTTTTPFDMAVMNRLDRHHLAIAALRRVPRLGARADRAERMLQERLAVHRAHVCRTGEDLPEIRDWRWPQPGMVKPDEAGARATMGRTGGSTKPAGSP

SEQ ID NO: 599 - protein, 832 aa, Methylobacterium sp. 4-46
MTGTAGTTRATASVRGRDGSVPGPLAPHDLAGLDAYWRAANYLSVGQIYLMENPLLREPLTPAQVKPRLLGHWGTTPGLNFIYAHLNRVIRARDLDMIAVWGPGHGAPGLVANAYLEGTYSEIYPDVAQDEAGMARLFRQFSFPGGIPSHASPELPGSIHEGGELGYSLVHAFGAALDNPDLIVACVVGDGEAETGALAASWHSAKFLDPRHDGTVLPILHLNGYKIANPTILARMPEAELRSLLVGYGYDPIMVAGDEPAPMHQAMAAALDDALDRIARIRHEAAAERPRWPMIVLRSPKGWTGPAQVDGKPVEGTWRAHQVPVAAIRDNPEHLAILDAWLRSYAPETLFDAAGRLRPDLAALAPRGERRLSANPQANGGRHPKPLRRPPLAQHAIPVPAPGATEAEATRVLGGYLRDLLSLNAEARNLRIMGPDETASNRLDAVFGVTDRAWQERILPGDEHLGRFGRVMEVLSEQLCEGWLEGYLLTGRHGLFASYEAFIHVVDSMVNQHAKWLKSARALPWRRPVPSLNLLLSSHVWRQDHNGFSHQDPGFIDFIANKRGDTARVYLPPDANTLLWVADHCLGTHDRINVIVAGKQPAPQWFSPEAAARHCEAGLGVLDFASTEGQGEPDVVMACAGDVPTMETLAAVDALRRAVPDLAIRVVNVVDLMTLASPDAHEHGIDDAAFDGIFTRDRPVIFAYHGYPWLIHRLTYKRTNHANFHVHGFIEEGTTTTPFDMAVMNRLDRHHLAIAALRRVPRLGARAGRVERALRERLAIHREHVCRTGEDLPEIRDWRWGEGEWPPAASADPSREEDADPRDLEAGWQFMS

SEQ ID NO: 600 - protein, 783 aa, Variovorax paradoxus S110
MTEHDDFALLDAWWRAANYLSVGQIYLMDNPLLREKLSLSHIKPRLLGHWGTTPGLNFVYAHMNRAIAARELDAIFVAGPGHGGPGVVANTYLEGTYSEVYPAIGQDADGMKRLFTQFSFPGGIPSHVAPETPGSIHEGGELGYSLLHAYGAVFDNPGLLACCVIGDGEAETGALAASWHSNKFLNPESDGAVLPILHLNGYKIAGPTVLARIPDEELAQLLRGYGHEPYFVAGHEPAQMHRLMAAALDKALDGIDAIQANARKNGFRERPRWPMIVLRSPKGWTGPRQVDGVPVEGTFRAHQVPLTGFAAKPAHVGLLEDWMRSYRPEELFDEGGALRPEIAALAPKGARRMSANPHTNGGLLLRDLAMPPFREHAVAVATPGAADAEATRVAGQFLREVMRRNEAARNFRVMGPDETTSNRLGALFEVTARTSTAEILPGDDHVSPEGRVMEVLSEHLCQGWLEGYLLTGRHGFFSCYEAFIHIVDSMFNQHAKWLKVTRGIGWRRPIASLNYLLTSHVWRQDHNGFSHQDPGFLDHVVNKKAEVVRVYLPPDANTLLSVADHCLKSRNYVNVIVAGKQPGPQWLDIESAVRHCTVGLGIWTWASNDQDAAPDVVMACAGDVPTLETLAAVDLLRRMLPELKVRVVNVVDLMALQSPDAHPHGLPHAEFDAIFTTDRPVVFAFHGYPSLVHRLTYKRTNHDNFHVHGYCEEGTTTTPFDMTVLNRLDRFHLAADAIARVERFRDSAGHVQQHLRDKLLEHRAYVTVHGKDMPEIEDWRWAG

SEQ ID NO: 601 - protein, 778 aa, Oceanicola granulosus HTCC2516
MSDDLTQVDAWWRAANYLSAAQIYLLDNPLLQEPLRADHIKPRLLGHWGTSPGLNFVYAHLNRAIRARDLDMIFIAGPGHGGPAVLANAWLEGTYGEVYPEAGHGAEEIRRFVKQFSFPGGVPSHAAPETPGSIHEGGELGYSLMHAHGAAFDNPDLHVACVIGDGEAEAGPLAASWPSIRFVDAARDGAVLPILHLNGYRIAGPTVMGRMDDAALDALFRGHGYAPLFVCGDEPARMHRDMAAALDAAFDSIAAIQRAARDGTATPAETPRWPLIVLRSPKGWTGPERVDGAPVEGTHRAHQIPLPGVKDDPDHLRQLEAWLKSYRPDELFRDGAPAEALRAIAPEGVRRMSANPAANGGRLLRPLDLPALAPAEVEVPAPGAVQASANKALGAWLREVMRANPDNFRLFGPDETESNKLDAVFDVTGRKATGEVRDDDADLAPDGRVMEVLSEHLCQGWLEGYLLTGRHGLFNSYEAFVHIAASMFNQHAKWLRVSGGLAWRAPVASLNYLLTSHVWRQDHNGFSHQDPGFLDHVASKGAEVVRIYLPPDANCLLQVARACLESRDRVNVIVSGKHEESQWLSPEAARAHCEAGLGAWDWASDEVPPDVVMACAGDVPTQETLAAVALLREHLPDLALRVVNVVDLMALQPPPRNADGLDDAGFDALFTTDKPVIFAFHGYPGLIHELTYRRRNHHNFHVHGYSESGTTTTPADMAVRNALDRFHLVLAALRRSGRDDPAAEALAAHCRDRLEAHHDHVRATGTDLPEIRDWRWPG

SEQ ID NO: 602 - protein, 793 aa, Nodularia spumigena CCY9414
MTLVSTPQTKPLADEELHKINAYWRAANYLSVGQIYLFDNPLLREPLKKEHVKPRLLGHWGTTPGLNFIYVHLNRVIKKYDLNTIYIAGPGHGGPGLVANTYLEGTYSEYYPNISQDTEGMKKLFKQFSFPGGIPSHVAPETPGSIHEGGELGYALVHAYGAAFDNPDLIVAAVVGDGEAETGALATSWHSNKFLNPVHDGAVLPILHLNGYKIANPTLLARLSYEELENLFLGYGYKPYFVEGVEPADVHQQMAATLDIAIAEIQNIQREARVHGFSQRPQWPMIILRTPKGWTGPKEVNGKKTEGYWRSHQVPFGNVTSNPEHLKLLEEWMKSYKPEELFDANGTLIPELAELAPAGHRRMGDNPHTNGGMLLRDLKMPDFPDYAVDVTHPGTTYAEATKVMGQLLRDVMKLNEESSNFRIFGPDETASNRLGAVLEVTDRTWVADILPEDENLSPNGRVMEVLSETNCQGWLEGYLLTGRHGFFSCYEAFIHIIDSMFNQHAKWLKTTNDIPWRRPIASLNYLLTSHVWRQDHNGFSHQDPGFIDHVLNKKAEIIRVYLPPDANTLLSVTDHCLRSRHYVNVIVAGKQPSLQYLDMDAAIKHCTKGLSIWEWASNDKGSEPDVVMACAGDVPTLETLAAVDILRQHFPELKVRVVNIVNLMKLQPQSEHPHGLSNKEFDTIFTTDKPIIFAFHGYPWLIHRLTYRHTNHKNLHVRGYKEEGTTTTPFDMVVLNDLDRFHLVMDVIDRVPQLGSKAAYVKQMLQDKLIEHKHYIQQHGEDMPEIRDWKWSY

SEQ ID NO: 603 - protein, 793 aa, Nostoc punctiforme PCC 73102
MTLASPLQTKPLTDEELRKINAYWRAANYLSVGQIYLLDNPLLREPLKLEHVKPRLLGHWGTTPGLNFIYAHLNRVIKKYDLNTIYIAGPGHGGPGLVANTYLEGTYTKYYHNISQDAEGIQKLFKQFSFPGGIPSHVAPETPGSIHEGGELGYALVHAFGAAFDNPDLIVAAVVGDGEAETGALATSWHSNKFLNPVHDGAVLPILHLNGYKIANPTVLARISHEELESLFVGYGYKPYFVEGDDPADVHQQMAATLDIAIAEIQSIQREARVHGYTERPQWPMIVMKTPKGWTGPKEVDGKKTEGSWRSHQVPFGNIAKQPEHLKLLEDWMKSYKPEELFDANGTLIPELAELAPKGHRRMGDNPHANGGLLLRDLKMPDFQKYAVDVLKPGQAIAEATQVAGIFLRDIMQLNQESRNFRIVGPDETVSNRLGAVLEVTDRDWAAQILPEDDHLSPDGRVMEILSETNCQGWLEGYLLTGRHGFFSCYEAFIHIVDSMFNQHAKWLKTTRHIPWRKPIASLNYLLTSHVWRQDHNGFSHQDPGFIDHVVNKKAEIVRVYLPPDANTLLSVTDHCLRSRNYVNVIVAGKQPALQYLNMDAAIKHCTKGIGIWEWASNDKDGEPDVVMACAGDIPTLETLAAVDILRQHFPELKVRVVNVVDLMTLQPKSEHPHGLSEKDFDTIFTTDKHIIFAFHGYPWLIHRLTYRHTNHEQLHVRGYKEEGTTTTPFDMVVLNELDRFHLVMDVIDRVPKLGYRAAYVKQQLQDKLIEHKHYIEKYGDDMPEIRDWKWPY

SEQ ID NO: 604 - protein, 793 aa, Anabaena variabilis ATCC 29413
MTLASPPQIKPLTDEELYKINAYWRAANYLSVGQIYLLDNPLLREPLNKEHVKPRLLGHWGTTPGLNFIYVHLNRIIKKYDQSMIYIAGPGHGGPGLVANTYLEGTYSEYYPNISQDAGGMQKLFKQFSFPGGIPSHVAPETPGSIHEGGELGYALVHAFGAAFDNPDLIVAAVVGDGEAETGALATSWHSNKFLNPASDGAVLPILHLNGYKIANPTVLARLSYEELESLFVGYGYKPYFVEGSDPAVVHQQMAATLDTVIAEIHSIQREARVHGFSKRPQWPMIILRTPKGWTGPKEVDGKKTEDYWRSHQVPFGNVTGNPEHLKLLEEWLKSYKPEELFDANGRLVPELAELAPKGDRRMGDNPHANGGILLRDLVMPNFQNYAVEVPQPGRVTAEATQVTGKFLRDVMKLNLDSRNFRVFGPDETASNRINAVLDVTDRTWVAQKLPEDDHLDPSGRVMEILSETCCQGWLEGYLLTGRHGFFSCYEAFIHIIDSMFNQHAKWLKTTRHISWRRPVASLNYLLTSHVWRQDHNGFSHQDPGFIDHVVNKKSEIIRVYLPPDANTLLSVTDHCLRSRNYVNVIVAGKQPALQFLDMDAAIKHCTKGIGIWEWASNDQGSEPDVVMACAGDVPTLETLAAVDILRQHFPDLKVRVVNVVDLMTLQPKTEHPHGLNPKDFETIFTTDKPIIFAFHGYPWLIHRLTYRQPNHNNLHVRGYKEEGTTTTPFDMVVLNDLDRFHLVMDVIDRVPKLGYKAAYVKQRLQDKLIEHKHYISKYGEDMPEINDWQWPY

SEQ ID NO: 605 - protein, 710 aa, 'Nostoc azollae' 0708
MTLASTRQIKPLSDTELQKINAYWRAANYLSVGQIYLLDNPLLKEPLKIDHVKPRLLGHWGTTPGLNLIYAHLNRVIKKYDLSTIYIAGPGHGGPGLVANTYLEGTYSEYYPNISQDAGGMRKLFKQFSFPGGIPSHVAPETPGSIHEGGELGYALVHAYGAAFDNPDLIVAAVVGDGEAETGALATSWHSNKFLNPVTDGAVLPILHLNGYKIANPTILARIPHEELESLFIGYGYKPYFIEGSDPADVHQKMAATLDIVIAEIQGIQREVRIHGFKKRSQWPMIILRTPKGWTGPKEVDGKKTEDYWRSHQVPFGDIAGRAEHLQLLEDWMKSYKPEELFDANGQLLPELAELAPTGQRRMGDNPYANGGILLRDLIMPDFSNYAVEVPKPGTVNAEATKVTGKFLRDIMKENQESHNFRVFGPDETASNRIDPVLEVTNRTWVAETLPEDDHLSPNGRVMEMLSETNCQGWLEGYLLTGRHGFFSCYEAFIHIIDSMFNQHAKWLKTTRHISWRRPIASLNYLLTSHVWRQDHNGFSHQDPGFLDHVINKKSEIIRVYLPPDANTLLSVTDHCLRSRNYVNVIVAGKQPALQYLDIDTAIKHCTKGLGIWEWASSDQGGDTDVVMACAGDIPTLETLAAVDILRQYFPELKVRVVSVVNLMKLQPQSEHPHGLTSKEFDTIFTTDKPVIFAFPWLSLVNSSSHLSSY

SEQ ID NO: 606 - protein, 793 aa, Gloeobacter violaceus PCC 7421
MVVAKIEKTGTLSTEQLQKMHAYWRAANYLSVGQIYLMDNPLLREPLKLEHVKPRLLGHWGTTPGLNFIYVHLNRVIQDEDLDMIYIAGPGHGGPGLVANTYLEGTYSEYYPNISEDAEGMKRLFKQFSFPGGIPSHVAPETPGSIHEGGELGYAVSHAYGAVFDNPDLIVACVVGDGEAETGPLATSWHSNKFLNPVRDGAVLPILHLNGYKIANPTVLARISHEELEKLFEGYGYKPYFVEGSEYEPTHQLMAATLDTCIAEIKAIQHEARTGGATARPRWPMIVLRTPKGWTGPKEVDGKKTEDFWRSHQVPFSEMAGKPEHVQLLETWMRSYQPEELFDENGTFLGELKALAPKGHRRMGDNPHANGGILLKDLKMPDFRSYAVDVAKPGTTFAEATKVMGIFLRDVMKANLDQRNFRIVGPDETASNRWGPLFEITNRTWMDAIHPYDDHLSQDGRVMEILSEHTCQGWLEGYLLTGRHGFFSCYEAFIHLVDSMFNQHAKWLKTTRHIPWRRPIASLNYLLTSHVWRQDHNGFSHQDPGFIDHVVNKRAEVIRVYLPPDANTLLSVTDHCLRSRHYVNVVVAGKQPALQYLDMDAAIKHCTKGIGIWDWASNDQGVEPDVVMACCGDIPTLETLAAVDILRQNFPDLKIRVINVVNLMKLQPESEHPHGLSDKDFDSIFTPDKPVVFAFHGYPWLIHRLTYRRNNHNNIHVRGYKEEGTTTTPFDMVVMNDLDRFNLADDVIDRVPRLRYTAAHVKQMLHDKLIEHKQYIHEHGDDMPEIRDWCWPY

SEQ ID NO: 607 - protein, 791 aa, Synechococcus sp. JA-2-3B'a(2-13)
MVLAEQLSTKPLTADELRKMDAYWRAANYLSVGQIYLMDNPLLREPLKLEHVKPRLLGHWGTTPGLNFIYVHLNRIIKRENLNILYITGPGHGGPALVANTYLEGTYSEVYPNIGQDAEGMRKLFKQFSFPGGVPSHVAPETPGSIHEGGELGYALAHAFGAAFDNPDLLVACVVGDGEAETGPLAASWHSNKFLNPIHDGAVLPILHLNGYKIANPTVLARLSRDELQSLFVGYGYKPYFVEGCEPAEMHQLMAATLDTVIHEIQEIQQHARSKGDPTRPQWPMIILRTPKGWTGPKEVDGKKVEDFWRSHQVPLADLAKKPEHLKALEDWMRSYKPEELFDENGRLLPELQELAPKGEKRMGALPHANGGLLTRELKMPDFRRYAVPVPRPGTTEAEATRVLGQFLRDVMKLNPHNFRLFGPDETASNRLDAVFEASDRTWVAPIYDCDEHLSPDGRVMEILSEHVCQGWLEGYLLTGRHGFFSCYEAFIHLVDSMFNQHAKWLKTTRHIPWRRPIPSLNYLLTSHVWRQDHNGFSHQDPGFLDHVVNKKAEIIRVYLPPDTNTLLSVADHCLRSRHYVNVIVAGKQPALQYLDMDAAIKHCTQGLGIWEWASNDQGSEPDVVMACCGDVPTMETLAAVDFLRQHLPEIKIRVVNVVNLMKLQPPSEHPHGISDKEFVSIFTPDKPIVFAFHGYPWLIHRLTYRRPNHHNLHVRGYKEEGTTTTPFDMCVLNQVDRFNLANDVLERVDRFKYRRDHVQQLIRDKLVEHKQYICKHGEDLPEVRNWKWPY

SEQ ID NO: 608 - protein, 790 aa, Sinorhizobium medicae WSM419
MDAYWRASNYLSVGQIYLLDNPLLRESLKREHIKPRLLGHWGTSPGLNMLYVHLNRVIKRDDLNMIYVIGPGHGGPSLVAHAYLEGTYSEFYPNISEDTEGMKRLFKQFSFPGGIPSHVAPETPGSIHEGGELGYALSHAYGAAFDNPDLIVACVVGDGEAETGPLATGWQSNKFLNPARDGCVLPILHLNGYKIANPCFLARIPEEELRKFFEGMGYRPYFVEGRDPEDVHQKLAGVLDTAVGEIKEIWADARTNGNLKRPAWPMIVFRTPKGWTCPPEIDGKKCEDYWRSHQVPMGEMDKPEHIRILEQWMKSYRPEELFDETGRLTAEIASLAPAGHRRMSDNPHANGGLLLRDLKMPDFREYAVEVTSPGATMAESARAMGKFLRDVMKANLESKNFRLFSPDENNSNRWQDVLEVTDRCYMADIYPEDDHLSPDGRIMEVLSEHQCQGWLEGYLLTGRHGFFSCYEAFIHIIDSMFNQHAKWLKVCGEIPWRRPIGSLNYFLSSHVWRQDHNGFSHQDPGFIDHVVNKKADVIRVYLPPDANTLLCVTDHCLRSRDYVNVVVAGKQPAPQWLTMSEAVRHCAMGLSIWDWASSDKGSEPDVVMACCGDVPTLETLAAVQLLREHLPELKVRVVNVVNLMKLQPAEEHPHGLSDRDFDAFFTRDKPIIFAFHGYPWLIHRFTYRRKNHGNLHVRGYKEEGTTTTPFDMVVLNELDRFHLVEDVIDRLPQLGARAAYFKQAIHEKLIEHREYIEKHGDDMLAISGWKWGVKDTTAASRKTSTEGDNV

SEQ ID NO: 609 - protein, 821 aa, Rhizobium leguminosarum bv. viciae 3841
MVSLKTARDAKVALHAKMATGGPLSTEELQSIDAYWRASNYLSVGQIYLLDNPLLKEPLRREHIKPRLLGHWGTSPGLNMLYVHLNRVIKRDDLEMIYVIGPGHGGPSLVAHAYLEGTYSEVYPNISQDAEGMKRLFKQFSFPGGIPSHVAPETPGSIHEGGELGYALSHAYGAAFDNPNLIVACVVGDGEAETGPLATGWHGNKFLNPARDGCVLPILHLNGYKIANPCFLARIPRDELRKFFEGMGYTPYFVEGSDPENVHQQLAGVLDTAVADIQEIWATARTKGKIKRPMWPMIIFRTPKGWTCPPEIDGKKCEDYWRAHQVPMGDMDKPEHIRILQEWMKSYRPEELFDDSGRFKPGLAALAPVGQRRMSDNPHANGGLLLRDLKMPDFRDYAVSVPSPGQTHTEAARVMGKFLRDIMKMNMDSKNFRLFSPDENNSNRWQDVLEVTDRCYMADIYPEDDHLSPDGRVMEVLSEHQCQGWLEGYLLTGRHGFFSCYEAFIHIIDSMFNQHAKWLKVCNDIPWRRSVASLNYFLSSHVWRQDHNGFSHQDPGFIDHVVNKKADVVRIYLPPDANTLLSVTDHCLRSRNYVNVVVAGKQPAPQWLTMDQAIKHCSEGLGIWEWASNDKGSEPDVVMACCGDVPTLETLAAVELIREHLPELKVRVINVVNLMKLQPPSEHPHGLPDRDFDALFTKNKPIIFAFHGYPWLIHRLTYRRTNHGNLHVRGYKEEGTTTTPFDMVVLNEMDRFHLVEDVIDRLPQLGARAAYFKQAIREKLVEHRQYIEKYGDDMPAISGWKWGSKAQPKTRQRTSTEGDNA

SEQ ID NO: 610 - protein, 817 aa, Sinorhizobium meliloti 1021
MTSPRTARDVSSQEPLSAGPLSADELQRMDAYWRASNYLSVGQIYLLDNPLLSEPLKREHIKPRLLGHWGTSPGLNMLYVHLNRVIKRDDLEMMYVIGPGHGGPSLVAHAYLEGTYSEVYPDISQDAEGLRKLFKQFSFPGGIPSHVAPETPGSIHEGGELGYALSHAYGAAFDNPELIVACVVGDGEAETGPLATGWHGNKFLNPARDGCVLPILHLNGYKIANPCFLARIPREELQKFFEGMGYAPLFVEGHDPADVHQQLAAALDTALADIRRIQTDARVNGNLKRPAWPMIVFRTPKGWTCPAEIDGKKCEDYWRSHQVPMGDMDKPEHIRILEGWMKSYRPEELFDGDGRLTAELAALAPTGRRRMSDNPHANGGLLLRDLKMPDFRDYAVAVQSPGAATAESARVMGSYLRDVMKLNLKSGNFRLFSPDENNSNRWQDVLEVTDRCFMADIYPEDDHLSPDGRLMEVLSEHQSQGWLEGYLLTGRHGFFSCYEAFIHIIDSMFNQHAKWLKVCNEIPWRRPIASLNYFLSSHVWRQDHNGFSHQDPGFIDHVVNKKADIIRVYLPPDANTLLSVTDHCLRSRNYINVVVAGKQPSPQWLTMDQAVKHCTEGLGIWEWASNDKGCEPDVVMACCGDVPTLETLAAVQLLREHLPELKVRVINVVNLMKLQPSGEHPHGLPDRDFDALFTKDKPIIFAFHGYPWLIHRLTYRRTNHANLHVRGYKEEGTTTTPFDMVVLNHLDRFHLVEDVIDRLPQLGARAAYFKQAIHERLIDHRHHIEKYGEDMPVISGWKWGAGSAGKAQGTSTKGDNV

SEQ ID NO: 611 - protein, 837 aa, Verrucomicrobium spinosum DSM 4136
MSKNSRKSSSAKTGSPTAAKKNTNAKDPTSGAIKGPLSEDQLARMDAWWRAANYLSVGQIYLQDNPLLTKRLKREHIKPRLLGHWGTTPGLNFIYVHLNRIIKEHDLNMLLITGPGHGGPGIVANTYLEGTYSEVYPEISEDEVGLQRLFKQFSFPGGIPSHVAPETPGSIHEGGELGYSLSHAYGAAFDNPDLIIPTIVGDGEAETGPLATGWHGNKFINPVRDGAVLPILHLNGYKIANPCFLARIPHEELQKFFEGMGYRPWFVEGDDPAILHQQMASTLDKVTQEIRSIWKNARTHGFQGRPAWPMIVLRTPKGWTCPKEIDGLKCEGYWRAHQVPMGDMDKPEHVKVLEAWMKSYRPEELFDATGHLHENIASLAPGGTRRMSANPHTNGGLLLRDLRLPDFRDYATKCPAPGENFAEATREMGRFLRDVMKLNLERQNFRLFSPDENNSNRWQDVLQVTSRAYAAEILPEDDHLSPDGRIMEVLSEHQCQGWLEGYLLTGRHGFFSCYEAFIHIIDSMFNQHAKWLKVCRHIPWRRPIASLNYLLSSHVWRQDHNGFSHQDPGFLDHVINKKSEVIRVYLPPDANTLLSVTDHCLRSRNYVNVVVAGKQPAPVWLSMQDAAQHCAAGVGIWDWASNDQGGEPDVVMACCGDVPTLETLAAVELIRQHAPDVKVRVVNVVDLMKLQPVEEHPHGLHDREFDAIFTRDKPVIFAFHGYPWLIHRLTYRRTNHCNLHVRGYKEEGTTTTPFDMCVLNQLDRFTLMGDALSRVTRLGSRLGYILQFVHEQLHHHRAYICEHGDDVPEIRDWKWNAKLNGATRRGVRQADTSADNT

SEQ ID NO: 612 - protein, 811 aa, Methylobacterium extorquens PA1
MDAILKARRQPKRTARTSELALIDAYWRAANYLSVGQIYLYDNPLLVERLTKEHIKPRLLGHWGTTPGLNFIYVHLNRLIKKHDLDVIYITGPGHGGPALIANAYLEGTYSEVYPNISADAEGMKRLFKQFSFPGGIPSHVAPETPGSMHEGGELGYSLSHAYGAAFDNPDLIVACVVGDGEAETGPLATSWHSNKFLNPVSDGTVLPILHLNGYKIANPTVLARISHAELEHLFRGYGYTPYFVEGHDPAEMHQRMASTMDAVLRDIRRIKSDARDKGFTGRPFWPMIVLRTPKGWTCPKEIDGRRTEDYWRSHQVPMGEMHDNPAHVRMLEDWMQSYRPAELFDEGGRLRSELAELAPTGDRRMSANPHTNGGTLLRDLRLPDFHDYAIPVTAPGAAVAESTRVMGRFLRDVMDLNAEARNFRLFSPDENNSNRWQDALEVTNRAWVAETYPWDDHLAHDGRVMEMLSEHQCQGWLEGYLLTGRHGFFSCYEAFIHIIDSMFNQHAKWLKVCNHIPWRRPIGSLNYLLSSHVWRQDHNGFSHQDPGFIDHVVNKKAEVVRVYLPPDANCLLSVTDHCLRSRNYVNVIVAGKQPAPQWLTMDQAVKHCTAGLGIWEWASNDRGSEPDVVMACCGDVPTLETLAAVDLLRCHAPDLKVRVINVVNLMKLQPDTEHPHGLSDQDFDALFTTDKPVVFAFHGYPWLIHRLVYRRHGHSNFHVRGYKEEGTTSTPFDMCVMNDMDRFHLVSDVIDRVPGLAARAAYAKQAIRDKLIDHRAYIHRHGDDMPEVSGWSWSPMATTRGLGSTESDNV

SEQ ID NO: 613 - protein, 788 aa, Nitrobacter sp. Nb-311A
MNAYWRAANYLSVGQIYLYDNPLLKQSLTKDHIKPRLLGHWGTTPGLNFIYVHLNRVINKHDLDVIYITGPGHGGPGLVANAYLEGTYSEVYPNISPDEEGMKRLFTQFSFPGGVPSHVAPETPGSIHEGGELGYALSHAYGAAFDNPNLIVACVVGDGEAETGPLATSWHSNKFLNPASDGVVLPILHLNGYKIANPCVLARISHDELDHLFRGYGYTPYFVEGDEPEKMHELMAATMDKVVGEIRRIKSAAKDGFVERPLWPMIVLRTPKGWTCPKEIDGKRTEDYWRSHQVPMGEMHQNAAHVRLLEEWMKSYRPSELFDDSGQLRPELADLAPRGARRMSANPHTNGGLILRELRLPNFRDYAVDVTAPGAETAESTRVMGRFLRDVMKLNMETRNFRLFSPDENNSNRWQDVLEVTNRAWAASTYPWDDHLAPDGRVMEMLSEHQCQGWLEGYLLTGRHGFFSCYEAFIHIIDSMFNQHAKWLKVCNQIPWRRPIGSLNYLLSSHVWRQDHNGFSHQDPGFIDHVINKKAEVIRVYLPPDANCLLSVTDHCLRSRNYVNVVVAGKQPAPQWLTMDEAVRHCEAGLGIWEWASNDHGGEPDVVMACCGDVPTLETLAAVDLLRRYAPDLKVRVINVVNLMKLQPPSEHPHGLSDHDFDTLFTVDKPIIFAFHGYPWLIHRLIYRRTSHDNVHVRGYKEEGTTTTPFDMCVLNELDRFHLVSDVIDRVPKLGSRAAYAKQAIRDKLIDHRTFIVRYGDDMPEITGWRWGQQAASAAVRSTEADNV

SEQ ID NO: 614 - protein, 801 aa, Gemmata obscuriglobus UQM 2246
MAEPIPDALLNRMDAYWRAANYLSVGQIYLLDNPLLREPLRKEHVKPRLLGHWGTTPGLNFIYVHLNRAIRQHDLNVLYVCGPGHGGPGIVANVYLEGTYTEVYPHIGPDAAGLKKLFKQFSFPGGIPSHVAPETPGSIHEGGELGYALSHAYGAVFDNPDLIAACVVGDGEAETGPLATGWHSNKFLNPVRDGAVLPILHLNGYKIANPCFMARMPEDELRKLFEGYGYAPHFVSGEDPLPTHRQMAAAVDACVAEIKRIQADARANGFRTRPQWPMIVLRTPKGWTCPKEIDGKRCEGSWRSHQVPMSEAGTESHLRVLEGWMKSYRPEELFDAAGTFKPELAELAPRGTKRMGANPHANGGRLLVDLKLPDFRDYAVKVAHPGAETAESTRVQGKYLRDVMKLNLEAQNFRLFSPDELASNRWQDVLEVTDRCYTAEIVPGDDHLSPDGRVLEVLSEHQCQGWLEGYLLTGRHGFFSCYEAFIHIVDSMFNQHAKWLKVCNHIEWRRPVASLNYLLSSHVWRQDHNGFSHQDPGFIDHVMNKKAEVIRVYLPPDANCLLSVTDHCLRSRDYVNVVIAGKQPGPQWLDMTSAVQHCAEGLGVWEWASSAGAAEPDVVLACCGDVPTLEVVAAADLLRRHLPDLKVRVVNVVDLMKLQPPKEHPHGLSDAAFDRLFTKDKPVIFNFHGYPWLIHRLTYRRTNHNNIHVRGYKEEGTTTTPFDMCVLNEIDRFKLVIDVIERTPGLAARAGHVKELMDAKHKAHRAYVTEHGIDMPEVSGWEWGQRGKVPRGSSDTAADNA

SEQ ID NO: 615 - protein, 797 aa, Desulfomicrobium baculatum DSM 4028
MQTKALSPELVAMMDAYWRAANYLSVGQIYLYDNPLLKKELMLKHIKPRLLGHWGTVPGLNFIYVHLNRIIKAYDLNIINITGPGHGGPGLVANAYLEGTYSEVYPHISQDEEGLTRLFKQFSFPGGIPSHVSPETPGSINEGGELGYALSHAFGAAFDNPDLLVACVIGDGEAETGPMATSWHSNKFLNPVHDGAVLPILHLNGYKIAGPTVLARIPHDELEALFHGYGYTPHFVEGDEPMEMHVLMAATLDRVVGEIRRIQRDAREQGFTERPRWPMIILRTPKGWTCPREVDGKPTEGTWRSHQVPMGDMGHPGHVKLLETWMKSYRPQELFDKSGRLRPELAGLAPAGERRMSANPHANGGLFLRDLRLPDFGDYAVKVPKPGAVDAEATRVQGEFIRDVIARNPSTFRVFSPDETSSNRWGAVFEVTSRCSMAAIVPGDEHVAPDGRVMEMLSEHQCEGWLEGYLLTGRHGFFSCYEAFIHIVDSMFNQHAKWLDVTRGIPWRRPIASLNYLLSSHVWRQDHNGFSHQDPGFIDVAANKKSEVIRVYLPPDANTLLCVTDQCLRSRNCVNVVVAGKQPGPQWLDMDAAVKHCAAGIGIWPWASNDQGCEPDVVMACCGDVPTLETLAAVQLLREHFPALKIRVVNVVDLMKLQHHREHPHGLSDGDFDTLFTTDKPVIFAYHGYPWLIHRLTYRRTNHGNLHVRGFKEEGSTTTPFDMVVVNDLDRFRLMADVIDRVPQVGATAAYAKQAIRDKLIEHRQYIEEHGEDLPEIRNWRWGLGEKEKLAGGKRES

SEQ ID NO: 616 - protein, 823 aa, bacterium Ellin514
MTSMRIKSPRLPRLRKRHLVKQTAGMEPAIQGRMEGAEETALLRKMDAYWRAANYLSVGQIYLMKNPLLRRPLKRDDIKPRLLGHWGTTPGLNFIYVHLNRVIKEHDLSMIYLAGPGHGGPGVVANAYLEGTYSEVYHEISQSERGMQRLFKQFSFPGGIPSHAAPETPGSINEGGELGYVLTHAFGAVFDNPELIAAAVIGDGEAETGPLATSWHSNKFLNPVHDGAVLPILHLNGYKIAGPTVLARLPHHELRSLLEGYGYKPYFVEGVEPLATHRLMASVLDVVIAEITGIQQKARAEGFKTRPMWPMIVLRSPKGWTGPKVVDSVQIEGTFRAHQVPMADMDKPEHIRILERWMKSYQPEKLFDQKGSLRPELAELAPKGDRRMSANPNANGGQLLRDLQLPDFYDYAVKVLRPGAAQVSATTVQGQFIRDVLRLNEERKNFRVFSPDETASNRWSAVFEVTERCSTAEILPSDYKVSPDGRVMEVLSEHMCQGWLEGYLLTGRHGFFSCYEAFIHIVDSMFNQHAKWLEATRHIPWRKPVASLNYLLTSHVWRQDHNGFSHQDPGFIDVVANKRSEVIRIYLPPDANTLLSVTDHCLRSRNYVNVIVAGKQLAPQWLDMDAAVKHCTLGIGIWDWASNDKGFEPDVVMACAGDVPTMETLAAVDLMRLNFPDLKIRMVNVVDLMRLQPASEHPHGMTDKNFDVLFTKDKPVIFAFHGYPMLIHKLTYRRANHSNIHVRGYKERGTTTTPFDMVVLNDLDRFHLVMDVIDRVPKLGSRAAYVKQALLRKLIDHKRYIREHGEDMPEVRNWKWSGEKFGD

SEQ ID NO: 617 - protein, 797 aa, Oxalobacter formigenes HOxBLS
MNAEKLDQNAKPLSPDMLKKIDAYFNAANYLSVGQIYLYNNPLLKEPLTADDIKPRLLGHWGTTPGLNFIYVHMNRVIKKYDLDMIFVTGPGHGGPALVANTYLEGTYSEFYPNISEDEEGMKKLFTQFSFPGGIPSHTAAETPGSINEGGELGYALSHAFGAAFDNPDLIVTCVVGDGEAETGPLATGWHSNKFINPVYDGAVLPILHLNDAKIAGPTVLGRIPPQELDELMRGYGYEPFYVEGSDPLVMHQKMAATLDVVVEKIRRIQSDARQNGFTTRPQWPMIVLRSPKGWTGPKVVDGQQIEGTFRAHQVPVNEVKNNPAHLKVLNEWLLSYKPHELFDENGKLKPELAELAPRGERRMGANPHANGGILLRELRMPDFRKYAVDVPSPGVVVAESTRVQGNMIRDVFVLNEEAKNFRVFSPDETSSNRWNAVFEVTERASMDEIKSTDDKVSPTGRVMEMLSEHQCEGWLEGYLLTGRHGFFPCYEAFIHVVDSMFNQHAKWLEVCRHIPWRRPIASLNYLLTSHVWRQDHNGLSHQNPGFIDLVMNKKADITRVYLPPDANCLLSVTDHCMRSRHRINVIVAGKQPALQYLNMDEAIKHCTAGIGIWEWASNDKGAEPDVVMACCGDIPTLETLAAVKILREHIPELKIRVINVVNLMTLQQPGEHPNGLSDREFDVLFTRDKPVIFAYHGYPWLIHRLTYRRTNHRNFHVRGYKEEGTTTTPFDMVVMNDLDRYHLAGDVIDRLPNLGSKAAYTKQYLRDRLLDHKAYVHKYGEDMPEIRDWNWADGKS

SEQ ID NO: 618 - protein, 798 aa, Oxalobacter formigenes OXCC13
MAKAGKLDKSSEPLSVDMLHKMNAYFSAANYLSVGQIYLFNNPLLREPLKPDDIKPRLLGHWGTTPGLNFVYVHMNRVIKKYDLDMIFVTGPGHGGPALVANTYLEGTYSEFYPNVSEDEEGMKKLFTQFSFPGGIPSHTAAETPGSINEGGELGYSLSHAFGAAFDNPDLIVTCVVGDGEAETGPLATGWHSNKFINPVFDGAVLPILHLNDAKIAGPTVLGRIPPNELDELMRGYGYEPFYVEGSDPLIMHQKMAATMDTVITKIRKIQDDARKNGFKERPQWPMIVLRSPKGWTGPHVVDGQQIEGTFRAHQVPVSEVKTNPAHLKILNEWLLSYKPHELFDETGRLIPELAELAPKGLRRMGANPHANGGILLRELRMPDFRKYAVDVPSPGVVVAESTRVQGNMIRDVFVLNEEAKNFRVFSPDETASNRWGAVFEVTERSSMDEIKPTDDKVSHTGRVMEMLSEHQCEGWLEGYLLTGRHGFFPCYEAFIHVVDSMYNQHAKWLEVTRHIPWRRPIASLNYLLTSHVWRQDHNGLSHQNPGFIDLVMNKKADISRVYLPPDANCLLSVTDHCMRSRHRINVIVAGKQPALQYLNMDDAIKHCSAGIGIWEWASNDKGSEPDVVMACCGDVPTLETLAAVKILRERLPEVKIRVINVVNLMTLQQPSEHPNGLSDKEFDILFTKDKPIIFAYHGYPWLIHRLTYRRTNHQNMHVRGYKEEGTTTTPFDMVVLNDLDRYHLAGDVIDRLPSLGSRAAYTKQYLRDRLLEHKEYVYKYGEDMPNIRDWNWADGKS

SEQ ID NO: 619 - protein, 789 aa, Solibacter usitatus Ellin6076
MSEVTVPLTPEELRKMDAWWRAANYLSVGQIYLHDNPLLKLPLTLEHIKPRLLGHWGTTPGLNFIYVHCNRLIRKYDLDMIYVTGPGHGGPGLVANTYLEGTYSEFWPHIPESAEGMKRLFKQFSFPGGIPSHVAPETPGSIHEGGELGYSLLHAYGAAFDNPDLVVCCVIGDGEAETGALATSWHSNKFLNAERDGAVIPVLHLNGYKIAGPTVLARMPEQELTDLLKGYGYRPYFVEGDDPPAMHQKMAATMDAVIAEIRRIQHEARSGGAVSQAAWPVVVLRTPKGWTGPKVVDGIQVEGTFRAHQVPLSELSAKPEHIRILENWMKSYRPEELFDEHGKLVGEIAELAPKGDRRMGANPHANGGLLLKDLDMPEFGDYAVAVPSPGTVKAEATRVMGRLLRDVMKRNLESRNFRVVGPDETNSNRLGALFEVTDRVSMEAILPNDDHVTHSGRVMEVLSEHMCEGWLEGYLLTGRHGFFSCYEAFIHIIDSMFNQHAKWLKVTQHIPWRRPIASLNYLLTSHVWQQDHNGFSHQDPGFLDHVVNKKADVVRVYLPPDANTLLSVTDHCLRSRNYVNVIVAGKAPALQWLDMDAAITHCTNGIGIWSWASNDQGQEPDVVMACCGDVPTVETLAAVDLLRRNLPDLKIRVVNVVDLMTLQPASEHPHGLSDRDFDSIFTTGKPVVFAFHGYPWLIHRLTYRRTNHVNLHVRGYKEEGTTTTPFDMTVLNDLDRFHLAMDVLDRVPRVRDISAHLKQALRNKLIEHKHYVTTFGEDMPEIREWTWKG

SEQ ID NO: 620 - protein, 795 aa, Pelodictyon phaeoclathratiforme BU-1
MALSPLSSGGPLSVDELQRIDAYWRAANYLSVGQIYLMDNPLLREPLKPEQVKPRLLGHWGTTPGLNFIYAHLNREICQRDLNVIYLAGPGHGGPAIVANVWLEGTYSEYYPNISEDAAGMKKMFRQFSFPGGVPSHVAPETPGSIHEGGELGYALSHAFGAVFDNPDLVAACVVGDGEAETGPLATSWHSNKFLNPARDGAVLPILHLNGYKIANPAFLARLPHDELESLMIGYGYKPCFVEGSDPAIMHQKMAAALDNCLDEIAEIQHEARAHGATERPLWPMIVLRSPKGWTGPKEVDGKKTEDFWRSHQVPFSAVRENPAHLALLEEWMKSYHPEELFTAEGALKPELKELAPKGQRRMGDNPHANGGLLLKSLHMPDYREYAVSVSSPGSVRAEATRVMGTFLRDVMKQNEHDSNFRVFGPDETASNRLGSLFEVTDRTWMESVMPYDESLSRNGRVMEILSEHTCQGWLEGYLLTGRHGLFSCYEAFIHIIDSMFNQHAKWLKITNDEIPWRRPIASLNYLLTSHVWQQDNNGFSHQDPGFIDHVVNKKADVIRVYLPPDANTLLSVTDHCLRSRNYINVIVAGKQPAWQWLDMDAAVRHCTSGIGIWEWASNDAEDGDPDVVMACAGDVPTLETLAAVDILRDKIPDLKIRVVNVVDLMTLQPSEEHPHGLKDRDFDDIFTTDKPIIFAYHGYPWLIHRLTYRRTNHKNLHVRGYKEEGTTTTPFDMVVMNDLDRFHLVADVVERVPRLRQRAAYVKQHVRDKLIAHKEYIRKYGEDMPEIRNWQWTR

SEQ ID NO: 621 - protein, 798 aa, Prosthecochloris aestuarii DSM 271
MSDAVCDQGFLQPLSAEQLERINAYWRAANYLSVGQIYLMDNPLLRVPLRAEHVKPRLLGHWGTTPGLNFIYAHLNRVIRARDLNLIYIAGPGHGGPALVANVWMEGTYSQYYPDVSFDEQGMKRLFRQFSFPGGIPSHVAPETPGSINEGGELGYCLSHAFGAVFDNPDLVAACVIGDGEAETGPLAAAWHSNKFLNPRRDGAVLPVLHLNGYKIANPTILARLPRQELERLMRGYGYNPCFVEGSDPFVMHQAMAAAMDNCFDEIREIQRQARQEEGVVKRPLWPMIVLRSPKGWTGPKEVDGKKTEDFWRSHQVPFAAVRENPDHLKLLESWMKSYRPEELFTSEGELIAELRELAPTGRRRMGDNPHANGGVLLQGLHMPDFQDYAVKVPEPGSVIAEAPIPMARFLRDVMRLNESAANFRVFGPDETASNRLGDLFEETDRAWMAEIIADDDHLSPDGRVMEILSEHTCQGWLEGYLLTGRHGFFSCYEAFIHIIDSMFNQHAKWLKVTNDEIPWRRPIASLNYFLTSHVWRQDHNGFSHQDPGFIDHVVNKKADVIRVYLPPDANTLLSITDHCLRSRNYINVIVAGKQPAFQWLDMDSAVKHCSSGIGIWEWASSDIEDGDPDVVMACAGDVPTLETLAAVDILRSQLPDLKIRVVNVIDLMTLQPQEEHPHGLPDRHFDDIFTTDKPVIFAYHGYPWLIHRLTYRRTNHRNLHVRGYKEEGTTTTPFDMVVMNDLDRFHLVADVVDRVPRLRQRAAYVKQYVRDRLIEHKQYIRTYGEDMPEIREWKWNW

SEQ ID NO: 622 - protein, 791 aa, Chlorobium limicola DSM 245
MTHTNSSLSERELELMHGWWRAANYLSVGQIYLMNNPLLKEPLSKEDIKPRLLGHWGTTPGLNFLYVHLNRIIRNRDLDIVYIAGPGHGGPALVANVWLEGTYSEYYPDVSFDEAGMKRLFRQFSFPGGIPSHVAPETPGSIHEGGELGYALSHAFGAVFDNPDLITACVVGDGEAETGPLATAWHSNKFLNPKRDGAVLPILHLNGYKIANPTVLARISHEELEQLMFGYGYRPYLVEGDDPVTMHGKMAAIMDSCFDEIAAIQRQARVDGVTERPRWPMIVFRSPKGWTGPKVVDGKPAEGNWRSHQVPFSTVRDNPEHMALLESWLKSYRAEELFSPDGVLLPELQALAPKGQKRMGDNPHANGGLLLRELRMPDFRDYALDVPSPGSVEAEAPKPMARFLRDIMKLNEKTANFRVFGPDETASNRLGDLFEETDRAWMARTLPSDDHLSPDGRVMEILSEHTCQGWLEGYLLTGRHGFFSCYEAFIHIIDSMFNQHAKWLKVTDSEIPWRRPIASLNYFLTSHVWRQDHNGFSHQDPGFIDHVVNKKAEVIRVYLPPDANTLLSVTDHCLRSRNYINVIVAGKQPSWQWLDMESSIRHCTRGIGVWDWASNDTGEGQPDVVMACAGDVPTLETLAAVKILRNLSPELKIRVVNVVDLMTLQPKEEHPHGLDDREFDDMFTTDRPIIFAYHGYPWLIHRLTYRRTNHGNMHVRGYKEEGTTTTPFDMVVMNDLDRFHLAADVVNRVECLKPKAAYIRQYVRDRLTEHKEYITKYGEDMPEVRDWRWVD

SEQ ID NO: 623 - protein, 837 aa, Chlorobium tepidum TLS
MTKGGRHRFTGATLSFNVMHLIVRSENRVPDELRTQHTTTIKSTILMTEMTTPLSPRELDLMNAYWRAANYLSVGQIYLMDNPLLKEPLSKEHIKPRLLGHWGTTPGLNFLYVHLNRIIRNRDLDIIYIAGPGHGGPALVANVWLEGTYSEYYPDVSFDEAGMKRLFRQFSFPGGIPSHVAPATPGSIHEGGELGYALSHAYGAVFDNPDLVAACVIGDGEAETGPLATAWHSNKFLNPKRDGAVLPVLHLNGYKIANPTVLARISHEELEQLMIGYGYKPYFVEGDDPATMHQMMAATMDRCFDEIAEIQRRARVDGVTERPMWPMIVFRSPKGWTGPKVVDGKPAEGSWRSHQVPFSTVRDNPEHMALLETWLKSYRAEELFTADGVLLPELQELAPRGKKRMGDIPHANGGLLLKELRMPDFREYGIDVPKPGSVEAEAPKPMARFLRDIMKMNEKAANFRVFGPDETASNRLGELFEETDRTWMAGMLPTDDHLSRDGRVMEILSEHTCQGWLEGYLLTGRHGFFSCYEAFIHIIDSMFNQHAKWLKVTGAEIPWRRPIASLNYFLTSHVWRQDHNGFSHQDPGFIDHVVNKKSSVIRVYLPPDANSLLSVTNHCLRSRNYINVIVAGKQPAWQWLDMESAVRHCTSGIGIWEWASNDANEGEPDVVMACAGDVPTLETLAAVKILRKLAPELKIRVVNVVDLMTLQPKEEHPHGLADRDFDDMFTTDKPIIFAYHGYPWLIHRLTYRRTNHHNLHVRGYKEEGTTTTPFDMVVMNELDRFHLVADVANRVESLRPQAAYIKQYVRDRLIEHKEYITKYGEDMPEVRDWRWED

SEQ ID NO: 624 - protein, 807 aa, Chlorobium ferrooxidans DSM 13031
MMSNQTQEEVFAAPLTQTGLHAIHACWRAANYLAVGQIYLLDNPLLLQPLKPEHIKPRLLGHWGTTPGQNFIYVHLNRAILQRNLDIIYISGPGHGGPAVVANVWLEGTYSEYYPNISQDEAGMKNLFRQFSFPGGIPSHVAPETPGSIHEGGELGYSLSHAFGAVFDNPDLVAACVIGDGEAETGPLAASWHSSKFLNPARDGAVLPILHLNGYKIANPSLLARIPHDELESLLTGYGYKPYFVEGSEAEPMHQKMASVLDICLDEIAEIQYAARKQGLHERPCWPMIVLRTPKGWTGPKEVDGLKVEDFWRSHQLPVTAVRENPAHLRLLEEWMRSYRPEELFTPSGAPQPELMALVPKGKKRMGDNPHANGGLLLKSLRLPDFREYGVAVPSPGSVRAEATMVMGAFLRDIMKLNESSRNFRVFGPDETASNRLDALFQVTARSWMENILPYDEHLSPDGRVMEILSEHTCQGWLEGYLLTGRHGLFSCYEAFIHIIDSMFNQHAKWLKITSTQIPWRRPVASLNYLLTSHVWRQDHNGFSHQDPGFIDHVVNKKSSVIRVYLPPDANTLLSVTDHCLKSRNYINVIVAGKQPEWQWLDMEAAVRHCAFGISIWEWASNDSADGEPDVVMACAGDVPTLETLAAVDILREKIPDIKIRVVNVVNLMTLQPREEHPHGLSDRDFDDIFTTDKPIIFAYHGYPWLIHRLAYRRTNHKNLHVRGYKEEGTTTTPFDILVMNDLDRFHLVADVVERVDRLRDRAAYIKQFVRDMLITHKEYIHEHGEDMPEIRNWKWKGRTGATSAGD

SEQ ID NO: 625 - protein, 809 aa, Chlorobium luteolum DSM 273
MNAEDPTKEREETKSALTAAEADGLNAYWRAANYLSVGQIYLLANPLLLEPLVPEHVKPRLLGHWGTTPGQNFIYVHLNRVIRIRDLNMIYISGPGHGGPAVLANVWLEGTYSEYYPAVSENEAGMKTLFHQFSFPGGVPSHVAPETPGSIHEGGELGYSLSHAYGAAFDNPDLIVAAVIGDGEAETGPLSTSWHSNKFLNPCRDGAVLPILHLNGYKIANPAVLARLPHEELENLMKGYGYSPRFVEGSDPLDMHQKMAAAMDACLDDIKGIQQAARNGGVRERPVWPMIVLRSPKGWSGPKEVDGKKVEDFWRSHQVPFAEVRTNPAHLQLLEDWMRSYRPEELFTPSGALRAELKALAPKGKRRMGDNPHANGGLLLRDLMMHDFRDFAVMVPSPGAVEAEATRVAGAFLRDVMKENMAAANFRVFGPDETASNRLGFLFEVTDRTWMDEVMDYDDHLAPDGRVMEILSEHTCQGWLEGYLLTGRHGFFSCYEAFIHIVDSMFNQHAKWLKVCKQEIPWRRPIASLNYLLTSHVWRQDHNGFSHQDPGFIDHVVNKKADVIRVYLPPDANTLLSVTDHCLRSRDYINVIVAGKQPSWQWLDMESAVRHCTCGIGIWEWASSDTLDGDPDVVMACAGDVPTLETLAAVDILREKIPDLKIRVVNIVDLMTLQPPEEHPHGLKDRDFDDIFTIDRPIIFAYHGYPWLIHRLTYRRTNHYNLHVRGYKEEGTTSTPFDMVVRNDLDRFHLVADVVERVPRLRQKAAYVKQYVRDMLIAHNEYIRTHGEDLPEVRNWQWTRTLKPSTDGL

SEQ ID NO: 626 - protein, 788 aa, Dechloromonas aromatica RCB
MLTTHTPLAADELDRMNAWWRAANYLSVGQIYLLDNPLLKTPLTLAHIKPRLLGHWGTTPGLNFIYVHMNRVIRQHGLNMIFIAGPGHGGPGVVANTWLEGSYSEFYQNISQDEEGMRRLFRQFSFPGGIPSHASPDTPGSIHEGGELGYALFHAYGAVFDNPHLITCCVVGDGEAETGPLATSWHSNKFLNPRTDGAVLPILHLNGYKIANPTILARISHTELECLFVGYGYQPLFVEGDDPQTMHQLMAAAVDTAIASIAAIQRRAREGGDESRPRWPMIILRSPKGWTGPKTVDGKQSEGSWRSHQVPFSDMDKPEHVQLLGEWMASYKPAELFDKDGRLMPEIAALAPAGQRRMGANLHANGGALLRDLRLPDFRDYAVAVPTPGGSVAEATRAMGVFLRDVMRQNPDNFRVFGPDETASNRLGALFEVTNRTWMAEHLAGDDHLAPDGRVMEVLSEHACQGWLEGYLLTGRHGLFSCYEAFIHIVDSMFNQHAKWLKMCGEIPWRRPIASLNILLTSHVWRQDHNGFSHQDPGFIDHVVNKKADIIRVYLPPDANTLLYVTDRCLKSRNLVNVIVAGKQPDWQWLDMEAAINHASAGIGLWEWACNDQPGEPDIVLASAGDVPTLEMLAAIDILHRMVPTLKIRYINVVDLMTLQPQEEHPHGLSSDEFNSLFTTDKPIIFAYHGYPWLIHRLTYRRTNTNLHVRGYKEEGTTTTPFDMVVLNNLDRYHLVMDVAKRVPKLHAQAAHIKQAMRDKLNQHTQYILEHGEDMPEILDWQWPGAKS

SEQ ID NO: 627 - protein, 812 aa, Thiobacillus denitrificans ATCC 25259
MYSFEPYTGRPIRLDLLVHKGETSMDAPTPATALTSVELEQLDAYWRAANYLSVGQIYLFDNPLLKQPLDRAHIKPRLLGHWGTTPGLNFIYAHMNRAIRAHDLDMIFITGPGHGGPAVVANTYLEGSYSELYPNITRDEAGLRQLFRQFSFPGGIPSHAAPETPGSINEGGELGYSLLHAYGAVFDNPDLIACCVIGDGEAETGALATSWHSNKFLDPRGDGAVLPVLHLNGYKIANPAFLARIPRHELESLLTGYGYRPIFVEGDEPSDMHQKMAAAVDQALAEIRGIQRRARDGGETTRPTWPMIVLDSPKGWTGPKEVDGKKTEDYWRSHQVPFGDLDNPAHVRLLDDWMRSYRPEELFDAGGALKPELAALAPTGERRMGANPHANGGKLLRDLRLPDFRDYRVELDAPGSVVSETTRTLGAYLRDVVRDNPDNFRLFGPDETHSNRLSAVFEVTDRTWVAERYPYDDHLAADGRVMEILSEHACEGWLEGYLLSGRHGLFSCYEAFIHIIGSMFNQHAKWLKVCNEIPWRVPVASLNILLTSHVWRQDHNGFSHQDPGFIDHVVNKKADVIRVYLPPDANTLLVVADKCLRSRNLVNVIVAGKQPEQQWLDMDAAVTHAGVGVGIWDWACNDQGGEPDIVLAAAGDVPTMEMLAAIDLLRTLVPDLKIRFINVVDLMTLQPAEEHPHGLPDEEFDLLFTTDKPILFGYHGYPWLIHRLTYRRTNHDNLHVRGYKEEGTTTTPFDMVVLNELDRFHLVIDVARRVPKLQAQAAHLQQQMLDKLGAHTQYIHAHGEDMPEIRDWKWAR

SEQ ID NO: 628 - protein, 791 aa, Methylobacillus flagellatus KT
MQSQAADHVLNAQQLAQLHAYWRAANYLSVGQIYLYANPLLKTPLLPEHIKPRLLGHWGTTPGLNFVYVHANRVIREHDLNMIYITGPGHGGPAVVANTYLEGSYTELYPEITEDETGMLKLFKQFSFPGGIPSHASAQTPGSINEGGELGYCLLHAFGAVFDNPDLIACCVVGDGEAETGPLATSWHGNKFLNPKTDGVVLPILHLNGYKIANPTILSRIGDEELQKLFEGYGYTPYFVEGSDPDFMHQRMASVMDQVIGEIQRIKREASLKREVSRPRWPMIILRSPKGWTGPAEVDGKPNTGTFHAHQVPFGELDKPEHIKLLQDWMQSYAPHELFDDTGRLKEELRALAPKGERRMGANPHANGGLLLKPLALPDFRKFAYAVTQPGERQTSTTGELGKYLAEVWRLNPNNFRVFSPDENNSNRLQALFEVTNRQWMAERLESDEHLAAHGGVMEILSEHSCEGWLEGYLLTGRHGFFSCYEAFIHIIDSMFNQHAKWLKECRHIPWRKPIASLNILLSSHVWRQDHNGFSHQDPGFIDHVANKKPDIIRIYLPADANTLIAITDHCLQSRNLINVIVAGKQPQGQWLDMPAAIEHARRGASIWHWAGNCAADEEPDLVIASAGDVPVMESLAAVMLLREHLPALKIRYVNVVDLMTLVPHDVHPHGLTDDAFDELFTRDKPVIFAFHGYPGLIHRLAYKRHNHANFHVHGFLEEGTTTTPFDMTVLNRLDRYNLVKNTLRWLPHIDNAPVLDALMDEKLAQHKQYIWQHGEDMPEIRDWKWQPADH

SEQ ID NO: 629 - protein, 790 aa, Nitrosomonas europaea ATCC 19718
MTQLPQPLTPDELQKIDAYWRAANYLSVGQIYLLDNPLLQTPLTLQHIKPRLLGHWGTTPGLNFIYAHLNRIIRRDDLNMIYIAGPGHGGPALVANTYLEGTYSEHYPDISQDIQGMKHLFRQFSFPGGIGSHATPEIPGSIHEGGELGYALSHAFGAVFDNPDLIAACVVGDGEAETGPLATAWHSNKFLNPVHDGAVLPILHLNGYKIANPTILARISREELDQLFQGYGYQPYIVEGEDPLTMHQLMAGTLDQVLAEIRSIQTRARLDGVTQYPRWPMIILRTPKGWTGPATVDGLKTEGSWRSHQVPLSELAKKPEHIQQLEAWLRSYRPEELFDTQGRLVEPLQTLAPLGNRRMGANPHANGGSLMKQLRMPDFRKYAVEIVQPGQIEAESTRIMGSFLRDIMCLNLKTCNFRVFGPDETASNRLGSLYDVTPKTWLAETLPEDEHLAPDGRVMEILSEHTCQGWLEGYLLTGRHGLFSCYEAFIHIVDSMFNQHAKWLKVSKEIPWRRPIASLNYLLTSHVWRQDHNGFSHQDPGFIDHVINKKADTIRIYLPPDANCLLYITDKCLRSRNFVNVIVAGKQPQLQWLDMDAAIKHCTAGIGIWGWASNDQAGEPDVVIACAGDVPTIEVLAAVSILREHLPDLRIRVINVVDLMTLQHDREHPQGLSDREFDTLFTTDKPIIFAYHGYPWLIHRLTYRRTNHANLHVRGYKEEGTTTTPFDMTVLNDMDRFHLVDDVIDRVPHLGYKAAYLRQIMRDKLVEHREYINRHGEDMPEIRDWKWTAP

SEQ ID NO: 630 - protein, 791 aa, Nitrosomonas eutropha C91
MTQTPQSLTPDELQKIDAYWRAANYLSVGQIYLLDNPLLQAPLTLQNIKPRLLGHWGTTPGLNFIYAHLNRVILRDDLNMIYIAGPGHGGPALAANTYLEGTYSEYYPDISQDIQGIKHLFRQFSFPGGIGSHATPEIPGSINEGGELGYSLSHAFGAVFDNPGLIAACVVGDGEAETGPLAAAWHSNKFLNPAQDGVVLPILHLNGYKIANPTILARISREELNQLFYGHGYRPYIVEGEDPLAMHQLMASTLDQVLTEIRSIQAQARLEGVTRYPRWPMIILRTPKGWTGPKTVDGLKIEGSWRSHQVPLSELAKKPEHLQQLEAWLKSYRPEELFDTHGRLIEPLQALAPLGNRRMGANPHANGGLLKEPLHMPDFREYAVEVAQPGQIEAEATRVMGSFLRDIMRLNLRSCNFRVFGPDETASNRLGNLYEVTPKTWLAETLAEDEHLAPDGRVMEILSEHLCQGWLEGYLLTGRHGLFSCYEAFIHIIDSMFNQHAKWLKISKEIPWRRPIASLNYLLTSHVWRQDHNGFSHQDPGFIDHVINKKADTIRIYLPPDANCLLYVTDKCLRSSNFVNVIVAGKQPQLQWLDMDAAIKHCTAGIGIWGWASNDQDGEPDVVIACAGDVPTIEALAAVSILREHLPDLRIRVINVVDLMTLQHHLEHPQGLSDREFDTLFTTDKPIIFAYHGYPWLIHRLTYRRTNHHNLHVRGYKEEGTTTTPFDMVVLNDMDRFHLVDDVIDRVSHLGYNAAYLRQIMRDKLIEHREYINRHGEDMPEIRDWKWTTLP

SEQ ID NO: 631 - protein, 807 aa, Nitrosospira multiformis ATCC 25196
MNRASPAVKTESNPLSTDELRKIDAYWRAANYLSVGQIYLLDNPLLKEPLTVTHIKPRLLGHWGTCPGLSFIYAHLNRIIKKFDLDMFYVCGPGHGGPAMVANTWLEGSYSEFYPRISRDATGMKRLFRQFSFPGGIPSHVAPETAGSINEGGELGYSLSHAFGAAFDNPDLIVACVVGDGEAETGPLAASWHSNKFLNPARDGAVLPILHLNGYKIANPTILARISHEELESLFAGYGYQPYFVEGSDPGPMHQSMAAVLDTAIESIRRIQREARSRGVNSGERQEAVTYPRWPLIILRSPKGWTGPEEVDGKKLEDYWRSHQVPLAELGSKPDHLKQLEDWMRSYKPEELFDENGCLMPELAALAPEGDRRMGANPHANGGLLLKELEMPDFRSYAVDVPVPGTEVREATRETGKFLRDIMKLNLDSSNFRVMGPDETSSNRLDALFDVTARAWVAQQLPEDEHLSPDGRVMEILSEHICQGWLEGYLLTGRHGLFSCYEAFIHIVDSMFNQHAKWLKVSKEIPWRRPIASLNYLLTSHVWRQDHNGFSHQDPGFIDLVVNKKASIIRVYLPPDANTLLYITDKCLRSRNFINVIVAGKQPALQWLDMDAAIRHGSAGIGIWGWASNDQEDEPDVVMACAGDIPTLETLAAVDLLRRHVPELRIRVVNIVDLMTLQPRSEHPDGLSDWDFDTLFTTNKPIIFAYHGYPWLIHRLTYRRTNHPNLHVRGYKEEGTTTTPFDMTVLNDLDRFHLVMDVADRVPKLSSKGAYLKQLMRDKLIDHKRYIRQYGEDMPEIRDWHWPSPGS

SEQ ID NO: 632 - protein, 804 aa, Nitrosococcus oceani ATCC 19707
MEQRLQTEHAKSRIEASPLAADELRNMDCYWRAANYLSVGQIYLRDNPLLTEPLTLEHVKARLLGHWGTTPGLNFIYVHLNRLIKACDLSMIYVTGPGHGAPGLVANTWLEGSYTAVYPNIPQDAVGMQRLFKQFSFPGGVPSHVAPETPGSINEGGELGYGLAHAYGAVFDNPDLIAACVVGDGEAETGPLATAWHSNKFLNPARDGAVLPILHLNGYKIANPTVLARISREDLESLLIGYGYHPYVVEGDEPERMHQLMAATLDQVVAEIHTIQRAARSQGATPCPRWPMIILRTPKGWTGPKEVDGKKTEGYWRSHQVPLAQLADKPEHLRLLEKWMKSYRPEELFDEQGTLRPELAALAPQGERRMGANPHANGGLLLKDLRLPEFRDYAVDVNGPGAKLAEATRVMGGYLRDVMKLNMDGRNFRVMGPDETNSNRLDALFEATDRTWMAETLPEDEHLAPDGRVMEILSEHTCQGWLEGYLLTGRHGLFSCYEAFIHIVDSMFNQHAKWLKVTGKEIPWRRPIASLNYLLTSHVWRQDHNGFSHQDPGFIDHVVNKKADVIRVYLPPDANTLLCVTDHCLRSRNFINVIVAGKQPQPQWLDMDAAVKHCTAGIGIWEWASNDQGSEPDVVMACAGDVPTLETLAAVDILRRHLPELKVRVINVVDLMTLQDKEQHPHGLSHKDFDTIFTTDQPIIFAYHGYPWLIHRLTYRRTNHKNLHVRGYKEEGTTTTPFDMVVLNDMDRFDLVADVIDRVPKLGSTAAYLKQWLRDKHIEHKQYITKHGVDMPEITQWQWGKSSD

SEQ ID NO: 633 - protein, 798 aa, Candidatus Protochlamydia amoebophila UWE25
MITKLPPTSESNNSLSDELLEKINAYWRAANYLSVGQIYLLDNPLLKKPLSIKDIKPRLLGHWGTTPGLNFIYVHLNRIIKKFDLDMIYLIGPGHGGPGIVANTYLEGTYSEYYPHISQDAEGMQKLFKQFSFPGGIPSHVAPETPGSINEGGELGYSLSHAFGAAFNNPDLIVGCVIGDGEAETGPLATAWHSNKFLNPAIDGAVLPILHLNGYKIANPTILARISQEELKSLFVGYGYKPYFVEGSDPQLMHRLMAETLDMIIKEIQEIQTNARKNGIVKRPIWPMIILRTPKGWTGPKEVDGKKTENYWRSHQVPFSDMKEEHIKLLEEWLKSYRPEELFDETGKLFPILAELAPKGKRRMGDNFHANGGLLRKNLRLPDFRSYQLEVVTPGVVEAESTRIMGSFLRDVLKLNPHNFLVTGPDETASNRLTNLFEVTQRRWLAEYLPEDTDGGNLSLEGRVLEILSEHTCLGWLEGYILTGRHGFFSTYEAFAHIIDSMFNQHAKWLQTTLTIPWRAPIPSINILLSSHVWRQDHNGFSHQDPGFIDLVMNKKAAVVRVYLPPDSNTLLSVTDHCLRSLNYINVIVAGKQPALQYLSMEAAIKHCTAGIGIWEWASNDKGGEPDVVLACAGDIPTLEILAAVDILRQSIPTLKIRVINVVDLMTLQPKEEHPHGLSNTDFDEMFTTNKPIIFAYHGYPWLIHRLTYRRSNHSNIHVRGYKEEGTTTTPFDMVVLNEVDRFHLVGDVIDRVPKLGYLAAYTKQEMRHKLIEHKEYIHQFGEDMPSVKNWKWPYGKE

SEQ ID NO: 634 - protein, 791 aa, Sinorhizobium meliloti 1021
MTNTLSPELLERMDAYWRAANYLSVGQIYLRDNPLLKQKLTLADVKPRLLGHWGTTPGLNFLYVHLNRLIQTHDLNMIYVTGPGHGGPGLVANTYLEGTYSELYPEVSQDEAGIKRLFTQFSYPGGIPSHVAAEVPGSINEGGELGYCLMHAYGAVFDNPDLIAACVVGDGEAETGALATSWHSNKFLNPARDGAVLPILHLNGYKIANPTVLARISHDELEALFMGYGYEPLFVEGADPRQMHQLMASALDKAHGKIAEIQRQARSRGFSDRPAWPMIIFRSPKGWTGPREVDGKKTEGTWRSHQVPLAKLAEVPAHLGILEEWLKSYRPWELFDESGSLRPELRELAPKGERRMGANPHANGGLLLKDLNLPDFRQYAVEIGIPGTVTAESTRTAGLYLRDVMKLNAQERNFRIFGPDETESNRLSPVFQETDRVFTGDILASDMQLSPDGRVMEVLSEQLCQGWLEGYLLTGRHGFFSCYEAFIHIVDSMFNQHAKWLKVCREVPWRKPIASLTYLLTSHVWRQDHNGFSHQDPGFIDHVANKKADIIRVYLPPDANTLLSVVDHCARSRDYINVIVAGKQPQLQWLDMGAAVAHCRAGLGVWEWASNDEGDPDAVVACAGDVPTMEALAAVMIVREAFPSLRLRVVNVVDLMALQAPSQHPHGIADDAFDRMFTTDKPVIFAYHGYPGLIHRLTYRRTNHANFHVHGYQEEGTTTTPFDMAVLNKLDRFHLAKAVVERVPSLASPREGFAHFVESKLAEHDAYIRENGEDLPEIRNWRWLASAVDAQ

SEQ ID NO: 635 - protein, 783 aa, Sulfurospirillum deleyianum DSM 6946
MQKHYLDAHELAQLDAYWRASNYISVGQIYLLDNPLLKKSLSLHDVKPRLLGHWGTTPGLNFIYTHMNRLINHDDLNMFFIAGPGHGGPSVVAQTYLEGVYSEVYPKITQDEVGLQMLFKQFSFPGGIPSHAAPQTPGSIHEGGELGYALSHAYGAVFDNKDVIACCVVGDGEAETGPLATSWHSNKFLNPKTDGVVLPILHLNGYKIASPTILSRISHEELEALFRGYGYEPFFVEGDEPEAMHSKMAEVLDVIVKRIQTIWHEARVLNKEERPRWPMLILRTPKGWSGPKEVDGLKSEGHCRSHQVPFATFGSSPEHLTLLERWLKSYKPEELFDEKGRLFSHIASFAPKGEKRMGANPHTNGGALLKPLVLPDFKAYAVDVPSPAGGLAESTRVLGNYLRDVMAQNRQNFRVFGPDETASNRLNALFEVTNRTWMAQKDSFDEHLSADGRVMEILSEHTCQGWLEGYLLTGRHGFFSCYEAFIHIVDSMFNQHAKWLKVTSREIPWRKPIASLNYLLTSHVWRQDHNGFSHQDPGFIDVVVNKKAHIINVYFPPDANTLLWVGDWCLKSKNSINVIVAGKQPEVQWLSMPDAIAHCEQGMGIWEWASDRGEPDVILACCGDVPTLETLAAVRLLRELVPSVKIRVVNVVDLMALQPHSEHPHGWSDEAYNALFPKDVPTIFAYHGYPWLIHRLAYKRAHHEHLHVRGYKEEGTTTTPFDMVVLNDTDRFHLVMDVMHRVSKMKPYEEEICQKMTEKLAEHKAYIERYGIDMPEILEWRWK

SEQ ID NO: 636 - protein, 807 aa, Mesorhizobium loti MAFF303099
MNDHTTIAASGGRLSDRELHDLDAYWRAANYLTIGQIYLLDNPLLREPLRLEHVKPRLLGHWGTSPGLSFIYAHLNRAIRLRDANVIYICGPGHGGPAMVANTYLEGTYSELNPDIAMDEQGMRKLFRQFSFPGGIPSHAAPDVPGSIHEGGELGYSLSHAYGAAFDNPDLVVACVVGDGEAETGPLAAAWHSNKFLNPARDGAVLPILHLNGYKIANPTILARIPEDELRALFAGYGYEPLFVAGHEPALMHQRMATVLDDAFDRISAIKHAARNGSGATGSRPEWPMIVLRSPKGWTGPKEVDGLKTEGFWRSHQVPLSGLAENPAHLKLLEEWLKSYRPEELFDAAGAPVASIRATAPQATKRMSANPHANGGLLRRSLELPGLHDHAVSLERPGAVKAESTRVMGSFLRDVMRLNEVAKNFRIVGPDETASNRLQDVFEVTERGWMEKILPEDVHLGREGRVLEILSEHTCQGWLEGYLLTGRHGLFSCYEAFIHIVDSMFNQHAKWLDACREIPWRRPIASLNYLLSSHVWHQEHNGFSHQDPGFIDVALNKKADIVRVYLPPDANTLLCVTDHVLQTWNRINVIVAGKPPSWQWLSMDKAIVHCRAGIGVWDWASTDDGAEPDVVMACAGDVPTLETLAAVQILRQQVPDLRIRVVNVVDLMTLQPKEYHPHGLSDREFDALFTPDKPVIFAYHGYPWTIHRLTYRRTNHDNIHVRGYNEEGTTTTPFDMTVLNGLDRFHIVQSVLDWVPRLKGVRVSLKQAMDSKLLEHRAYICSHGQDMPEILDWKWGQDPDAAPKRPD

SEQ ID NO: 637 - protein, 797 aa, Oligotropha carboxidovorans OM5
MVADTSLTDHELGLIDAWWRAANYLSVGQVYLLDNPLLKIPLAIEHVKPRLLGHWGTVPGLNFIYAHLNRLIKARDLNILFVTGPGHGAPGIIANAYLEGTYSELCPAITQDIEGIKRLFRQFSFPGGVPSHTAPETPGSIHEGGELGYSLSHAFGAAFDNPELIIACVVGDGEAETGPLAAAWHSNKFLNPASDGAVLPILHLNGYKIANPTVLARIPSEEIRALFEGYGYAPIFVEGHDHFQMHRKMALALSTAFSDIAKIQKTARSERNPERPRWPMIVLRTPKGWSGPKTVDGQKTEGSWRSHQVPFSNIRAPGHLQLLENWLRSYLPERLFDDLGRLCPEIAALAPEGAKRMSANPHANGGTKRRPLCLPDFTSFAVDVEAPGQVDAEATRVLGGFLRDTMAANKANRNFRVFGPDETASNRLQALFDVTDRSWNAEIIPDDDDLGPDGRVMEILSEHTCQGWLEGYLLTGRHGFFSCYEAFIHIVDSMFNQHAKWLKTAREVPWRQPIASLNYLLTSHVWQQDHNGFSHQDPGFIDHVINKKADIVRVYLPPDANTLLYVADHCLRSWDRVNVIIAGKAPSPQWLSMDAAIKHCTEGIGIWEWASNDRGSEPDVVMACAGDVPTLETLAAVDLLEQQIPELKIRVVNVVDLMTLQSKEQHPHGLADNDFDALFTTDKPVIFAYHGYPTLIHRLTYKRTNHHNIHVRGYEEEGSTTTSFDMAVRNRIDRFHLIAAVIDWVPQLGAAAVYTKQAIRDKLVEHERFIRTHGVDLPEVRNWRWKGAQRPATDAFR

SEQ ID NO: 638 - protein, 795 aa, Beijerinckia indica subsp. indica ATCC 9039
MDDRAHGPAGISQPLSPDLLQRLNAWWRAANYLSVAQLYLLDNPLLRQKLTLDHIKPRLLGHWGTTPGLNFIYVHLNRIIKERDLDILFIAGPGHGAPGLIANSWLEKTYSEVYPAVSQDIEGMTRLCRQFSFPVGIPSHAAPETPGSIHEGGELGYSLSHAFGAVFDNPDLIAACVIGDGEAETGPLATSWHANKFLDAARDGAVLPILHLNGYKIANPTVLGRIPSDELENLLQGYGYAPLFVEGDDPDIMHRHMAEALNVAFAGIAKIQRAARVEGHIERPRWPMLVLRSPKGWTGPKTVDGLKTEGFWRAHQVPFTIADKPEHLSLLESWLKSYRPEELFEESGALKPEIASLAPSGERRMSANPQANGGNLPRPLQIPDFTLHAVDVDYPGARTAEATFVMGQFLRDIMRANETNKNFRVFGPDETASNRLQALYDVTDKTWNAAFIAEDEHLDPTGRVMEILSEHTCQGWLEGYLLTGRHGLMSCYEAFIHIVDSMVNQHAKWLKTARGVPWRRPIASLNYLLTSHVWRQDHNGFSHQDPGFIDHIANKKSDIARVYLPPDANCLLYITDHCLRSWNRINVIVAGKQPEPQWLDMEEAISHCRAGLGIWSFASNDQDSEPDVVLACAGDVPTLETLAAADFLHTHLPEVKVRVVNIVDLFALEPQTRHPHGWSDKDFDTLFTKDKPVIFAYHGYPSLIHRLIYKRTNHSNFHVHGYQEEGSTTTPFDMVVRNRLDRFHLVGDVVDHLPKLGAKAAYVKQWLRDKFAEHERYIVAHGEDLPEIRHWRWPE

SEQ ID NO: 639 - DNA, 60 bp, Artificial sequence
  Primer
gtttcgaataaacacacataaacgctgaggatgacaacagattactcatcaccagcatat

SEQ ID NO: 640 - DNA, 60 bp, Artificial sequence
  Primer
cgtgacataactaattacatgattaattaattattttaaacccttccattgccaatcatt

SEQ ID NO: 641 - DNA, 60 bp, Artificial sequence
  Primer
ccaagcatacaatcaactatctcgctgaggatggatttatttgagtcattagcacaaaaa

SEQ ID NO: 642 - DNA, 60 bp, Artificial sequence
  Primer
atcataagaaattcgcttactcttaattaattaagctaatccttgggctgctgtaataat

SEQ ID NO: 643 - DNA, 11017 bp, Artificial sequence
  Vector
gatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcggatagatctagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacgctgaggatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataattaattaatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaattaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatcctcagcgagatagttgattgtatgcttggtatagcttgaaatattgtgcagaaaaagaaacaaggaagaaagggaacgagaacaatgacgaggaaacaaaagattaataattgcaggtctatttatacttgatagcaagacagcaaacttttttttatttcaaattcaagtaactggaaggaaggccgtataccgttgctcattagagagtagtgtgcgtgaatgaaggaaggaaaaagtttcgtgtgcttcgagatacccctcatcagctctggaacaacgacatctgttggtgctgtctttgtcgttaattttttcctttagtgtcttccatcatttttttgtcattgcggatatggtgagacaacaacgggggagagagaaaagaaaaaaaaagaaaagaagttgcatgcgcctattattacttcaatagatggcaaatggaaaaagggtagtgaaacttcgatatgatgatggctatcaagtctagggctacagtattagttcgttatgtaccaccatcaatgaggcagtgtaattggtgtagtcttgtttagcccattatgtcttgtctggtatctgttctattgtatatctcccctccgccacctacatgttagggagaccaacgaaggtattataggaatcccgatgtatgggtttggttgccagaaaag

SEQ ID NO: 644 - DNA, 57 bp, Artificial sequence
  Primer
aattggatccggcgcgccgtttaaacggccggccaatgtggctgtggtttcagggtc

SEQ ID NO: 645 - DNA, 49 bp, Artificial sequence
  Primer
aatttctagattaattaagcggccgcaaggccatgaagctttttctttc

SEQ ID NO: 646 - DNA, 21 bp, Artificial sequence
  Primer
tcggtgcgggcctcttcgcta

SEQ ID NO: 647 - DNA, 21 bp, Artificial sequence
  Primer
aatgtgagttagctcactcat

SEQ ID NO: 648 - DNA, 60 bp, Artificial sequence
  Primer
gtctgttgaattggcctggttaggcttaagcaatcaattgaggattttatgcaaatatcg

SEQ ID NO: 649 - DNA, 31 bp, Artificial sequence
  Primer
gaattcgtgccatcaccataagctgattcaa

SEQ ID NO: 650 - DNA, 31 bp, Artificial sequence
  Primer
gaattcgcgatttaatctctaattattagtt

SEQ ID NO: 651 - DNA, 30 bp, Artificial sequence
  Primer
cttaagcctaaccaggccaattcaacagac

SEQ ID NO: 652 - DNA, 23 bp, Artificial sequence
  Primer
ttatgtatgctcttctgactttt

SEQ ID NO: 653 - DNA, 30 bp, Artificial sequence
  Primer
gcgatttaatctctaattattagttaaagt

SEQ ID NO: 654 - DNA, 30 bp, Artificial sequence
  Primer
tatttgtatcgaggtgtctagtcttctatt

SEQ ID NO: 655 - DNA, 1772 bp, Artificial sequence
  chimeric construct
  misc_feature (613)..(616): Start codon
  misc_feature (1420)..(1423): Stop codon
  misc_feature (1420)..(1422): Stop codon
cctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatct

SEQ ID NO: 656 - DNA, 38 bp, Artificial sequence
  Primer
gcctcgagttttaatgttacttctcttgcagttaggga

SEQ ID NO: 657 - DNA, 28 bp, Artificial sequence
  Primer
aatcccgatgtatgggtttggttgccag

SEQ ID NO: 658 - DNA, 30 bp, Artificial sequence
  Primer
tggcagtattgataatgataaactcgaact

SEQ ID NO: 659 - DNA, 20 bp, Artificial sequence
  Primer
caatgattgttggtaaaggg

SEQ ID NO: 660 - DNA, 22 bp, Artificial sequence
  Primer
aaagttggcatagcggaaactt

SEQ ID NO: 661 - DNA, 4586 bp, Artificial sequence
  Template DNA
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 662 - DNA, 80 bp, Artificial sequence
  Primer
ttccggtttctttgaaatttttttgattcggtaatctccgagcagaaggagcattgcggattacgtattctaatgttcag

SEQ ID NO: 663 - DNA, 81 bp, Artificial sequence
  Primer
gggtaataactgatataattaaattgaagctctaatttgtgagtttagtacaccttggctaactcgttgtatcatcactgg

SEQ ID NO: 664 - DNA, 38 bp, Artificial sequence; identical to SEQ ID NO: 656
  Primer

SEQ ID NO: 665 - DNA, 31 bp, Artificial sequence
  Primer
gctaaattcgagtgaaacacaggaagaccag

SEQ ID NO: 666 - DNA, 24 bp, Artificial sequence
  Primer
ttctcgacgtgggcctttttcttg

SEQ ID NO: 667 - DNA, 49 bp, Artificial sequence
  Primer
tgcagctttaaataatcggtgtcactactttgccttcgtttatcttgcc

SEQ ID NO: 668 - DNA, 49 bp, Artificial sequence
  Primer
gagcaggcaagataaacgaaggcaaagtagtgacaccgattatttaaag

SEQ ID NO: 669 - DNA, 49 bp, Artificial sequence
  Primer
tatggaccctgaaaccacagccacattgtaaccaccacgacggttgttg

SEQ ID NO: 670 - DNA, 49 bp, Artificial sequence
  Primer
tttagcaacaaccgtcgtggtggttacaatgtggctgtggtttcagggt

SEQ ID NO: 671 - DNA, 49 bp, Artificial sequence
  Primer
ccagaaaccctatacctgtgtggacgtaaggccatgaagctttttcttt

SEQ ID NO: 672 - DNA, 49 bp, Artificial sequence
  Primer
attggaaagaaaaagcttcatggccttacgtccacacaggtatagggtt

SEQ ID NO: 673 - DNA, 22 bp, Artificial sequence
  Primer
cataagaacacctttggtggag

SEQ ID NO: 674 - DNA, 22 bp, Artificial sequence
  Primer
aggattatcattcataagtttc

SEQ ID NO: 675 - DNA, 23 bp, Artificial sequence
  Primer
ttcttggagctgggacatgtttg

SEQ ID NO: 676 - DNA, 22 bp, Artificial sequence
  Primer
tgatgatatttcataaataatg

SEQ ID NO: 677 - DNA, 23 bp, Artificial sequence
  Primer
atgcgtccatctttacagtcctg

SEQ ID NO: 678 - DNA, 22 bp, Artificial sequence
  Primer
tacgtacggaccaatcgaagtg

SEQ ID NO: 679 - DNA, 49 bp, Artificial sequence
  Primer
aattcgtttgagtacactactaatggctttgttggcaatatgtttttgc

SEQ ID NO: 680 - DNA, 49 bp, Artificial sequence
  Primer
atatagcaaaaacatattgccaacaaagccattagtagtgtactcaaac

SEQ ID NO: 681 - DNA, 49 bp, Artificial sequence
  Primer
tatggaccctgaaaccacagccacattcttgttatttataaaaagacac

SEQ ID NO: 682 - DNA, 49 bp, Artificial sequence
  Primer
ctcccgtgtctttttataaataacaagaatgtggctgtggtttcagggt

SEQ ID NO: 683 - DNA, 49 bp, Artificial sequence
  Primer
taccgtaggcgtccttaggaaagatagaaggccatgaagctttttcttt

SEQ ID NO: 684 - DNA, 49 bp, Artificial sequence
  Primer
attggaaagaaaaagcttcatggccttctatctttcctaaggacgccta

SEQ ID NO: 685 - DNA, 21 bp, Artificial sequence
  Primer
ttattgtttggcatttgtagc

SEQ ID NO: 686 - DNA, 22 bp, Artificial sequence
  Primer
ccaagcatctcataaacctatg

SEQ ID NO: 687 - DNA, 22 bp, Artificial sequence
  Primer
tgtgcagatgcagatgtgagac

SEQ ID NO: 688 - DNA, 17 bp, Artificial sequence
  Primer
agttattgataccgtac

SEQ ID NO: 689 - DNA, 19 bp, Artificial sequence
  Primer
cgagataccgtaggcgtcc

SEQ ID NO: 690 - DNA, 24 bp, Artificial sequence
  Primer
ttatgtatgctcttctgacttttc

SEQ ID NO: 691 - DNA, 49 bp, Artificial sequence
  Primer
aataattagagattaaatcgctcattttttgccagtttcttcaggcttc

SEQ ID NO: 692 - DNA, 49 bp, Artificial sequence
  Primer
agcctgaagaaactggcaaaaaatgagcgatttaatctctaattattag

SEQ ID NO: 693 - DNA, 49 bp, Artificial sequence
  Primer
tatggaccctgaaaccacagccacatttttcaatcattggagcaatcat

SEQ ID NO: 694 - DNA, 49 bp, Artificial sequence
  Primer
taaaatgattgctccaatgattgaaaaatgtggctgtggtttcagggtc

SEQ ID NO: 695 - DNA, 49 bp, Artificial sequence
  Primer
accgtaggtgttgtttgggaaagtggaaggccatgaagctttttctttc

SEQ ID NO: 696 - DNA, 49 bp, Artificial sequence
  Primer
ttggaaagaaaaagcttcatggccttccactttcccaaacaacacctac

SEQ ID NO: 697 - DNA, 23 bp, Artificial sequence
  Primer
ttattgcttagcgttggtagcag

SEQ ID NO: 698 - DNA, 21 bp, Artificial sequence
  Primer
tttttggtggttccggcttcc

SEQ ID NO: 699 - DNA, 22 bp, Artificial sequence
  Primer
aaagttggcatagcggaaactt

SEQ ID NO: 700 - DNA, 16 bp, Artificial sequence
  Primer
gtcattgacaccatct

SEQ ID NO: 701 - DNA, 19 bp, Artificial sequence
  Primer
agagataccgtaggtgttg

SEQ ID NO: 702 - DNA, 33 bp, Artificial sequence
  Primer
aattggcgcgccatgaaagctctggtttatcac

SEQ ID NO: 703 - DNA, 49 bp, Artificial sequence
  Primer
tgaatcatgagttttatgttaattagctcaggcagcgcctgcgttcgag

SEQ ID NO: 704 - DNA, 49 bp, Artificial sequence
  Primer
atcctctcgaacgcaggcgctgcctgagctaattaacataaaactcatg

SEQ ID NO: 705 - DNA, 34 bp, Artificial sequence
  Primer
aattgtttaaacaagtaaataaattaatcagcat

SEQ ID NO: 706 - DNA, 49 bp, Artificial sequence
  Primer
acacaatacaataacaagaagaacaaaatgaaagctctggtttatcacg

SEQ ID NO: 707 - DNA, 49 bp, Artificial sequence
  Primer
agcgtatacatctgttgggaaagtagaaggccatgaagctttttctttc

SEQ ID NO: 708 - DNA, 49 bp, Artificial sequence
  Primer
ttggaaagaaaaagcttcatggccttctactttcccaacagatgtatac

SEQ ID NO: 709 - DNA, 22 bp, Artificial sequence
  Primer
ttattgtttagcgttagtagcg

SEQ ID NO: 710 - DNA, 72 bp, Artificial sequence
  Primer
cataatcaatctcaaagagaacaacacaatacaataacaagaagaacaaaatgaaagctctggtttatcacg

SEQ ID NO: 711 - DNA, 21 bp, Artificial sequence
  Primer
taggcataatcaccgaagaag

SEQ ID NO: 712 - DNA, 21 bp, Artificial sequence
  Primer
aaaatggtaagcagctgaaag

SEQ ID NO: 713 - DNA, 17 bp, Artificial sequence
  Primer
agttgttagaactgttg

SEQ ID NO: 714 - DNA, 19 bp, Artificial sequence
  Primer
gacgatagcgtatacatct

SEQ ID NO: 715 - DNA, 7523 bp, Artificial sequence
  Synthetic construct
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 716 - DNA, 15456 bp, Artificial sequence
  Synthetic construct
aaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaggcagcgcctgcgttcgagaggatgatcttcatcgccttctccttggcgccattgaggaatacctgataggcgtgctcgatctcggccagctcgaagcgatgggtaatcatcttcttcaacggaagcttgtcggtcgaggcgaccttcatcagcatgggcgtcgtgttcgtgttcaccagtcccgtggtgatcgtcaggttcttgatccagagcttctgaatctcgaagtcaaccttgacgccatgcacgccgacgttggcgatgtgcgcgccgggcttgacgatctcctggcagatgtcccaagtcgccggtatgcccaccgcctcgatcgcaacatcgactccctctgccgcaatcctatgcacggcttcgacaacgttctccgtgccggagttgatggtgtgcgttgccccgagctccttggcgagctggaggcgattctcgtccatgtcgatcacgatgatggtcgagggggagtagaactgggcggtcaacagtacggacatgccgacggggcccgcgccgacaatagccaccgcatcgcccggctggacattcccatactggacgccgatttcgtggccggtgggcaggatgtcgctcagcaggacggcgatttcgtcgtcaattgtctgggggatcttgtagaggctgttgtcggcatgcgggatgcggacgtattcggcctgcacgccatcgatcatgtaacccaggatccacccgccgtcgcggcaatgggagtaaagctgcttcttgcagtagtcgcacgagccgcaagaagtgacgcaggaaatcaggaccttgtcgcctttcttgaactgcgtgacactctcgcccacttcctcgatgacgcctaccccttcatggcccaggatgcgcccgtcggcgacctctggattcttgcctttgtagatgccgagatccgtgccgcagatcgtggtcttcaaaacccgtactactacatccgtgggcttttgaagggtgggcttgggcttgtcttcaagcgagatcttgtggtcaccgtgataaaccagagctttcatcctcagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtct

SEQ ID NO: 717 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 718 - DNA, 1047 bp, Achromobacter xylosoxidans
atgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctga

SEQ ID NO: 719 - DNA, 1644 bp, artificial sequence
  codon optimized L. lactis kivD coding region for S. cerevisiae expression
atgtatacagtaggtgactatctgttggacagattacacgaattaggtatagaagaaatattcggagtaccaggtgactacaatttgcaatttctagatcaaattatttcacacaaagatatgaaatgggtgggaaatgctaatgagttaaatgcctcctatatggccgacgggtacgcaagaacgaaaaaggctgcggcattcttgactacatttggtgttggcgaattatccgcagttaatggcttagcgggctcctatgctgagaacctgcctgttgttgagatcgtgggatctcctacctcgaaagtgcagaacgaaggtaagtttgttcaccatacgttggctgatggtgatttcaagcactttatgaagatgcacgaaccggttactgctgccaggactttattgacagccgagaatgcaactgttgaaattgatagagtgttgtctgccttactaaaggaaagaaagccggtttacatcaatttacctgtagatgtagctgccgctaaggctgaaaaaccatccttgcctcttaagaaggaaaattccacgtcgaatacatctgatcaagagattctgaacaaaatacaggaaagtctgaagaatgccaagaaaccaattgtaatcacaggccatgaaattatatcgttcggcctagagaagactgttactcagtttatttcaaagactaagttacctattactactttgaactttggtaaatcatctgttgatgaagcattgccctcatttttggggatttacaacggtactctgtcagagccaaacttgaaggaatttgtggaatctgctgattttattcttatgttgggtgtaaagcttaccgattctagtacgggtgcatttactcaccatcttaatgaaaataaaatgatttccttgaatatcgatgaaggtaaaattttcaacgaaagaatccaaaatttcgacttcgaatccctgatatcatctcttcttgacttgtccgaaattgaatataaaggcaagtacatagataaaaagcaagaagattttgtaccttctaacgcgctgttgtcacaagatagactgtggcaagctgtcgaaaatttgacccaaagtaatgagacgatcgtggctgaacaaggcacttctttcttcggtgcctcatctatatttctgaaatcgaaatcacattttattggtcaacccttgtggggatctataggatacactttccccgcagctctaggcagccaaattgcagataaagaatctagacatttattgtttatcggagatggatcattgcaactgactgtccaagaattaggactagccattagagagaagataaacccaatctgctttatcattaataacgatggttacacggttgagagggaaattcatggtccgaaccagagttataatgacattcctatgtggaattactcaaaactgccagaaagtttcggggcaacggaagacagagttgtgtccaaaattgtgagaacagaaaatgaattcgtatccgtgatgaaagaagctcaagcagatccaaataggatgtattggatagaacttattctagcaaaggagggtgcacctaaagttttgaaaaagatgggtaagttatttgcagaacaaaacaagagc

SEQ ID NO: 720 - DNA, 8994 bp, artificial sequence
  synthetic construct
ctagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggta

SEQ ID NO: 721 - DNA, 753 bp, Saccharomyces cerevisiae
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaata

SEQ ID NO: 722 - DNA, 316 bp, Saccharomyces cerevisiae
gagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 723 - DNA, 2145 bp, artificial sequence
  constructed chimeric gene
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 724 - DNA, 4280 bp, artificial sequence
  vector
ggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccccggctctgagacagtagtaggttagtcatcgctctaccgacgcgcaggaaaagaaagaagcattgcggattacgtattctaatgttcagcccgcggaacgccagcaaatcaccacccatgcgcatgatactgagtcttgtacacgctgggcttccagtgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcttcagcccgcggaacgccagcaaatcaccacccatgcgcatgatactgagtcttgtacacgctgggcttccagtgatgatacaacgagttagccaaggtgagcacggatgtctaaattagaattacgttttaatatctttttttccatatctagggctag

SEQ ID NO: 725 - DNA, 30 bp, artificial sequence
  primer
ggaattcacacatgaaagctctggtttatc

SEQ ID NO: 726 - DNA, 28 bp, artificial sequence
  primer
gcgtccagggcgtcaaagatcaggcagc

SEQ ID NO: 727 - DNA, 55 bp, artificial sequence
  primer
aaacaaacacacatattacaatagctgaggatgaaagctctggtttatcacggtg

SEQ ID NO: 728 - DNA, 55 bp, artificial sequence
  primer
atcataagaaattcgcttactcttaattaatcaggcagcgcctgcgttcgagagg

SEQ ID NO: 729 - DNA, 28 bp, artificial sequence
  primer
ggatccgcatgcttgcatttagtcgtgc

SEQ ID NO: 730 - DNA, 20 bp, artificial sequence
  primer
gggatgcggacgtattcggc

SEQ ID NO: 731 - DNA, 30 bp, artificial sequence
  primer
gcatgcttgcatttagtcgtgcaatgtatg

SEQ ID NO: 732 - DNA, 54 bp, artificial sequence
  primer
gaacattagaatacgtaatccgcaatgcactagtaccacaggtgttgtcctctg

SEQ ID NO: 733 - DNA, 54 bp, artificial sequence
  primer
cagaggacaacacctgtggtactagtgcattgcggattacgtattctaatgttc

SEQ ID NO: 734 - DNA, 28 bp, artificial sequence
  primer
caccttggctaactcgttgtatcatcac

SEQ ID NO: 735 - DNA, 100 bp, artificial sequence
  primer
ttttaagccgaatgagtgacagaaaaagcccacaacttatcaagtgatattgaacaaagggcgaaacttcgcatgcttgcatttagtcgtgcaatgtatg

SEQ ID NO: 736 - DNA, 98 bp, artificial sequence
  primer
cccaattggtaaatattcaacaagagacgcgcagtacgtaacatgcgaattgcgtaattcacggcgataacaccttggctaactcgttgtatcatcac

SEQ ID NO: 737 - DNA, 29 bp, artificial sequence
  primer
caaaagcccatgtcccacaccaaaggatg

SEQ ID NO: 738 - DNA, 26 bp, artificial sequence
  primer
caccatcgcgcgtgcatcactgcatg

SEQ ID NO: 739 - DNA, 28 bp, artificial sequence
  primer
tcggtttttgcaatatgacctgtgggcc

SEQ ID NO: 740 - DNA, 22 bp, artificial sequence
  primer
gagaagatgcggccagcaaaac

SEQ ID NO: 741 - DNA, 2745 bp, artificial sequence
  constructed coding region-terminator segment
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaa

SEQ ID NO: 742 - DNA, 99 bp, artificial sequence
  primer
tcctttctcaattattattttctactcataacctcacgcaaaataacacagtcaaatcaatcaaagtatgactgacaaaaaaactcttaaagacttaag

SEQ ID NO: 743 - DNA, 77 bp, artificial sequence
  primer
gaacattagaatacgtaatccgcaatgcttctttcttttccgtttaacgtatagacttctaatatatttctccatac

SEQ ID NO: 744 - DNA, 45 bp, artificial sequence
  primer
aaacggaaaagaaagaagcattgcggattacgtattctaatgttc

SEQ ID NO: 745 - DNA, 88 bp, artificial sequence
  primer
tatttttcgttacataaaaatgcttataaaactttaactaataattagagattaaatcgccaccttggctaactcgttgtatcatcac

SEQ ID NO: 746 - DNA, 27 bp, artificial sequence
  primer
gacttttggaagcctgaagaaactggc

SEQ ID NO: 747 - DNA, 20 bp, artificial sequence
  primer
cttggcagcaacaggactag

SEQ ID NO: 748 - DNA, 26 bp, artificial sequence
  primer
ccaggccaattcaacagactgtcggc

SEQ ID NO: 749 - DNA, 2347 bp, artificial sequence
  constructed URA3 marker with flanking homologous repeat sequences for HIS gene replacement and marker excision
gcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtg

SEQ ID NO: 750 - DNA, 80 bp, artificial sequence
  primer
cttcgaagaatatactaaaaaatgagcaggcaagataaacgaaggcaaaggcattgcggattacgtattctaatgttcag

SEQ ID NO: 751 - DNA, 81 bp, artificial sequence
  primer
tatacacatgtatatatatcgtatgctgcagctttaaataatcggtgtcacaccttggctaactcgttgtatcatcactgg

SEQ ID NO: 752 - DNA, 26 bp, artificial sequence
  primer
gacttgaataatgcagcggcgcttgc

SEQ ID NO: 753 - DNA, 30 bp, artificial sequence
  primer
ccaccctcttcaattagctaagatcatagc

SEQ ID NO: 754 - DNA, 25 bp, artificial sequence
  primer
aaaaattgattctcatcgtaaatgc

SEQ ID NO: 755 - DNA, 20 bp, artificial sequence
  primer
ctgcagcgaggagccgtaat

SEQ ID NO: 756 - DNA, 90 bp, artificial sequence
  primer
atggttcatttaggtccaaaaaaaccacaagccagaaagggttccatggccgatgtgccagcattgcggattacgtattctaatgttcag

SEQ ID NO: 757 - DNA, 91 bp, artificial sequence
  primer
ttaagcaccgatgataccaacggacttaccttcagcaattcttttttgggccaaagcagccaccttggctaactcgttgtatcatcactgg

SEQ ID NO: 758 - DNA, 24 bp, artificial sequence
  primer
ctaggatgagtagcagcacgttcc

SEQ ID NO: 759 - DNA, 26 bp, artificial sequence
  primer
ccaattccgtgatgtctctttgttgc

SEQ ID NO: 760 - DNA, 20 bp, artificial sequence
  primer
gtgaacgagttcacaaccgc

SEQ ID NO: 761 - DNA, 22 bp, artificial sequence
  primer
gttcgttccagaattatcacgc

SEQ ID NO: 762 - DNA, 969 bp, Eubacterium saphenum ATCC 49989
atggatcttatcgatgttctaaaagaacaggtgaaagccgagaaaaaaagcatagtattcccggaaggcacggacaagcgaatcctcggtgctgccgcaaagctaaaaaaagaaaacatacttaacccgatactcgtaggcaaggaagaagacgtaaaaaaaaccgcagcggataacggaatagacgttacggatcttgagatactggatcccgctacatatcctgaaatggacgagctcgtagcaaaatttgtagaaagacgtaagggcaagatagatgaagcgggggcaagagaaaagctaacaaatgatgtgaactacttcggcaccatgctcgtatccacagacaaagtaggcggactcgtatccggcgcaattcactctacgggcgataccgtaagacctgcccttcaaatagtgaagacaaagcctgaatacaataaggtagcgggttgcttcatactgagaaagggcgatgaagtatacttgtttgcagacggcggtgtaaacctcgacccaagcgcagaggaccttgcagaaactgccatccagactgcagaaaccgcaaagaaattcgggatagatcctaaggttgcgatgctaagtttctccacaatgggctcggcttcatccgatgaagtaaccaaggtacaggaagcgacaaaacttgcaaaagaaaaagcgccggatcttgatgtagacggcgagctacaattcgatgcggcattcgtacctgaggtagccgcattaaaagctcctgattccaaggtggcaggcaaggcaaacgtattcatcttccctaaccttgcagcaggaaacataggatataaactggtacaaaggctcggaggatttgccgcaataggacctctccttcagggactcaatgcacctatcaatgacctgtccagaggctgcaatgaaaaagacgtatatgagcttgcaatagtaacggcagctacaatgtaa

SEQ ID NO: 763 - DNA, 1143 bp, bacterium Ellin514
gtgaatttggaaatttggaacctcacatggattcccgaaatcaagccatttgacattgcagtattcacctttctcggctacttaacctccatgcgttttattggcagtgtcatcgaaaagttgcagcgacatcccaagcgagttgtcttccctgaagggacggaacctcgcgtgctccaggccgcgcgccaattttactcgcttcgactcggcgtccccatcctcctgggagatcgcacgaaggttaaagaggctgcccagagcctcaatgtgtcgctggaaggtgttcgcatcattaatccggccgaaagcgaagatctggacagctttgtccgccgttttgaatccctgcgccgcctgaaaggtctgcgctcccatgaagccagagaagcgatgttgctgccgaattattacggtgccatgatggtggcaatgcatcaggctgatggcatgatctctggtaccaaccagaccactggcagcgtactccgcccactatttcaaatcattaaagtcgcccccacaacctccacggcttcgagttgcatggtgatggaagtggaagacactcggtttggtgaaaacggaaccttgttcatggcggattgcggcgtcattcctgaaccaacagtggaacagctcgctgatattgccatttcaaccgcccagctggcgcgtcaaatcatgggaacccgtccacgttgcgccctgctctccttctcaaccaagggcagcgccaaacacccatccatcatgaaggtccaggcagccacagcactggcggtgaaaaaggcgcagcaaattaatttggaagctgattttgatggcgaactccaggtggatgccgcgttagtgccggaaattgctcttcgcaagctgccagacagcaaagtgggcgggcgggcgacggtattaatcttccccgatctgaattcaggcaatattgccagcaagctcatccaacatgtcgcccgcgcgaatgcttacggtcaaatcctgctggggctggatcggccggcagcggatgtgtcccgcggatccaatgcccatgatattttgggcgtggctgccatagtgggattgcaatccatcgaatatagcaaactttatcccggcgcaggtgataagcttcccggagaatag

SEQ ID NO: 764 - DNA, 1044 bp, Chthoniobacter flavus Ellin428
atgaattttatcgagaccgtctttcaaaaactgaagcggcatcccaaacgcattgtctttcccgagggcaccgagccgcgcgtcctgcgcgctgccgcccgtttcgtgaaattacagctcggtgcgccggtggtgctggggcgcaaggacgaaatcgagaagatcgccgtggcggaggacatcagcctcgaccatatcggcgtcatcgatcccacgacttcatccgagctgccgacctttgccgcccggctggagaagctgaagcgttatcgcaacctcggcacgaagcaggccaacgagatcctggccaacccgaattacttcggcgcgatgatggtgcaatacaaccaggtcgacggcctcgtgaccggcgcccgcgataccgcgagcagcgccctgcgtccgctcatccagctgatcaagccgctgccgaccacgaccagcatttcgagctgcatgatgctcgacctttccaacaagcgctacggcgagcgcggggtcatgttcttcgcggattgcgcggtcatccccgagccgaatgtggagcaactctccgacatcgccgtgcagaccggcgcgatctgccgccagctcaccggcaacaagccgcgcatcgccctgctcagcttctcgaccaagggcagcgccaatctgccctcgccgcagaaagtcgccgcagccaccgcactcgcccgccaaaaggccgacgcccaagggctggaaatggaaatcgacggcgaactccaggccgacaccgcgctgctacccgaccttgctgcgcgcaaggcgccgagcagtctcgtggccggcaaggcgaacgtgatgatcttccccgatctgaacagcggtaacatcggcgccaagctcgtgcagtatctcgccggcgcggaaacctatggccagatcctactcggcctctcgcgtccctgcgccgatctctcgcgcggcgccaccgaggacgacatcctcggcgtcgccgccatcctcggtctccaggcgatcgaataccgtaagctttaccccccgaaccccagcgacgcgtga

SEQ ID NO: 765 - DNA, 1092 bp, Akkermansia muciniphila ATCC BAA-835
atgagtgactggcaaggcttttccccgctgaatgattttactgggccgctcctggataacctgaagcgccaccccaagcgcattgtttttccggaaggggaggatgtccgcgtgctgcgcgtgtcccagcgctttgtggaagagcaggccggcgcgcctatcctgctggggaggagggaagtcatcacgagaatggcggaaatgaacggaatttccctgaaattcgtccgtatcattgaaccggaaaaaagctcggatcttcagatgttctgcgaccgttatgaacgggcggagcagatgttcggcaacgggttgcctatgaatacccgtgaaattgtttccgaaccggttcattttgccgccatgatggtgctctacggccaggcggacgccattgtggccgggaacatgaaaagggtggcttccgttttccgcgcagtaaacaagtacaggcaggatcccgttcccaccaagcccctgtttgccatttccattgtgctcgttcccgaattttccaagaaattcggcggccgcggcgtctattttctggcggataccggggtaaaccctgaacccacggtggaaaatatggcctattttgccgtagagacggccaaaatggcccgccacatgctgggtaaaagcgttcgcgtcgccatgctgagcgcgtccacttcgggctccgttccggaactggctgcggaccgcaccagggccgctgcggcgctggcgaagagcatggtgcagaaggattgcctgaacaatgaaatctccatagagggggaaatccagattgatgccgctctgtcgtcagattcctacagcgtgcgcgtgcaccgcaactccatgcttcagccaagtgaggtttgggtcttcccgactctggatgctgcggatatctccaaaaaactgttgtgcatgatgccgtccgtatacaactatggccttattctgggcggtctgctcttcccgattgcccagctgccgcggctgacagatgaagacaggatgttcggtactgcgctggtggtggggaatgaagccattaaattccacctgttgtatccgcagggggttgctccgctttattga

SEQ ID NO: 766 - DNA, 1017 bp, Citrobacter sp. 30_2
atgatcattgaacgtgctcgtcaactcgcccaacgctcaccggcacgggtggtgttcccggatgcgctggatgtccgggtgctgaaggcggcgaattacctgcatcagcacggtctggcacatcccattctcgtcgccagtccgtttgcgctgcgccagtttgccctcagccaccgggtggcaatggatggcattcaggttatcgatccgcaaagcaatcagccaatgcgcgaagagtttgcgctgcgctggctggcccgcgcgggagataaaacgcctgcggatgcgctggaaaaactcaacgatccgctgatgttcgccgctgcaatggttagcgcgggtaaagctgacgtctgtattgcgggcaatctctcatcaacagcgaacgtgctgcgtgccggattacgcattatcgggctacagcctggctgtaaaacgctgtcgtcaattttcctgatgctgccgcagtaccttggtccgtcattaggttttgccgattgcagcgtcgtgccgcagcccaccgccgcacagcttgcggatattgcgattgccagcgcgcagacatggcaggcgatcacaggtgaagagccgcgcgtggctatgctgtcgttttcaagtaatggcagtgctcgccatcctaacgtcgctaacgtgcagcaggcgaccgagatcgttcgtgagcgtgccccgcagcttaccgtggacggagaactgcaatttgatgccgcctttgttccggatgtcgccgcgcaaaaagcgcccgccagtccgttaaagggcaatgctaatgtgatggtcttcccatcgctggaggcaggcaatattggctacaaaatagctcagcgtctgggaggatatcgcgcagtaggtccgttgattcaagggcttgccgcaccgcttcatgatctctctcgtggctgtagcgtacaggaaattatcgaactggcgttggtggcagcagtgcctcgccagactgacgtgagtcgtgaaaacgcctcgcacacactggttgtataa

SEQ ID NO: 767 - DNA, 1017 bp, Citrobacter koseri ATCC BAA-895
atgatcattgaacgttgccgcgaacaggccttacgcgcgcccgccagggtggtcttcccggatgcgctggatgtccgtgtcctgaaggcggcgcactatctgcaacggcatggtctggcgcgaccggttcttgtcaccagcccgtttgcgctacgccagtttgcgctcactcaccgtatcgcgatggatggcattcaggtgattgacccacagagcaatctgtctatgcgcgaggtgttcgccgggcgctggctggcgcgggcgggagagaaaacaccgccggatgcgctggaaaaactgaacgacccgctgatgttcgccgccgcgatggtgagcgcaggtcatgccgatgtgtgcattgccggcaacctctcttcgacagcgaacgtgctacgggcagggctacgcctgatcggtttgcagccgggctgcaaaacgctgtcgtcgatcttcctgatgctgccgcagtacaccgggcaggcgctgggattcgccgattgcagcgtggtgccgcaacccacggcggcgcaactggcggatatcgccatcgccagcgcgcagacctggcgaaccattactggagaggagcctcgggtcgccatgctgtcgttctccagtcatggcagcgcgcgtcaccccaatgtcgccaatgtgcagcaggcgacagagatcgttcgtgagcgcgcgccggatttgattgttgacggcgagttgcagttcgacgccgcttttgtcccggacgtcgccgcgcaaaaagcgcccgccagtccgttacagggcaaagccaatgtgatggtctttccgtcactggaagcgggcaacattggctacaaaatcgcccagcgtctgggaggatatcgcgccgttgggccgctgattcaggggcttgccgcaccgcttcacgatctctcccgaggctgtagcgtacaggaaattatcgaactggcgttggtggcagcagtgccgcgccagactgacgtgagtcgtgaacacgactcgcaaacactggttgtataa

SEQ ID NO: 768 - DNA, 1017 bp, Salmonella enterica subsp. enterica serovar Paratyphi A str. ATCC 9150
atgatcattgaacgcgcccgcgaactggcggtacgcgcccccgccagagtcgtttttcccgatgcgctggacgaacgcgtgctgaaagcggcgcattacctgcaacagtacggtctggctcgccccgttctggtcgccagtccgtttgcgctgcgtcagtttgccctaagtcatcgtatggcgatggatggcattcaggtcatcgacccacacagcaacctgagtatgcgccagcgttttgcgcaacgctggcttgcccgcgccggagaaaaaacgccgccggacgcagtggaaaagcttagcgacccgctgatgttcgctgccgccatggtgagcgccggtgaggcagatgtgtgtatcgcaggcaacctgtcgtcaacggcgaatgtgctgcgcgcagggctgcgggtgattggcctgcaacccgggtgcaaaacattgtcgtctattttcctgatgctgccgcagtatgccggcccggcattagggttcgccgattgcagcgtagtgccgcagccgacggcggcgcagctggcggatatcgctatcgccagcgccgatacctggcgggccattaccggcgaagagccgcgcgtggcgatgctgtcattttcaagcaacggcagcgcccgtcaccccaatgttgccaacgtgcagcaggcgacagagctcgctcgcgaacgtgcgccgcaactgcttgtggacggtgaattgcagtttgacgccgcttttgtaccggaggtcgccgcgcaaaaagcgcctgacagcccgctgcaaggccgcgccaacgtgatgattttcccgtcgctggaggcgggcaatattggctacaaaatcgctcagcgtctgggaggctatcgcgctgttgggccactaattcaggggcttgccgcgccgcttcacgacctctcccgaggctgtagcgtgcaggaaattatcgaactggcgttggtggcagccgtgccgcgccaggctgacgtgagccgcgaacgcagcttacacacactggttgaatga

SEQ ID NO: 769 - DNA, 1017 bp, Salmonella enterica subsp. arizonae serovar 62:z4,z23:--
atgatcattgaacgtgcccgcgaactggcattacgcgcccctgccagggtggtcttcccggatgcgctggacgaacgtgtactcaaagcggcgcattacctgcaacagcatggcctggcacgccccattctggtcgccagcccgtttgtgctgcgtcagtttgccctcagccatcgtatggcgctggatggcattcaggttatcgccccccctggcaacctgccaatgcgcgaaagctttgcgcagcgctggcttgcccgcgccggagaaaaaacgccgtcggacgcggtggaaaagcttaacgacccgctgatgttcgccgccgcgatggtgagcgcgggtgatgccgatgtgtgtatcgcgggcaatctctcctcgacggcgaacgtgctgcgcgcaggactgcgggtgattggtctgcaacccggctgccagacattgtcgtctattttcctgatgctgccgcagtacgccggtcaggcattagggttcgctgattgcagcgtagtgccgcagccgacggcggcgcaactggcggatatcgctatcgccagcgccgacacctggcgggccattaccggcgaagagccgcgcgtggcgatgctgtcattttcaagcaacggcagcgcccgtcaccccaatgttgccaacgtgcagcaggcgacagagatcgttcgcgaacgtgcgccgcaactgcttgtggacggtgaattgcagtttgacgccgctttcgtgccggaggttgccgcgcaaaaagcgcctgacagcccgctacaaggccgcgccaatgtgatgattttcccatcgctggaggcgggcaatattggctacaaaatcgcccagcgcctggggggatatcgcgctgtggggccgctaattcagggacttgccgcgccgcttcacgacctctcccgcggctgtagcgtgcaggaaattatcgaactggcgttggtggcagccgtgccgcgccaggctgacgtaagcagtgaaagccgcttacaaacactggttgaatga

SEQ ID NO: 770 - DNA, 1017 bp, Escherichia coli str. K-12 substr. MG1655
atgattattgaacgttgtcgtgaactggcgttgcgagcgcccgccagagtggtttttccggatgcgttagaccaacgtgtgctgaaagccgcgcaatatttacatcaacaaggtctggcaacgcccattctggtcgccaatccgtttgaacttcgtcagtttgcgctcagtcacggcgtggcgatggacgggctacaggtgattgatccgcatggcaacctcgcaatgcgggaagaatttgctcatcgctggctggcccgcgcgggcgaaaaaacgccgccggatgcgctggaaaaacttaccgaccctctgatgttcgccgcagcaatggtcagcgccggtaaagcggatgtctgtatcgcgggcaacctctcttccacggcaaatgtgctgcgtgccggattacgcattatcggcttgcagccaggctgtaaaacgctctcttccattttcctgatgttgccacagtacagcggcccggcgttgggctttgccgattgcagcgtggtgccacagccgacggcggcgcagctggcggatatcgcgcttgccagtgccgaaacctggcgcgccatcaccggagaagagccgcgcgtggcgatgctgtcgttttccagcaatggtagcgcccgtcacccctgtgttgctaacgtccagcaggcgacagaaatcgtccgtgagcgcgcaccaaagctggtggtggatggcgagttacagtttgacgccgccttcgtgccggaagtggcggcgcaaaaagcgcctgccagcccgctacagggcaaggccaatgtgatggtttttccgtcgctggaagccggaaatattggttacaaaatcgcacaacgactcggcggatatcgtgccgtcgggccactgatacaaggacttgccgcgccgatgcacgatctctctcgtggttgtagcgtgcaggaaattatcgagctggcgctggtggcagctgtgccgcgtcagacagaagtgaaccgcgaaagcagtttacaaacactggttgaatga

SEQ ID NO: 771 - DNA, 1017 bp, Klebsiella pneumoniae NTUH-K2044
atgatcattgaccagtgtcgcaaactggcgctgcgcgcccccgccagggtggtgttcccggatgcgctggacgtccgcgtgttgaaggcggcgcattatctgcagcagcagggcctggcgcatccgatcctcgtcgccagccccttcgcgctgcggcagttcgcccttggcgaacgtctgccgctgaccggggtgcaggtcatcgatccgcacagcaacctggcgatgcgcgaggcgtttgccgccgcctggcaggcgcgcgccggcgataaagcgcccgctgacgcggtcgacaagctggccgacccgctgatgttcgccgcggcgatggtcagcgccgggcaggccgaggtgtgtatcgccggaaatctctcgtcaaccgccagcgtgctgcgcgctggtctgcgccttatcggcctgcagccggggtgtaaaacgctctcttcgctgtttctgatgctgccgcagtatgccggccagccgctggggtttgccgactgcagcgtggtgccgcagccgaccgcggcgcagctggcggatatcgcgattgccagcgccgagacctggcaagcgatcgctggcgaagcgccgcgggtggcaatgctgtccttctcgacacacggcagcgcccggcatccctgtgtggctaacgtccagcaggccacggagatcgtgcgtcagcgggcgccgcagctgatggtcgatggcgagctgcagtttgacgccgcctttgtaccggacgtcgctgcgcacaaagcgcccggcagcccgctgcagggccgggccaatgtgctggtcttcccgtcgctggaggcgggcaacatcggctacaaaatcgcccagcggctgggcggatatcgcgccatcgggccgctgatccagggcctggccgccccgcttcacgacctctcgcgaggctgtagcgtagaggaaattatcgaactggcgctggtggcgtcggtaccgcgccagacggacgcaagccggatccccgactcgtccacgctggttgaatga

SEQ ID NO: 772 - DNA, 999 bp, Yersinia intermedia ATCC 29909
atggcgcaaagccatcctcggcgggtggttttccctgatgctcttgataagcgggtgctggaagccgctcattatttattacaccacagtttggctcagccaattttgctggcgaatccctttgctctacgccatttcgcactgagtcagcgcttaacattggacggcatgacggttattgatccgcaaaatgccgatgattggcaccatgagttttgccagcgtctaacgcagcgtttgggtgagaaaacgcccgcagactgtgacgagaaaatgcgtcagccgctgtggtttgctgctgcgatggtgactggcggtaaagctgatttatgcattgccggaaatctctcgtcaaccgctgccgtattgcgcgcagggttacgggtcatggggcttcaggcaggaaccaaaactctgtcatccctatttttaatgctgcctccgcaaggtgacgaggtgctgggttttgccgattgcagcgtggttcctcaaccaacctcagcgcaattggcggatatcgccataagcagcgctgcaacgtatcaaatgattacgggggctgaatctcgcgtggcgatgctttcgttttcaacccgtggaagtgccaagcattcggcagtggcatctgttcaacaggccacagagatagttcgccagcgtttaccgacgctgattgttgatggcgaattacagtttgacgcggcttttgtacccgcggtcgcgcggcaaaaagcgccagatagcttactggaagggcgcgctaatgtgatggtattcccttcacttgaggcaggaaatatcggctataagattgctcagcgcttggccggatatcgtgctttagggccgttgattcaaggacttaatgcacctatgcatgacttatcacgcgggtgtagctcacgtgaaattatcgaactggtgctggtggcacaaacgcaatgctcattgtccgtaacaccagcaaaagcaaatggagtcgcatctgctgttgcgtaa

SEQ ID NO: 773 - DNA, 978 bp, Photobacterium profundum 3TCK
atgaaattacttgagcaatgccgtgctcagtgtttgaagagcccaaaacgtatcgtatttcctgatgccaatgatgttcgtttactgcacgccgccaatgacatgaagcttgcaggattagctgagccaatcttgttgggtagtccgtttcagttacgtgaccttgcgcaccgtagtggtattgccgtgccttgtctgacgttgttatcgccagaatctgcgggttgctttgatgagatggtgaagagttatattgccaagcaacgcaagcctattacggtcgaagaggctaccgatcgtcttaaaaagcccctcgattttgccatgatgatggtggatcagggttacgccgatatttgtatcggcggcaatgtgtcaacaacgggtgatgttattcgtgctgccattcgcggtacaggcgttgcgccgggttctaaaacagtttctagcttcttcttgatgctctcgcccgatggtgaacaggttcatgctttttcggatgcgggggtcattccgttgccgacggctgagcagttagccgatattgcgattgataccgcacgtaactatcaacagctaacgggcaatattccgcgtgtggcgatgttgtcgttttcaaccaaaggcagtgcggatcatcctgcagttagtaaggtgacggaagcgacggagatggttcgccagcgtcaacctgatctgatcatcgatggtgaagtacagtttgatgctgcaattgttccggccgttgctgcacagaaaatgcctgatagcccactaggcggtctggcaaatgtgtttatctttccatctttgaatgcgggcaatattgcatacaaagttgcccaacgtttaggtggctatatcgcactgggcccgatgctgcaaggcttggcgtcaccggtgcatgatttatctcggggctgtagtgcgaacgatatcgttgatatatcggttttggcatctagcctgtgtaaataa

SEQ ID NO: 774 - DNA, 972 bp, Shewanella benthica KT99
atgaaactgcttgataagtgccgcgaggcatgtttaaagcaaccgaaacgcattgtttttccagatgctaatgacgtgcgattgttacacgcagcaaatgagctgaaaatggctggcttggctgaaccaattttattgggaagtccgtttgaactgcgcgatcacgcacatagtagcggaattgccatgccatgtttaacgatattagcccccgagtttgctggctgtttcgatgaaatggtcgatagatatatcgctaaacagcgtaaacctgtggagcgagaggaagccataagccgactcaagcaaccactgaattttgccatgatgatggttgaccaaggttacgcagatatctgtatagctggcaatatgtcatcgacgggtgatgttattcgcgctgcgttacgtggtgtcggtgttgctcccgaatctaagacggtatctagcttctttatgatgctttctccagatggaagcaagacctttgcattctcagatgcgggcgtcattccactgccaacggccgaacaactggctgatatcgcaatcgataccgcgcgtaattttcagaaattaaccggtgaagaaccgcgtgttgccatgttgtcattttcgactaagggcagcgcatcgcatccgacactcactagtgtcaccgaagcgaccgagttggttcgtcagcgtgcaccgaatctgatcatcgatggcgaagtgcagtttgatgcggctattgtgcctgcaatttctgcgcaaaaaatgccgggcagcccactcgagggtgctgccaacgtgtttattttcccctctcttaacgcgggcaacatcgcttacaaagtggcgcagcgtttgggtggatatatggctctgggacccatgttacaagggcttgcaggctctgtacatgacctgtctcgtgggtgtagtgccgatgatatcgttgatatctcagtactcgcatccaatttatag

SEQ ID NO: 775 - DNA, 984 bp, Marinobacter aquaeolei VT8
atgatccggatgatggaacagtgtcggaacgcttgtcgcgaagcacccaaacgcattgtttttcccgatgcgcttgatgcacgtgttctgcacgcggcaaacgaactgcaacagcgagggctggctgaacccattttcctgtgtaatccgtttgaacttcgtgattatgcccatgacgcaggcgtagccgtaccctgtttttcaattgtggacccgctgcgttcgccctggatggactcttttatcagtgcgtatcttgatgaaaatgagggagtggacagcgacgaagcccgcaagctcctgagccaccccctgtattttggcgccatgatggtgaagcgcgcacatgcagacatctgcatcgctggaaacgtgtccaccagtggtgacgttatccgtgctgcgatcaacgttattggcgttgaaggcgggcataagacggtgtcctcgttttttctgatggcttccgccgatggcacggatttccgtctgtttgcagacgctggtgtaattcccgaacccactgtagagcagcttgcggatatcgccatcgattcagctcgcagcttcgagacgcttaccggcgagcaagcgcgtgtcgcgctcctgtcattttcgaccaaaggcagttcccaacatcctgcagcaaagcgggtcaaggaggcctttgatttggcgcgtacgcgcgcgccttcactgatcattgatggtgagttgcagtttgatgcggcggtggtgccagcggttgcactgaaaaaggcacccgaaagcccgctgaaaggaaactcgaatgttctgatatttccgtcactggatgccggaaatatcgcttacaaggttgcccagcgcctgtgtaattacatggcgctggggccgatgttggaaggtttggcaaaacctatgcatgacctgtcacgtggatgcacggccgacgatattgtcgacgtcgccattgtggcgtcatgcctggtaaacaaagcgtag

SEQ ID NO: 776 - DNA, 981 bp, Desulfotalea psychrophila LSv54
gtgagcatattagaacgttgtaaagatgtatgtcgtaaagcgcctaagacaattgtctttcctgattgcctcgataagagagtttttgaggcggctggtcgtcttcaggcagaagggcttgctcatccagtatttatgggttctccgtttgctgttcgcgctaagatgcgggaggcaaaatgttcaagtcgtggggtgaccgtggttgaccataccagtccctctctgcttgaaaaaaatgccaatgaatttattgcaattcgtgaggcaaagggtaaaaagctgagcatggatgatgccgtaaaggccatgagatgtccccttgccggtgcagctatgatggtgcgtcgtgaggaggttaatctgggtgtttccggtaatatatcttcgactggtaatgttattcgtgcaggtttgcagtttctgcccaagcagcagggtatgaaaaccatctccagcttcttttttatgatagcaccggaaggcggaaaagattatatctttgccgattgtggtgtagtgccagtgcccaatgaaaatactttggctgatatagccatatcatcggcggataaggcgcgcaagttactcggtgaagaacctcgggtggccatgctctctttttctactaagggtagcgccaatcatgagcgggcaatttttgttcgtgataccgttgagcaaattcgtaagcgcgctcctgatatgttggttgacggtgagctacaactcgatgcagctatcgtcccaagtgttgctgcccaaaaggctcccggtagtgtagttgaaggaatggcaaatgtgcttatctttccttctcttgaagcaggtaatattggctataagctcgctcagcgtttgggtgggtatacagctcttggcccgcttcttcagggttttgctgcaggttggcatgatctttcccgtggttgtactgcggatgatatatataaggttgccgttgtaggtcagtgcctataa

SEQ ID NO: 777 - DNA, 1026 bp, Rhodococcus opacus B4
atggccccgggcgtcaccgctgcacctacctacactgcacgacagaatgattcgtcgctgatcgacggctgggtcgccgctctgcgggggcagaaccggatcgtcgctctcgcggacggcgaagacgaacgcgcgatccgtgccgcccataccctgcaccacaagtgcgtcgtctcgccgcgactgttcggacggcgggacgtcatccggcgtatcgccgaaaccgcgggagtcccgctggccgaggagttgatcgtcgacatcgccgacgccgccgccgatcccgcgatccgcggagccgtcgaagccgggttcgcccggtatcccgaccggatcgtaccggcgctgtccgatccggtgtgcctggccgcggcggcgctgcgtgccggagtggtcgatgccggagtcgcgggtgcgggcaggccgacgtccgacgtgctgcgggccggactgcgcatcgtgggcctcgcgcccgggtcgagcatcctgtcgagtgcgttcctgatgttgctgccggacggccggcaattgaccttctccgactgcgccgtcgtgcccgaccccacggccggcgaactggccgacatcgcactggcggccggcgccacccacttccacctcaccgggcagacaccgatcgtggcgatgctgtcgttcagcacccagggcagcgcgaggcatccgcgcgtggagaaggtccgcgaggccgcggatctggtccgtgtccgggacccgcaactgcacgtcgacggagatctgcagttcgacgccgcgctggtcgccgagatcggcgcgtcgaaggccccggactcccgggtcgccggtcgcgccaacgtcctggtgttcccgaacctcgacgccggcaacatcgggtacaagattgctcaaaggctggggggtgcaatagccttgggaccgatcctgcagggtttggccgcaccgtggaacgacctctcccgtggatgcaccgacagcgacatcgaattgatcgctctggtgagcgcagtccaatccctggccacctga

SEQ ID NO: 778 - DNA, 1029 bp, Rhodococcus jostii RHA1
atggccccgggcgtcaccgctgtaccacccaccgacgctgcacgactgaatgattcgtcgctgatcgaccactggatcgccaccctgcgtggggagaaccgcatcgtcggtctggcggacggagaagacgagcgcgcgatacgtgcggcccaccatctgcaccacaaatgtgtcgtctccccgcggctgttcgggcggcgggacgtcatccggcgcatcgccgaggccgcgggtatcccactggccgaggaactcgtcgtcgacctcgccgaggcggccgccgaccccgcgatccgtgacgccgtcgaatcgggattcgccaggtaccccgaccggatcgagtcggcgctgtccgacccggtgtgcctcgccgcagcggcactgcgcgccggagtggtcgacgcctgcgtcgcgggtgcgagcaggccgacgtccgacgtgctgcgggccggactgcgcatcgtcggtctcgcgccgggttcgagcatcctgtcgagctcgttcctgatgttgctgtcggacggcaggcagttgacgttctccgactgcgccgtagtacccgaccccacggtcgaggaactggtcgacatcgcgctggccgccagcgccacccacttccagctcaccgagcagacgccgatcgcggcgatgctgtcgttcagcacccagggcagcgccagccacccgcgagtggagaaggtccgcgaggccgcggaactggtgcgcgtccgggacccgcagttgcacgtggacggtgacctgcaattcgatgccgcgctggtcgccgagatcggcgcgtccaaggcgcccggttcacgggtcgctggccgggcgaacgtgttggtcttccccaatctcgatgccggcaacatcgggtacaagattgctcagcggctcggtggtgcaatagccttgggtcccatcctgcaaggcttggccgcaccgtggaacgacctgtcccgagggtgcaccggcagcgacatcgaactgatggctctggtgagcgcagtccaatccttggccacctga

SEQ ID NO: 779 - DNA, 990 bp, Streptomyces sp. AA4
atgaccatggccccattggccgagacctggcgggaacgcgtcggcgacgcccgcccgcggatcgccctcgccgacggcgccgatccgcgcgctgtcaccgcggccgcgcatctggtcgaccgcggcgtggtcgagccggtcctcgttggttcgtccgcggagatcgctgcagtggcaggagagcttggcgttgcggtgccgcccactttggacactgcggttctggccgctgacgacgctgtcctcgcgcggttggctacggcgtttccggaccgggtggagaacgttcgcaccgatccggtcgccctctccgccgcgcttctcgcgctgggccgggtggacgcgtgcctggccggggcgacgcggccgacgtccgatgtgctccgggctggcctgcggattgtcggcctcgctcctggggtgcggacgctgagcagttgcttcctgatgttgttgcaggacggccgatcgctcactttcgccgactgcgcagtggtccccgagccggacgcgaatgcgctggccgacatcgcggtcggcgcggcttccacgcaccgcgcgctgactgggaccgagcccgtcgtggcgatgctttcctttagtacgcaaggcagtgccaagcattccgcggtggacaaggttcgcgaggcgacttcgctggtgcgggaacggctgccgggcgtggctgtggacggggaattgcaattcgacgccgctgtggtggatgcggtcggggtggcgaaggcaccgcggtcgactgtcgccgggcgggcgaatgtcttggtgttccccaatcttgacgcggggaacatcgcgtacaagatcgccgaacggctcggcggggcgaccgcgctgggcccgattctgcaaggcgtcgcggcgccgctgcacgacctgtcgcgcggctgcagcgcggccgacatcgagacgatggccctgatcagcgcggtgcacgcggtgaccgggcgggaagtggagggggttcgatga

SEQ ID NO: 780 - DNA, 1023 bp, Gemmatimonas aurantiaca T-27
atgaacgccgccggccagggcgcgtcggatgccgccgcggcgtttctgcagtccttgcacgagcgtgccgcggccaagccccgcaccatcctgtttcccgaagccaccgacattcgaacggtgcaggcggtcatcgccctgcagaagcgaaagtcggtggtgccagtgctcgtgcggcgcagcgatgcctcgaccggtgtcacgcccacggcaggggtggtcctcgatccgctcaccgatccgcgtcacgaacgcgtggtggcccacctgctggcacgccgcggcgacaaggggttggcccgggaagacgccgagcgtctggcgagggacccactctatttcgccgattcgttggtcgcgttgggcgaggccgacgggtgtgtggccggtgcggtgcacaccaccgccgacgtgctccgtgccgcgctctggaccatcggcgccgccagtggcgtgcggaatgtgtcgtcctcgttctatctcatcgtgccgccgtttcgcagtggggaaggggaggtgctgacctataccgactgcgcggtcatccccgacccgagcgcccggcaactggccgatatcgcgctctcggcggcggccgatcggcgacgcatcgtgggcgacgaaccccgggtggcgtttctgtcctacagcaccatgggcagcgcggacgggccgtcggtcagcaaagtgcgtgaagccgtggcgctggtgcggcaggcggcgccgtcgctggtggtgtcgggcgagctgcaggtggacgccgcgctcatcggggagattgcccggcgcaaggcgcctggtgaggccgcgggcggtgtggccaacgtgctggtgttcccgtgcctcgacgccgggaatatcgcctacaagctcacccagcggctggccggtggcaccgccatcggacccatcctgcaggggctggcgaagccctgcagtgacttgtcccggggggccacggcagacgacattgtccatgttgcagcgatcacggccctgcaggccgctggcgctgctctctga

SEQ ID NO: 781 - DNA, 1020 bp, Clostridiales bacterium 1_7_47FAA
atgggtttactggaacagatttatgaaaaagcaaaggaaaatccccagaggatagcatttccagaagcagtcaatgaaaagatgatgcaggcagcctatgagacaggcaaggaagggtatatccttcccgtgcttgtgggatatgccgatgaaatcagggaagcattatcctccaaaggatatgaggaagatattttcacaattgtggatatcagggaagagatttataaaaagaaactcatagaccggtatgtggccctgccgcacaccctgttaaaagaaaaggccctgaaccgccgcatgcaggatccgctgtattatgccatggtcatggaggcagtgggcgaggcggatgtgacctttgcggggattgacaatacaaccggggatgtgctgctggccggacagatgattattggtctgaagccgggaatcagcaccatctcaagtatcgggttatgcgatatccctggatttaagggaagtgaaggaagccttcttgcaatcggcgacagcgctgtgtgtgccaacccggattcagggcagttggcaggaatcgctgtttctgcctgcgacacggtcagggacctgctgggatgggagccgagatgcgccatggtcagctattccaccctgggaagcggacagggggagctggtggataaagtggcggaggcggtcaggattgccaatgagcagaggccggagcttgccattgacggtgaattccagtttgacgcagccgtatcgccggcagtggcggctaaaaaggtgcagagggagagccgggttgcgggaaaagccaatgtgattatctggccggacctgaatgtgggcaatgtaggggttaagctgatacagcagttcggacacgcagatgcctacggcccaatgctccagggcttcaacaaagtggtgtgcgactgctccagaggcgcccctgtgtccgagattaagggaaatatcgtaatcagcgcagtaagggccgcaggaagtaaaaggcaggaggaaccagtatga

SEQ ID NO: 782 - DNA, 1002 bp, Clostridium papyrosolvens DSM 2782
atgaatgatttcctaaaaaaaatgacagataaggcaaaagaaaatccaaagataatagcttttccagaggctacaaatgttgatattctgagaactgctcagcaagtggtaataactggcatagggttcccgatgatgattggaaacaaagaaattatagagcagattgctgataaaaacggcgtatctacgaatggttttcaatattttgattttaatgatgaagaggtacgtcaattgctggcagaagaatatactggtaagttttcagatttttctgccaagacagttgcaaggaaagcaaaagatccggtacgctgcgcaatgtttcttctgaaacttaataaggtggattgcactgcggctggaaaagagtattccacaggagatgttatttttgaagcaatgagtattgtaggactgcaagaaggcgtagaaagtgtgtcaagtcttggtattgcagatattccgggatttaacgggtcggaaggcacgatgcttggattggctgattgtgcaattacagcacagccagatgcaaaggatctggctggtattgctattgcttcggcagatacggcgaaggcactgcttggatgggagccaagggttgcaatgctatcattttcaacctgcggaagtgccgagcatgaaagtcttgaaacagtacgtgaatcagtagaacttgtccataagctgagacctgaaataaaggtggatggtgaattccagctggattctgcaatcattcccggagttgcagaaaaaaaagtaaaaagagacagtgaagtagccggtaaggccaatattgttatttttccaaacctgcatgcaggaaacatcggagtaaaaatgattcaaatatttggacatgcaaatgcgtatggcccggtacttcagggatttgctaagccagtgtgtgacttctccagaagtgccccggtagaagaaatgttgggaaatgttgcaatgttggtaattcgtgcagcagggggtagataa

SEQ ID NO: 783 - DNA, 999 bp, Slackia heliotrinireducens DSM 20476
atgactgcatcgttgatggaccagcttaaagctcgcgcatgcgaaagcccgaaaaccgttgtgttcccagaaggggaatcgcctcgcatcatcgaggccgccgcacaggctgccgcagagggtttcgcgttccccgttctggttggaaaccctcaggtcatcggcgatatcgctgctcatcgcggccttagcctcgacggcgtagcaatacggccccttccagacgagacggaagcagaggcgcttgccgccgcttatctcgaggcgggcggaatgttgtcgagaaagggcatccttcgccgcatgaaaagcccgatgtacttcggagcgttgcttgtagcaagcggacagggtgacgccatggtcgcaggcctggaacactcaaccgcagaagttgtcttggcaagttcgacaatcatcggattcgccgagggcatttcgacgccttcgagcatttgccttatggaatgccctggctttgccggccccgagggcgagctgctcattttcgccgatcccggcgtttgcgagaaacccgacgtgtcggcattggccgacatcgcgatcagcagcgcccgcaccgcgaaggctctcttgaattgggagccgcgcgtggcattcctgtcgttctcgacaaagggtagcgtggagtctgaaatcatcgacttgcagctgaaagccctagaagaggttcgcaggcgcgaaccggatttgaaggtcgatggcgagcttcagttcgacgctgcaatcgtacctgacgtggcgcgcaaaaaggttcccgaaggctcggatgtcgcaggcgccgcaaacgtcctggtgttcccggatctgaatgcgggcaacatctgctacaaggcagcccagcgcctgactggtggaaacgcatatggcccgttcctccagggtttcgcgaagacggtgtcggacctttcgcgcgggtcgagcgtggacgacattctcggcgtgaccgtcatggcggtgctgaacagccagtcataa

SEQ ID NO: 784 - DNA, 852 bp, Ruegeria sp. R11
atgactgtacttgaaaacgcatatgcgctggcccgggatcgcaaggcacgggtggtgtttcccgagatggatgaccccagagtggcggccgcagtggaccagctgacccgtgaggggctggtggaggcggtgcctttggcgccggtgtccgacgcgcatgtcgaggtgctggtggcggcgcgcggcatgaaggaaggcatcgcgaagcggatgctctccaaacccctgtaccgcgcggcggcgatggtgtctgcgggcgaggcggatgcgatggtggcgggggcggatgtgcccacgcgccgggtgatcgaggcggccagcatcggcatcggactggatgccggggtcagtacggcttcgtcgtttttcctgatggtgtttccggacgggcgcgaattggtgtttgccgattgtgcggtcaacgtggctccggatgcggcgcaactggctgatattgcacgggcttctgcgcggtcggcagaggcgctcttgggggttgcgcgggtcgcgatgctgtcgttttccaccggcacatccggcgatggcgacagcgtggcgctggtgcgcgcggcagcagaggccagtggatttgcaggcccggtgcaggcagatgcggcactgaacccggtgattgccgagaagaaaggcatcgcgccggtcgaggccaatgtgctgatcttcccgacgctggatgcaggcaacatcggatataagctgtgccaggaattgggcggcgcgcaggcgctggggccgttcttgcagggctttgccaagccggtctgtgacctcagccggggcgcctcggttgaggatatcgtggcggcgaccgtgctgacggtggcgcagatctga

SEQ ID NO: 785 - DNA, 945 bp, Sagittula stellata E-37
atgttcgcgggcgcgcagcgctggcccccgcaggttgatcttcgcccgccgcgcggtcaaagtctgccgcgcatcggtggcgggggtggcatggcggttctggaacaggcattcgaaacggcccgcgcccggcaggcccgtgtggtctttcccgaagcgggagagccgcgcatagacgctgcccgcgagcgtcttctggccgaggggctggcgatgcccgtctcgctgaccgataccgcgacggaagcacaggtcgcggccctgaccggcgcgcgcggcatgaaagagccgatcgcccggcggatgctggcgcgcccgctgttccgggccgccgccatggtcgccgcgggtgaggcagaggccatggtcgccggtatcgccaacccgacacgccgggtgatcgaggcggcctccatcgccatcggcctggcggagggcgtgacgatcccgtccagcttcttcctgatggtctttcccgacgggcgagagatgatctttgccgactgcgccgtgaacgtggcccccgacgccggggggctggccgccatcgcaagggcctctgccctgtccgcaaccgcgctgctgggggaggcgcgggtggcgcttttgtccttttccactggcaccagcggcgcggggccatccgtcgacatcgtgcgtgccgccgccgggcagaccggtttcaccggaccgatccaggccgacgcggcactgaacgccgccatcgccgccacgaaggggatgggcgcgggcgatgccaacactctgatctttccgtcgctcgacgcgggcaatatcgcctacaagctggcgcaggaactggccggggcgcaggccatcgggccgatgctgcagggcttccgcaggccggtctgcgacctgagccgtggcgccagcgtggacgacatcgtcgccgccaccgcgctttgcatcgcgatgggctga

SEQ ID NO: 786 - DNA, 1014 bp, Fusobacterium nucleatum subsp. nucleatum ATCC 25586
gtgattataatgagttttttagggcaagttagaaaaaaggccttacaagcaaacagaagaatagttttacctgaatcaagtgatgaaagaataatccgagcaacttctcaaattttaaaagaaggtttagctcaagttgttcttgtaggaaatcaagaagcaataatgcatagtgcaaaggcttatgaagtttcattaagtggagccaaaattgtagatccttataattttgaaagattaaatgactatattaataagttagttgaattaagagctaaaaaagggatgactcctgaagaagcaaaaaaaatattattaaatgatcctactttttttggagctatgttagtaagaatgggagatgctgatggaatggtatctggatctgcatcaccaactgcaaatgtattaagagcagcaattcaagttatagggactcaaccaggagtaaagacagtttcatctgttttcattatggaattatctcaatttaaagatttatttggaagtatcttagtatttggagattgttcagttattccattcccaacttcagaacaattggctgatattgctacttctgcagctgaaacagcaattaaaatagcagggataaatccaagagtagcattgatgacattctcaacaaaaggttcagcaaaacatgaatgtgtggatagagttatagaagcaggacatattttaagagaaagaaaagtacaatttagatttgatgctgaattacaagcagatgcggctttagtaaaatctattggagaaataaaggctcctttatctgatgtatctggtaatgcaaatgtcttaatattccctacattatctgctggaaatattggatataagttggttcaaagattagcaggagctaatgcttatggaccaattatccaaggattaaatgcaccagtaaatgatttatcaagaggatgttcagttgaagatatagttgtattaactgctattacttctgcacaagcttgtatagattgttaa

SEQ ID NO: 787 - DNA, 1014 bp, Fusobacterium sp. 3_1_33
gtgattataatgagttttttagggcaagttagaaaaaaagccttacaagcacacagaagaatagttttacctgaaacaaatgatgaaagagtaataagagcagcttctcaaattttgaaagagggtttagcacaagttattcttgtaggaaatcaagaagcaataatgcacagtgcaaaggcttatgaagtttcattaagtggggcaaaaattgtagacccttataattttgaaagatttaatgattatgtaaataaattagtagaattaagagctaaaaaaggaatgactcctgaggaagcaaaaaaattattattaaataatcctactttttttggagctatgttggtaaaaatgggagatgctgatggaatggtatctggttctgcatcacctactgctaatgtattgagagcagctattcaggttataggtacacaaccaggagtaaaaacagtttcatctgttttcattatggaattatcacaatttaaagatttatttggaagtatattagtatttggagattgctcagtaatacctgtacctacatctgaacaattagcagatattgccacttcagcagctgaaacagcagtaaaaatagcaggtataaacccaagagtagcattattgacattttctacaaaaggttcagctaaacatgaatgtgtagatagagttattgaagctggtcgtattttaagagaaagaaaagtacaatttagatttgatgatgaattacaagcagatgctgccttagtaaaatctgttggagaaataaaagctcctttatcagatgtatctggtaatgcaaatgtattaatattcccttcattgtctgctggaaatattggatataaattagttcaaagattggcaggagctaatgcttatggaccaattattcaaggattaaatgcaccagtaaatgatttatcaagaggttgctcagtggaagatatagttgtattgacagctattacatctgctcaagcttgtgtagattgttaa

SEQ ID NO: 788 - DNA, 1005 bp, Fusobacterium periodonticum ATCC 33693
atgagttttttagggcaagttagaaaaaaagccttacaagcaaacagaagaatagttttaccagaaacaggggatgaaagagtaataagagctgcttctttaattttaaaagaaagtttagcacaagttgttcttgttggaaatcaagaagctataatgaatagtgcaaaagcatatgaagtttcattagctggagcaaaaatagttgatccttataattttgaaagaatggatgactatgttaataaattagtagaattaagatctaaaaaaggaatgactcctgaagaagctaaaaagattttattaaatgatcctaacttctttggtgctatgcttattaaaatgggagatgctgatggaatggtctctggttctgcatcaccaactgcaaatgttttaagagcagctatccaagttattggtactcaacctggagttaaaacagtttcatctgttttcattatggaattatctcaattcaaagatttatttggaagtattttagtatttggagattgttctgttattccattcccaacatcagaacaattagctgacattgctacttcagcagcagaaacagctgttagaatagctggaataaatcctagagttgccttaatgactttctctacaaaaggttctgctaaacatgaatgtgttgatagagtaaaagaagctggacaaattttaagagaaagaaaagtttcattcagatttgatgatgaattacaagctgatgctgctttagtaaaatctgttggagaaattaaagctcctctatcagatgtatctggaaatgctaatgtattgatattccctacattatctgctggaaatattggatataaactagttcaaagacttgctggtgctcatgcatatggacctatcatacaaggtttaaatgctccagtaaatgatttatcaagaggttgctcagttgaagatatagttgtgctaacagctatcacatctgctcaagcttgtactgagtgttaa

SEQ ID NO: 789 - DNA, 1014 bp, Fusobacterium sp. 3_1_5R
atgagttttttaggacaagttcgaaaaaaagcattacaagcaaatcgaagaatcgtattaccagaatcatttgatgaaagagtattgagagcggttgcagaaattttaaaagaaaaggtagcacaacctattttggttggaaatcctgatcaaattatgaatgatgcaaaagcttacgaaatttctttacaaggagctagaattgtagatcctgaaaattttgaaagatttgaagtatatgtagacaaattagtagaattaagatctaaaaaaggaatgactcgagaagaagcaactaaaattttgaaaaatgatatcaacttcttcggagctatgatggtaaaaatgggagatgcagacggaatggtatcaggagcatcttctccaacagcaaaagtattaagagcgggaatccaagtaattggaacaaaacctggaatgaagacagtttcttctgtatttattatggaattatctcaatttaaagaaatgtatggaagtgttttagtatttggagattgttctgtaattcctcatccaaatgcagaacaattagcagatattgcttgctcttctgcagaaacagcattatctattgcaaatatcaatccaagagttgctttattaactttctcaacaaagggatctgcaaatcatgaatgtgtagataaagtaattgaagcaggaagaattttaagagatagacatgtatctttccgttttgatgatgaattacaagccgatgctgctttagtaaaatcaattggagaaatcaaggctccattatcagatgtatccggaaatgcaaatgtattgattttccctaacttgtctgcaggaaacatcggatataaattggtacaaagattggcaggagcaaatgcttatggacctatcattcaaggattggatgctccggtaaatgacttatcaagaggatgttctgttaacgacatcgtggtattaactgctattacttcagcacaagcatgtactgattgtacatttgaataa

SEQ ID NO: 790 - DNA, 1014 bp, Fusobacterium sp. D12
atgagttttttagggcaagttcgaaaaaaagcattacaagcaaatcgaagaattgtattaccggaatcatttgacgaaagaatattgagagcggttgcggagattttgaaggaaaaggtagcacaacctgtgttaattggaaatcctgacagaatcatgaatgatgcaaaagcttatgaaatttctttgcaaggggctagaattgtagatcctgaaaattttgaaagattcgaagtgtatgtggacaagctggtggaattacgggctaaaaaaggaatgactcgagaagaagcaagcagcattttaaaaaatgacattaacttcttcggagctatgatggtaaaaatgggagatgcagacggaatggtatcaggagcttcttctccaacggcaaaggtgttaaaggcggcaattcaagttatcggaacaaaaccgggaatgaaaaccgtatcatctgtctttattatggaattatctcgtttccaagaaacctatggaagtactttagtatttggagactgttccgttattccacatccaaatgcggaacaaatggcggacattgcttgctcttcggcagaaacggcattatccattgcaaacatcaatccaagagttgctttgatgagtttctctaccaaaggctctgcaacccatgaatgtgtggataaagtgattgaagcaggaagaattctacgagaaagaaaagtttctttccggtttgatgacgaattacaagcggatgccgctttggtgaaatcggtgggagaaattaaggctccgttgtctgatgtatctggaaatgcaaatgtattgattttccctaatctatctgcaggaaacattggatataagttagtacaaagattggcgggagcaaatgcttacggacctattattcaaggattggccgctccggtaaatgatttatcaagaggatgttctatgaacgacgttgttgtattgactgctattacatcagcacaagcatgtacagattgcacatttgaataa

SEQ ID NO: 791 - DNA, 1008 bp, Fusobacterium varium ATCC 27725
gtgattgttttgagttttttggttaaaataagagaaaaagcaagaatggttggtaagacagtcgttttaccagaaggtgaagatgaaagagtagttactgctgctgctaaaatagttgaattaggagttgctaaacctgttgttttaggaattaaagctgatatggaaagagtagctaatgatttaggaatttctctaaaaggtgtggaaattattgaaattgccaactctccaaaattagacgaatatgcaactaaattcgctgaattaagagcaaagaaaggaatgacttttgaaaaagctaaagaaatcatgtcaactgatcctaacttctatggagctatgatggtaaaaatgaaagatgctgatgcaatggtatctggatcagattcacctacagcagatgtattaagagctggattacaaattattggaactaaacctggaataaaaactgtttcttctatgtttgtcatggaacttacagaaagacaagaaacttatggagaagttttactatttggagattgttcagttataccagttccaacttctgaacaattagctgatattgctgaagcttcagttatcactgctaaaaatgtagtaggaatggaaggaaaagttgctttaatgactttctcaactaaaggttctgcaagccaccctgacattgatgtagtaaaagaagcaggaaatattttgaaagaaagaggagttacattcccttttgaagctgaaattcaagctgatgctgctattgtcaaatcagtagctatgaaaaaatgtcctgaatctaaagttgcaggaagtgctaatatattagtgttccctaacctagctgcaggaaatattggatataaattagttcaaagattggctggtgctaatgcttatggtccattaattcaagggcttgcatctcctatcaatgacttatcaagaggatgttcagtagatgacatcgtaaacctagtagcaattacagcagttcaagccgctgaataa

SEQ ID NO: 792 - DNA, 1008 bp, Fusobacterium mortiferum ATCC 9817
gtgagtgttttgagttttttagtaaaaattagagaaaaggcaagagaagtacaaaaatctgttgtattaccagaaggaacagatgaaagagtaattacagctgcagctaaaatagttgagttaggagttgcaagaccaattgttttaggacacagagaagacatggaaagaatagctaatgacttaggaattagcttaagaggagtagaagttatagaagctaaaaatcctccaaaactagaaacttatgcagcaaaattagcagagttaagagctaaaaaaggaatgacaatagagcaagctagagaaattttattaaatgaccctaacttctatggtgcaatgatggttaagatgaaagatgcagatgcaatggtatctggttctgattctccaacagctgatgtattaagagcaggattacaaataataggaactagaccaggaataaaaactgtatcatcagtatttgtaatggaattaacagaaagacaagatacttatggagatgtattattatttggagactgttcagtaattcctgtacctacagcagaacaattagctgatatagctgaagcttcagtagtaactgctcacaatgtagttggaatggaaggtaaagtagcgttaatgactttctctacaaaaggttcagcacatcacccagatatcgatgtagtaattgaagctggaaaaatattagaagaaagaaatgtaaaattccactatatagcagaagttcaagcagacgctgctatagttaagtcagtagctatgaaaaaatgtccagagtctaaagttgcaggaaatgctaatattttaatattccctaacttagcagctggaaatattggatataaattagtacaaagattagcaggagctaatgcatatggtccattaattcaaggtttagcagctcctattaatgacttatcaagaggatgttcagtggatgacattgtaaacctagtagcaataacagcagttcaagcagcagaataa

SEQ ID NO: 793 - DNA, 996 bp, Arcobacter butzleri RM4018
atgggtttaattgaaactattaaagaaaaagcaaaattaaaattaagaacaattgttctacctgagccagaagacgaaagagttctaaaagctacagaacaagttttaaaagataaaactgcaaacgttgttttaattggaaatgctgatactataaaagcagatgctgctaaacatggtgcaaatattgatggagcaacaatcattgatcctaaaaaatttgataatatcaataaatatattgatgagttagttgaattaagaaaaaataaaaacctttcaagagatgaagcaactgaaattatgttaaatgaaccaagattttttggttgtatgatggtaagacttggtgatgctgatggtttagttgcgggttcaaattctccaacagctgatgtattaaaagctgctattcaagttatcaaaactgcacctggaataaatactgtttcatctacattcattatggaaacagctgatggtaaatttggtgataatggattaatcttatttgcagattgtgctgttattcctgaaccaaatgcagaacaattagctgatattgcttgtgcaactgctgcaactgctgctagcgttgttggattaaatccaagagttgctatgttatctttttctacaaaaggaagtgctgcacatccactagtagacaaagtacaatcagcttgtaaaattttaggtgaaagaaatgttaatttctcatttgatggtgagcttcaagctgatgctgctatcgttgaatctattggtgcaaaaaaagctcctggttcaaaagttgctggacatgcaaatattttagttttccctgatttacaatctggaaatattggatataaacttgttcaaagatttgcaggagcagaagctcacggaccaatcgttcaaggtttaaataaaccagtaaacgatctttcaagaggttgttctgttgaagatattgcaaatttagttgctattacagctacacaaattaaataa

SEQ ID NO: 794 - DNA, 1005 bp, Leptotrichia buccalis C-1013-b
atgaacacattaacagaaaagttaaaagaaaaagcaaaaaaattgaacaaaacgattattttgccagaatcagaagacgaaagaatattaaaagcaactgaaaaaattattgcagaaggaatcgcaaaaatagctttggttggaaatgaaaaaacattgaaggaaaaagcggaaaaaatcggagtttcattggaaggagcgatattttacaatcctaattcatgtgctacaattgatgcaatgtcagaacttttgaaaaaaagaagggaaaagaaaggtatgacatttgagacagcaaaggcgatacttatgtcagatccaagatactttgcatcgatgttggttcatcagggaagagtagatggaatggtggcaggttcaaattcacccacagcacatgttttaagagctgcaattcacgtaattggacctagaccaggattaaaaactgtatcaagttcgtttgttatgataacgaatacacctgaatttggagataacggaacatttattttctcagacggtggagtaattcctgatcctacagctatgcagcttgcggatattgccatttctgcagctgaaaaagctaaatttactgctggaataaaagagccaaaagtggcattcttgtcgttttctacaaaaggaagtgccgatggagtgtctgtaagcaaagtaagggaagctatagaaattttaaaagtcagaaatgttgattttgattttgatggggaattacagctggatgcggcaattattcctgaagtagcggcttcaaaagcacctaattctaaggtagcaggacaagcgaatgtattgatttttcctgatttggattctgggaatattggatataaattgacacagagattggcaaaggcaaaagcattaggaccattaattcaaggattggcaagaccagttcatgatttatcgagaggctgcagtgtggaagatattgttgaagttgtagcaatcacagctgtagaatctgaaatgtaa

SEQ ID NO: 795 - DNA, 1005 bp, Leptotrichia hofstadii F0254
atgaacacattagcaaatgaattaaaagaaaaagcaaaaaaactgaacaagacaatcattttacctgaaacagaagatgagagagttttgcgggcaacagaaaaaatcattaatgaaggaattgcaaaaatagcgctggtcggagatgagaaaaagttaaaggaaaaagcggctgaactgggggtttcgttggaaggagcgattttctataatcctgattcgtgtgcaacaattgacgctatgtcggaacttttgagaaaaagaagagagaaaaaaggtatgacattagaaactgcaaaagcaacacttatgtcagatccaagatattttgcggcaatgcttgtacatcaaggaagagttgatggaatggtagcaggttcggattcaccaacagcccatgttttaagagcggcaattcacataattggaccaaaggaaggactgaagacagtatcgagttcttttattatgataacaaatacgcctgaatttggagataacggaactcttgtgtattctgatggtggggtaatacctagtcctactgctatgcagcttgctgatattgctatttctgcagcagaaaaagctagatttactgctggaataaaagagcctaaagtggcatttctatcattttctacaaagggaagtgcagatggagtgtctgtaagtaaagttagagaagctatcgaaattttaaaagttagaaatgttgattttgactttgatggagaattacagctggatgctgcaattgtgccagaagtagctgctgcaaaagcgcctggctcaaaagtggcaggacaggcaaatgtattgattttccctgacttagattcaggaaatatcggttataaattaacgcagagattggctaaggcaaaagcattagggcctttaatccaaggattggcacgtccagttcacgatctttcaagaggatgtagcgtggaagatattgtggaagtcgtggcgattactgccgttgaatcagaaatgtaa

SEQ ID NO: 796 - DNA, 1008 bp, Leptotrichia goodfellowii F0264
gtggctgatttagtagcaagtttaaaagaaaaagctaaaaaattgggtaaaacagttattttacctgaaacagaagacgaaagagtcctcagagcggctgaaaaaatcatagctgaaggcattgccaaagtggctttggtaggaaatgaacagaaattaaaagaagaggctgcaaaacttggagtttcaattgaaggagcgattatatacgatcctcaaaactgtgcaacaatagacgatatggctgaacttttaagaaaaagaagagaaaaaaaaggaatgacttttgaaactgcaaaagcgacattattgtcggatccgagatttttcggagcaatgctcataagtcagggaagagttgacggaatggttgcaggatccaattcacctacagctcatgtattaagggcagcaattttggtaataggacctaaagcaggattgaaaacagtatcaagttcctttgttatgataacaaaaactcctgaatacggagataacggtgtatttatatatgccgacggaggagttataccgaatccgacagccttgcaactggcagatatagcagtatcaagtgctgaaaaagcaagatttactgcagggataaaagaacctaaagtagcgtttctttcattttctacaaaagggagtgccgatggagagtctgttacaaaagtaagagaggcgatagaaattttaaaagaaagaaatgtggacttcgagtttgacggagagcttcaactggatgcggctatcgttcctgaagtcgcaaaatcaaaagcacccggctcaaaagttgcaggacatgcaaatgttcttatattccctgatttgaactcaggaaatataggatacaaattaactcaaagactggcaggagcaaaagcattgggacctttaattcagggattggcaagtccggtacatgatctgtcaagaggatgcagtgtagacgatattgtcgaagtggtagcaataacagcagtagaatccgatcaaaaatag

SEQ ID NO: 797 - DNA, 1026 bp, Streptobacillus moniliformis DSM 12112
atggcagatttaattcaagaaattaaagaaaaggaaaaagaacataaaaaaacagtagttttaccagaatctgaagatgaaagagtattaagagctgctgaacaaattactaaagagggatttgctaatatcatattagttggtaaagactatcaagtaagagaacatgcttcaaaaataggggtagatttaagtggagtacaaattattgatccaatgtcttttgaaaaaacaccagaatttattagacaatttgttcatttaagatctaaaaaaggaatgaaagaagaacaagctcgtgaaatcattcaaaatgatgtaagattttttggagctatgcttgttagaaactgtatagcagatggtatggttgctggttctagttcaccaacatctaatgtattaagagcagcaatacaagtaataggacctaaaaaaggtttaaaaacaatttcaagttcatttattatgcaaacaaaaactaaggaatttggagtagatggaacattaatattctcagattgtggagtacttccaaatccaactgctcaacaaattgcggatatagcgatatcggctgttgaaaaatcaagattaataactaaatttactgatccgaaagtagcacttttaacttattcaactaaaggttctgctgaaggtgaacaagtaactaaaatgagagaagcatacaagatattagaagaaagaggagtagactttgaatttgatggagaattacaattagatgctgcgataattccaagtgtagctgaacaaaaagctaaagattctaatgttgcaggtaaagcaaatattttagtattccctgatttatgttctggaaatatagggtataagttagttcaaagatttgcaaaagctaaggctttaggaccattaattcaagggcttgcaagacctgtgcatgatttatcgagaggatgtaatgtagaagatatagttgatgtagttgcaataacttgtgcagaatgtgcagtattttgtgaaattttaacattataa

SEQ ID NO: 798 - DNA, 999 bp, Veillonella parvula DSM 2008
gtggatttaattcaaaaattaaaagaccaagtaaaaccattaggtaaaaaaatcgtgttgccagaatacaaagatgaacgcgtattgaaagcaactgaaattattttgaaagaaggtttcgtaacacctgtactcgttggtagccctgctgaaatcgctgaagctgctaaagctgttggtgtatccattgaaggtgctgaaatcatcgatcctgctaactacgatcgttatcaagaaatggttgatacattcgtagaattgcgcgctaaaaaaggtatgactcctgaaaaggctgatgcaactatgaaaggtgattgcttgttcttcggtgctatgcttgttcgccttggtgcagtagacggcatggttgctggctctgcttgcccaactgcaaacgtattgcgcgctgcattacaagttgtaggtactaaaccaggtcttaaaactgtatcctcttccatgttcatgttcacaagcaaaaaagaatatggcgacgacggtatgcttgtattctccgattgcggtgtattgcctaacccaactagcgaacaattggctgatattgcagaatccactgtagaaaaagctcgcaaagttgttggcatggctgatcctcgcgtatccatgttgtccttctccacaaaaggttctgcttccactcctgaagtagataaagtggttgaagctgttaatatcttgaaagaacgcaacgttgatttcaaatttgacggcgaattacaattggacgcttccatcgttccttccgtagcagaaaagaaagctcctggctccaacgtagctggtaaagctaacatcttgatcttccctgatcttcaagctgctaacatcggttacaaattggtacaacgcttctccggcgctgatgctcttggcccattgattcaaggtttggctaaaccagttcatgacctttcccgtggttgctccgctcaagatgttgtagacgttgccgctatcgctgctgttgaaagtatctaa

SEQ ID NO: 799 - DNA, 1014 bp, Acidaminococcus sp. D21
atgccttttattgatcatctgaaatctcgcgtcaaaccgattcaaaagagaatcgttcttccggaaaacaactctgacagagcccttaaagcagctgccattgttgctcgtgaaggatttgccaagatcatccttgttggggatcctgaacagctgaaccgtgatgccaagagactgggtgtctcctttgaaggcattgaaatcatcaatcctgcaacctatgaacgcatggatgagctgtgcgcttattttgcaaaacgccgtgaaaagaagggcatgaccgttgataaagcccgcgaaatcatgaccaaggacacgaccttctttggggctggcttggttgccatgggcgatgctgacgggtgcgtttctggttctacccgtacttctgctgatgttatcaaggcaggtctccaggttatcggtgtccgtcctggcaacaagactgtttgctccggctttatcgtcctcagcaacaccaaccttggtgaaggcggtaaactggtcttcggtgactgcggtgttatccttgacccgacagctgaacagcttgctgatattgctacgagctgcgccatccgtgcccgttataccctgggtatcaaagatgtccgcgttgccctcctgacctattccacgaagggatccggcactggtgaatccgttgataaggttcagcaggctgttgaaatcctgaaacaaagaaatgtcgactttgctttcgacggtgaactccaggctgacgctgcccttgttcctgaagttggcgaaagaaaagctcctggttccagcgtagctggccatgccaacgtcctcattttcccgaaccttgctgccgctaacattggctacaagttggttgaacgcttcagcggcgctacctgccttgggcctctggttcagggtctggctaaaccaatcctcgacctgtcccgcggttgctctgtcagcgatatcgttgacgttgttgctgtctgcgcaagcgatgctatccttgctgacagcctgaagtaa

SEQ ID NO: 800 - DNA, 1008 bp, Treponema denticola ATCC 35405
atgagttttgtagatgaaatgaaaagaaaggcaaagatgtatgctaaccgccttgttttgcctgaaggtactgaagaaaggactctcaaagcagcccgatctatcgtagacgaaaaattggtatcggagctttttttaatcggttccgatgatgctgtttatgcagcggcttctaaggcgggggtaaaacttggcggaatcaagataatcgatccgaaaaaatcggaatggctcgattcctttgccgaaagctattacgaaaaaagaaaggccaagggtatgacccttgaacaggctaaaatagaaatgagtgcggagctgggcttcgcagcgatgatgttggttcaagataaggcggatgcaatggttgcgggagccttaaacacaacagccgatgttctccgtgcaggtttaaaagttatcggaacccttccgggaatgaaaaccgcttcttcttgctttttgatggacacaaaaaatcccaaactcggagcaaacggagtctttatcttttcggactgtgccgtaattccgactcccagctctgaacagttggccgacattgcctgctctgcagctataagttgccggacctttgccggggttgagccgattgttgcaatgctctccttttctaccaagggttcgggcggcgacaaagatgaaaatattttacgcgtccgcgaagccgtaaaaatcttacaggaaagaaaacccgatttcgtctttgacggagaaatccagttggactgcgccatagttccttcagttatgcaaaagaaagcggccgactctcccgtaaaaggacaggccaataccctgattttccccgacctcggagccggaaacataggatataagctggtacagagaattgccggtgcagaagccctcggccccttcctccaaggctttgcaaagcccatatccgacctttccagaggctgctcggtagacgacataattaccacctcggctgtaaccttggttcaagccggaagaaaataa

SEQ ID NO: 801 - DNA, 1008 bp, Treponema vincentii ATCC 35580
atgcggtttgttcaaataatgaaagacaaagcgaaagaatatcacaatcgcttggtcttgcctgaggcgacggaagcgcgaactcttcgtgcggctcgtatacttgtcgatcaacaaattcccgccgagctgtttttaatcggaaagaaagctgaggttgaagatgcctgtaaaaaagtaggcgttgcgaccgatggtttcactattatcgatccggagcattccgaatggacggaaggttttgctacagctttatatgaaaaacggaaggctaagggaatgacgcctgaggaagcaaaaaaggagatgcatgatcctttacggttcggcgcaatgatgttagctcaagacaaagccgatgctatggttgcaggtgcagaaaatacgactgcaaacgtattgcgtgcaggacttactattgtaggggtaaagaaaggagttaagactgcttcttcctgttttattgtggataccaagagtaccgaatggggaacaaacggtgtattgattttctccgattctgcggttattcctaatccgaccgctgaacagttagcggatatcgcaacagcggctgcggaaagctatcgtgcatttatcggacatgaacctgtcgttgcgcttctatcttactctacaaaaggttcgggcggcgataaggatgaaagcatccttaaagtacgcgaagcggttaaactgcttgacgagcggaaggttaatttctgctatgacggtgaattgcagctcgatgccgcccttataccggaagtaaccgatagaaaagctcccggtagtcctatccgcgataaagtaaatacgttgatattccccgatcttaatgccggaaatatcggctataagttagtgcagcgttttgcaaaagccgatgcttacgggccttttatgcagggctttgctaagccgctgtcggatttgtcccgcggctgttcagtcgaggacattgtcgtaacggcagttgtaacgcttgtacaggccgataaaaaataa

SEQ ID NO: 802 - DNA, 1011 bp, Treponema pallidum subsp. pallidum str. Nichols
atgaccttcgttgaatcaatgcagcggcgtgctgtgcttgcgcaaaaacgactcgtgcttcctgaggcctgcgagcagcgtacgctcgaagccgcccgtttgattgtgttcagaaacatagccgcaaaagtttttcttgtcggatgcgagcgtgatatcaaaaacaccgcagacaggtgcggtatcgaccttaccgacatggtcgtcatcgatccgagcgttagcaagcacagagatcagttcgcagaacgttattttcagaagcgaaaacacaaaggaataagtcttgcccaggctgcagaggatatgcgcgatcctctgcgtttcgctgctatgatgcttgaccaaggtcacgcagatgccatggttgccggtgcagaaaacactaccgcgcgcgttcttcgtgcaggcctcaccatcatcggaacccttccgagtgttaaaactgcctcttcctgcttcgttatggatactaataacccccgtctgggaggaacacgtggtctatttattttttcagactgtgcagtgatccccactcccaccgcagaacagttggctgatatcgcctgctctgctgcagaaagctgccgcaccttcattggagaggaaccgactgtcgcacttctttcctactctactaaaggatcaggaggtgatagtgacgagaatatcctgcgtgtacgtgaggcagtcaggattctacacgaacggcgggtggactttaccttcgatggggaattgcagctcgatgctgcgctcgtacctaagattaccgaaaaaaaagcgcctcacagtcctattacgggaaaggtgaacacactcgtgtttcccgatctttcttcgggtaatattgggtacaagcttgtccagcgcctttcagatgcggatgcatacggacctttcctgcaaggttttgcaaaaccactgtctgatctctcgcgtgggtgctcggttgaagatatcgtcgccgcttgtgcagtcacacttgtgcaatcgaatggacgctaa

SEQ ID NO: 803 - DNA, 1008 bp, Brachyspira murdochii DSM 12563
atggcatcatttatggataatttgagagaaaaagtaaaatctaatcctaaaactataatattggctgaaggatatgatgaaagacatgttaaagctgcagttattttaaagaaagaacagttagttaaaggagttatattagttggagacacttctaaaatagaagctttggcaaaagaaaatgcattagaattagacggtaattttgctaaaatttttgaccctaataaagatgctaaaactgaaagttatattgaaatgctttttaaagccagagaaaaaaaaggtatgactaaagatcaggctaaagatttaattattaacaattctgtttatactggtgctgctatgcttgcttctaacgatgctgacggtatggtgggaggagcagtatatgctactggtgaaatgttaagagctgctttatttttaattggtcttaaaaaaggcattaaaactttatcttctacattctttattgaaagcccggacaaatctttatttacaaatggtatagcttgttttgctgactgtgctgttatacctgatcctacttctgaacagcttgctgatattgctgaatctactgctgaatcttatagagttatgactggtttagaaccaaaagttgctttgctttctttctctacaaaaggttctgctaaacatgaaagtgttgataaggtgatagaagctaaaaaaatattagattcacgtaatgtgaaatttgattatgacggcgaaatgcagtttgatgctgctatagttgaaaaagtaggtgctcaaaaagctcctaattctcctattaaaggtaatgctaatgtgcttgtattcccagaattaaatgctggaaatatcggatacaaaatagctcaaagagtaggtaaatgtactgctataggtcctatgcttcaaggtattgctaaacctgctaatgacctttcaagaggctgttctgctcaggatatagctgatttggcagtattaacttctttacaagctatgtaa

SEQ ID NO: 804 - DNA, 1008 bp, Brachyspira hyodysenteriae WA1
atggcatcatttatggataatttaaaagaaaaagtaaaatctaatccaaaaactataatcttagcagaaggatatgatgaaagacatgttaaggctactgttatattaaaaaaagaacagttagttaaaggaatcatattagtaggagatactgctaaaatagaaagtctagctaaagaaaatgatttaaaattagacgatggttttgcaagaatttttgatccaaaaaaagaagctaaatcagaagaatatattgaaatgcttttcaaagctagagaaaagaaaggtatgactaaagatcatgctagagatttaattacaaatcattctatatacgcagccgctgcaatgatagctgataatgatgctgacggtatggtaggcggtgctgtttattctacaggtgaaatgcttagagctgctttattcttaataggcttaaaaccaggaattagaactttatcatctacattcttccttgaaagccctgataagtctttatttacaaatggtatatcatgttttgctgactgtgcggttatacctgaacctacacctcaacagcttgctgatattgctaaagctacagctgaatcttataggaatatgacaggtaatgaacctaaagttgctttactttcattctctactaaaggttctgctgaacatgaatcaattgagagagttagagaagctaaaaagattttggattctcaagaagttgattttgtttatgacggcgaaatgcagcttgatgcagctatgattgaaaaagttgctgctcaaaaagctcctggttctcctattaaaggtgatgctaacgtatttatattcccagaattaaactcaggaaatatcggacacaaaatagctcagagagttggtaaatgtacagctataggtcctatgcttcaaggtattgctaaacctgctaatgacctttcaagaggatgttctgctcaggatattgctgatttagctgttataacttctttacaagctaaataa

SEQ ID NO: 805 - DNA, 1005 bp, Candidatus Cloacamonas acidaminovorans
atgttcataatagatgatttaataaacaaagcaaaaggaaactccggaagtattgttttgccggaatccactgatccacgcgttttaactgcggttgccaaaattgtggcaatggacttggcaaaagttaccctgctgggtgaaagtgaaataataaatcaagaagccaaagcactaaatatagaattaaacaatgtgaccataataaatcctgagacctcagaagacattcccgcttttgcagaagcatattatcaaagacgaaaagagaaaggtgttacaatggctcaggcgatagagacagttaaaaatcctttatatttcggtgcttcaatggttaaagagggaaaagttgaaggaatggttgctggagcagttaatattacagcagatgttttaagggctgcattacaagtgattggtgttatgccggggcttaaaactgtttccagcgcatttataatgccggttcctgattttcggggggaaaaaagaatttttttatttgccgattgtgctgtagttcccaatcccagttcagaacagcttgcggacattgctatgagctctgctttaacccgaaaagctataatcggagatgagccaaaagtagctttactttcgttttccaccttaggaagtgctaaacacgaacttgtagataaagtaactatggctaaagaaattttaacagaaagaaaggtggattttgattttgatggagaattacaggttgatgcagctataattcccgaagtagcaaaaaggaaagcaccccaaagttctgtggcaggaaatgccaatatccttattttcccggatttacaggcaggaaatattggttataaactggctcaatacataggaaaagtagaagcaatcggacctatcatacaaggtttagcagctccggtaagtgatttatcccgtggttgttctgctgaagatattgttaatacagtcgctattgttctgcttttggcggatcaacaaaaaaagaaataa

SEQ ID NO: 806 - DNA, 1062 bp, Perkinsus marinus ATCC 50983
atgctttctcgttctactgctcgctgtgcccccgccgcccttgctggcattcgtcagcgtgctatgcagactggccttgaaaagttcatagcgttccctgaggtcactgatgagcgtgttatccccgctgttgctaaggtcctcaaggagaagatcgcccaacccgtgctggttggtgatcgcgaggcggcttacaagtgcgcgaaggctaacaacgtgtctcttgaaggtgtgaggatcattgacccttcccttcaccctgaagtcgtcgagcagacagcaactgtcttgttccagaagcgtcagaagaagggtatgactctcgatgctgctcttgatactgtgaagaactcccctctcatgatggccgacttgatgttgaccactggtcacgttcaaggatgtgtcgccggagcctctcatacctctgctgatgtggccagagccgccttgcagactgttggtgttaaaaagggtttgaaaactgcttcttcgttcttcatcatcgccaaggatgacaagactttcctcttctctgactgcggtttctgcatcgccccttccatctcgcagctcgccgagatcgccattacgaccgcccagacctgcgaggatgtcttagccaccactccccgtgtcgccatgctcagcttctccacgtttggcagtgccaagcacgagtatgtgaccagagttgaggaggctctcgctcttgctcgcaaggagaagcctgacctcgccatcgacggtgagatgcaggtcgacgctgccatcgttcccgaggtagccgccaagaaggctcctggctccaaggttgccggccatgccaatgtcctcatcttccccgatctcaacgctggcaacatcgcctacaaggtcgctgagcgtttcggaggttatcaagccgtcggtcctatcttccaggggcttgcctatcccactaacgatctttcccgaggctgccacgctgaggatgtcgttgacgctgctgctgtgactgtccttcagggctccagcatccccatccctactggtcctgcccctggtgatatcctcaactaa

SEQ ID NO: 807 - DNA, 1047 bp, Borrelia turicatae 91E135
atgggttcttttaattttaaaaattatgtatgtgatagagcaaaaaaaattgtgagggaaaagggagataaggccagtatagtttttcctgaaagtactgatgttagaattttagaagcaactattgatcttttaaagaaaaaactcgcaggacttgtggtgcttattgggcgtagagatgaggtttttagaagattaaaagaacagtcaggttctagagatgatatcttagaaatggtaaaagttgtagatcccagttcttttaaagattttaatagatatttagatgaatattttagtttacaacataataggaaattaactttgaagcaagctagagaagaacttttagatgaaattgctttttctatgatgatggtgagacttggtgaagttaaaacctgtgtttgtggtgctttagtgtcttcagctaaagttttaaggagtgtgtttaaaatacttcctaagcttaaagagactaattttatatcttcttttatgattatggatactggtaatgatcttggtcgggctgaaacttgttttgggtatgagggaattttaatgtttgctgattgtgctgtaataatcaatcctaatgctcttcagcttgcagaaattgcaatacagagtgcaaattcatttaagaatatttttaatgcagagccaaaaatagcccttctaagcttttctacaaaggggtctgctaattctatagaagttgacaaggtgaaaggtgctttagagcttgttaaaagcaaatgctcagacttacttattgatggggaacttcagattgatgcagctttggttaaaggtgttgcagagaaaaagtgcggtgattccttggttgctggtgctgcaaatgtacttattttccctagtttggagtctggtaatattggctataagcttgttgaaagattggcttttgctaatgcctatggacctttcttgcaaggacttaaaaatcctgttagtgatctctcaagggggtgttctctagatgatatcgtattaacgagtgccttgatgattggtagttag

SEQ ID NO: 808 - DNA, 1059 bp, Borrelia hermsii DAH
atggagagtattatgggatcttttaattttaaagattatgtttgtggtagagcaaaaagaattgtgatggaaaagggagatagggctagtatagtttttcctgagagtatggatgataggattttaaaggctactatttatattttaaaggaaaaacttgcaggacttgtggtgcttattgggtgtaaggataaggtttttagaagattaaaagaatttgtgggctttagtggtgatatcttagaaatgataagagttatagagcccaattcttttaaagattttaatagatatttagatgaatatttaagtttacgatacagtaagacattaactctaagtaaggctagagaggaacttttagatgagattgttttttctatgatgatggtgagacttggtgaggttaagacttgtgtatgtggtgctttagcatcttctgctaaggttttaaggagtgtgtttggaatacttcctaagcttaaagaaactaaatgtatatcttcttttatgattatggatactgggaatgattttggtcggtttgaaacttgttttgggtatgagggaattttaatgtttgctgattgtgctgtaataataaatcctgattctatgcagcttgcagaaattgcaatacagagtgcaaattcatttaaaaatatttttagcgcagaaccaaaagtggctcttttaagcttttctacaaaagggtctgctcattctgttgaagttgaaaaggtgaggtgtgccttagatatcgttaagaaaaaatgcataaacttacttattgatggggaactgcagattgatgcagctttagttaaaagtgttgcagagaaaaaatgcagtgattccttggttgctggtgctgcaaatgtacttatttttcctaatttggaggctggtaatattgggtataagcttgttgagagattggcctttgctaaggcttatggaccttttttacaaggacttaagaatcccgttagtgatctctcgcgaggttgttctgtagatgatattgtattaacaagtgcattgatgattggtagttag

SEQ ID NO: 809 - DNA, 1071 bp, Borrelia duttonii Ly
atgcttgaggggttggtggaatatatgggcttttttaattttaaggattatgtttatgctagagcaagaaaaaatgtaatagatcatggggataaggctagtattgtttttcctgagagcactgatattagaattttaaaagctactattaatattttaagagaaggtcttgcaggatttgtagtacttattggagttagagatactattttagggaaattaagagaacttatggggtttggagatgatattttggatatgataaaaattataaatcctagttcttttaaagactttaataggtatttggatgaatacttaagtttgtgccatgataaaaaattagatgttagtaaagctaaggaagagcttttagatgatattgtattttctatgatgatggttaggcttggtgatgttaagacttgtgtttgtggtgctttagcttcttctgctaaagttttaaaaagcgtttttaagatacttcctagacttagagaaactaaatttgtgtcttcttttatgattatggatactcggaatgtttttgctcaatctgaaacttgttttgggtatgaagggattttaatgtttgctgattgtgctgtaataattaatcctgattctatacaacttgcagaaattgcaatgcatagtgcaaattcatttagaaatatttttgatcaagagccaaaggtggctcttttaagcttttctacaaaaggatctgctgattctttagaggttagaaaagtaagagatgctttagatattgttaggagcaaatgttcagacttattgattgatggagaacttcaggttgatgcagctttagttaaaagtattgcagaaaagaagtgtagtgattctctggttgccggtatttcaaatattcttatttttcctaatttagagtctggtaatattggatataaacttgttgagagattagcttttgctagagcatacggtccttttttgcaaggattaaagaatcctgttagtgatctctcaagaggttgttctgtaaatgatattgtattaacaagtgccttaatgatatgtagttaa

SEQ ID NO: 810 - DNA, 1038 bp, Borrelia spielmanii A14S
gtgttttgtttaaaagattatgtttttaagaaagcagaaatattcacaaaagagaataagcttaaaggcagtatagtttttcccgaaagcagtgattctagagttttgagggcagctgttattgttttgcaaaaaaatcttgcaaattcaattattttgatagggaaaaaagatcctgttatgaattctttaaaagaattttccagttgtaataatattttagaaagaatagaggttgttgatcctaattcttttccagatattgaaatgtatttggatgagtattggagtttgctaaagtcaaaaggagctacgaagcaaagtttaaagactcaagttttagatgaaattacttttgctatgcttatggtaaggcttggttatgttaagtcttgtgtttgtggtgctatttcgacttctgctaaggttctgtctaatgctttgagaataattcctaagttggatggtgttaagattatatcatcttttatgattatggatactttaaatgttgctcgcaatgttgatttttgttttgggcatgatggaattttattttttgcagattgttctgtagtagttaatcctaattctttagagcttgctgaaattgcattgcaaagtgctaaatcttttaaagatattttaaatgcaaaacccaaggttgctcttttaagtttttcaacaaaaggatcttccaatgctagagaaactgaaaaagtaaagaatgctttaaatattgtgaagaataaagagggcgatttgcttattgacggagagcttcaacttgattcagccataattaaaagtgttgcagagaaaaaatgcagagaatctttggtagcagggtctgctaatgttttaatatttcccaatttagatgctgggaatattggatataaattagtagagagatttgcttttgctaaagcctacggtccttttttacaaggttttgctaagcccgttagtgatctttcaaggggttgctctgttgatgaaattgtatttgcaagtgctttaatgataagcagttaa

SEQ ID NO: 811 - DNA, 1038 bp, Borrelia afzelii ACA-1
gtgttttgtttaaaagattatgtttttaagaaggcaagaatattttcaaaagagaataagcttaaggccagtatagtttttcctgaaagtagtgattctagggttttaaaagcagctgttgttgttttgcaaaaaaatcttgcgaattcaattattttgataggtaaaaaagatcctgttattaattctttaaaagaattttctagttgtaataatattttagaaagaatagaaattgttgatcctagttcttttccagacattggaatgtatttggatgaatattggagtttgttaaagtcaaaaggagctactaagcaaagtttaaagactcaagttttagatgaaattacttttgctatgcttatggtaagatttggctatgttaagtcttgtgtttgtggtgctatttcgacttccgctaaggttttgtctaatgctttgagaataattcccaagttggatggtgttaagatcatatcatcttttatgattatggatactttgaatgttgctcgcaatgttgatttttgttttggacataatggaattttattttttgcagattgttctgtagtagtcaatcctaattatttagagcttgcagaaattgcattacaaagtgctaaatcttttcaagatattttaaatgcaaagcccaaggttgctcttttaagtttttcaacaaaaggatcttctaatgctagagaaactgaaaaaataaaggatgctttaaatattgtgaagaataaaaaggccgatttacttattgatggggagcttcaacttgattcagctataattaaaaatgttgcagagaaaaaatgcagagaatctttggtagcaggttctgctaatgttttaatatttcctaatttagatgctgggaatattggatataaattagtagagagatttgcttttgctaaagcctacgggccttttttacaaggcttttctaagcccattagtgatctttcaaggggttgttctgttgatgagattgtatttgcaagtgctttaatgataagcagttaa

SEQ ID NO: 812 - DNA, 1038 bp, Borrelia garinii Far04
gtgttttgtttaaaagattatgtttttaataaggcaagaatatttgtaaaagagaataagtttaaggccagtgtagtttttcctgaaagtagtgattctagagttttgaaggcagctgttattgttttgcaaaaaaatcttgctaattcagttattttaataggcaaaaaagatcctgttgttaattctctaaaagaattttctaattgtaataatattttagaaaaaatagaagttattgatcctcattctttcccagacattgaaatgtatttggatgaatattggagtttattaaaaccaaaaggagctactaagcaaagtttaaagactcaagttttagatgaaattacttttgctatgcttatggtaagatttgggcatgtcaagtcttgtgtttgtggggctatttcaacttctgctaaggttttgtctaatgctttgagaataattcctaagttggatggcgttaagactgtatcatcttttatgattatggatactttaaatattgctcgcaatcttgatttttgttttggacataatggaattttattttttgcagattgttctttagtagtaaatcccaattctttagagcttgcagaaattgcattgcaaagcgctaaatcttttaaagacattttaaatgcaaagcccaaggttgctcttttaagtttttcaacaaaaggatcttccaatgctagagaaactgaaaaggtaaagaatgctttaaatattgtaaagaataaagagagtgatttgcttgttgatggggaacttcaacttgattcagctataattaaggatgttgcagagaaaaaatgtagcgaatctttggtagcaggttctgctaatgttttaatatttcctaatttagatgccgggaatattggttataaattagtagagagatttgcttttgctaaggcttacggtccttttttacaaggtttgtcaaagcctattagtgatctttcaaggggttgttctgttgatgaaattgtatttgcaagtgctttaatgatgggcagttaa

SEQ ID NO: 813 - DNA, 1038 bp, Borrelia valaisiana VS116
atgttttgtttaaaggattatatttttaagagagcaaaaatatttgtaaaagagaataagtttaatgccagtgtagtttatcccgaaagtagtgattccagagttttgaaggcagctgttattgttttgcaaaaaaatcttgcaagctcaattattttgataggtaaaaaggatcctgttattaattctttaaaagagttttctaattgtaattctattttagaaagaatagaagttgttgatcctaattctttcccagacattgaaatgtatttggatgaatattggagtttgctaaaactaaaaggagttactagaaagagtttaaaaactcaagttttagatgaaattacttttgctatgcttatggtaagacttggttatgtcaagtcttgtgtttgtggtgctatttcaacttccgctaaggttttgtctaatgctttgagaataattcctaaatctaatggtgttaaaatcatatcatcttttatgattatggatactttgaatattgctcgtaatgttgatttttgttttggacataatggaattttattttttgcagattgttctgtggtagtcaatcccaattctttagagcttgcagaaattgcattgcaaagtgctaaatcttttaaagatattttaaatgtaaatcctaaggttgcgcttttaagtttttcaacaaaaggatcttctaatgctagagaaactgaaaaagtaaagagtgctttaaatattgtgaaaaataaagagagtgatttgcttgttgatggggaacttcaacttgattcagctataattaaaaatgtcgcagagaaaaaatgcagagaatctttggtagcaggttctgccaatgttttaatatttcctaatttagatgctgggaatattggttataaattagtagagagatttgcttttgctaaggcctacggtccttttttgcaaggcttttccaagcccattagtgatctttcaaggggttgttctgttgatgaaattgtatttgcaagtgctttaatgataagtagttaa

SEQ ID NO: 814 - DNA, 1059 bp, Borrelia burgdorferi B31
gtgttgtattctttttataaggtgttttgtttaaaagattatgtttttaagaaggcaagaatatttgtaaaagagaataagcttaaggccaatatagtttttcccgaaagtagtgattctagagttttaaaggcagctattgttattttgcaaaaaaatcttgcagattcgattattttgataggcaaaaaagatactgttattaattctttaaaagaattttctaattgcaatgatattttaggaagaatagaagttgttgatcctaattctttcccagatattgaaatgtatttggatgaatattggagtttacaaaagttaaagggagttacgaagcaaagtttaaagactcaagttttagatgaaattacttttgctatgcttatggtaagatttggttatgctaaatcttgtgtttgtggggctgtctcaacttctgctaaagttttgtctaatgctttaagaataatccctaagttggaaggtgttaagattatatcatcttttatgattatggatactttatgcactgckcgtaatgttgatttttgttttggacataatggaatcttattttttgcagattgttctgtagtggtcaatcccaattctttagagcttgcagaaattgcattgcaaagtgctaaatcttttaaagatattttaaatgcaaagcccaaggttgctcttttgagtttttcaacaaaagggtcttctagtgctaaagaaactgaaaaagtaaagaatgctttaaatattgttaggaataaagagagtgatttacttattgatggtgagctgcagcttgattcagccataataaaagatgttgcagagaaaaaatgtagagaatctttagtagcaggttctgctaatgttttaatatttcccaatttagatgcggggaatattggttataaattagtagagagatttgcttttgccaaggcctacggtccctttttacaaggtttttccaagcccattagcgatctttcaaggggctgttctgttgatgaaattgtatttgcaagtgctttaatgataagcatttaa

SEQ ID NO: 815 - DNA, 1002 bp, uncultured Termite group 1 bacterium phylotype Rs-D17
atgaacataagagagcgcattttggaattggccaaaaaaacaaaaagtaaaataattctacctgagagttttgatataagaattttaaaagccgcgcaaattcttacaaaagatggcatagcttcggttattctgcttgctgaagatataaaagaagttgaaaagattgcttcagcggtaggggtagatttaaacgctgttgaaataattaaaatagatataaatcttcttaataaaaagaaagttgaagaatttgttgatgcgagaatgaaaaagggtatgactttgcaggatgcctcagatcttttaaaaaaacctttatacttttcaatgatgtatttaaaaagcggaaaatgcgatgcgtgcgtcgccggtgctgtttatgatacatcagatgttttaagagctagtattcaagtagcaggctttaccgaatgcacaaaactggtttcttcgtattttcttatgataccgccggatgggcataatattgcaaaagaacccgtattatttgcagattgtggcgtaaatccagatccacaggttttgggtttaaaagatattgcggttgcaacggtagagaattttaaaaagcttttcccgggaagacaggtaaatgtcgcaatgctttcgttttcaacgaaaggaagcgcaaatagcaaagtcttatcaaaagtaatagaagcgacagaacttgtcaaaagtcattttgcaggatacagcgacataaatgttgacggtgaatttcaatttgatgccgccgttgtgcaaagtgtcggaaagaaaaaagcttctggctcttctgttgccggcaatgcaaatattttaattttcccagacttaaatgccggaaatatcggttataaaattgcggaaagatacggtggatttcaagctctcggtcctataattcagggacttgcgctgccaataagtgatttaagcagaggttccagcgttgatgatatctgtctcatctgcgcaattatgcttttgaagtaa

SEQ ID NO: 816 - DNA, 969 bp, Mycoplasma mycoides subsp. mycoides SC str. PG1
atgtatacattagaagaaattaaaaatcaactagttttaaaatcagaaaaaaaatctattgtttttccagaaggtgaatctgaaattattcaatctgtggctaaaactttagttgatgaaaaattaggattaccaattctattatttaaatcttcaaaagaagttccaagtgaaattaaaaataattcatcaattaaaactatttgtttagatgaatttgacacaaaagaatttagtgaagaatttgtaaaacttagaaaaggtaaagcaactattgaagttgcacatcaagtaatgcaattaccaaattatgttggagctatgctagttaaattaaatcaagctgattgtatgttatctggattaaacaatacaacagctgatacaatcagaccagctttacaaattattggtacaaaacctggatataatattgcaagtagtatctttattatgtcaaaaggtgatgaaaattacatttttactgattgtgctttaaacattagaccaacaagcgaacaattagttgaaatcacacaaatggcagttgattttgcaaagactttaaatgtaaaaaatgttgaagctgctttattaagctattcaacaaaaggtagtggtaaaggtgaagatgttgatagagttcacaaagcagttgaaattttaaaatctagtcaaaatgattatgtttgtgaaggtgaaattcaatttgatgctgcttttgataaaaaaactagagataaaaaattcaaaaactgtttattaactaaacaaactccagatatctttgtttttccagatataaatgctggaaatattggttataaaattgctcaaagaatgggtggttttgaagcaattggaccttttgttttaggattaaatcaaccaattaatgatttgagtagaggtgctacatttatagatgttttaaatacagctataatgacactacacttatcttattaa

SEQ ID NO: 817 - DNA, 969 bp, Mycoplasma capricolum subsp. capricolum ATCC 27343
atgtatacattagaagaaattaaaaatcaactaggtttaaaatcagaaaaaaaatctattgtttttccagaagctgaatctgaaattattcaatctgtggctaaaactttagttgatgaaaaattgggattaccaattctattatttaaatcttcaaaagaagttccaagtgaaattaaaaataattcatcaattaaaactatttgtttagatgaatttgacacaaaagaatttgaagaagaatttgtaaaacttagaaaaggtaaagcaactattgaagttgcacaccaagtaatgcaattaccaaattatattggagctatgctagttaaattaaatcaggctgattgtatgttatctggattaaacaatacaacagctgatacaattagaccagctttacaaattattgggacaaaaccaggatataatattgcaagtagtatttttgttatgtcaaaaggtaatgaaaattatatttttactgattgtgctttaaatattaaaccaacaagtgaacaattagttgaaattacacaaatggcagttgattttgcaaaagctttaaatgtaaaaaatgttgaagcagctttattaagttattcaacaaatggtagtggtaaaggtgaagatgttgatagagtacatcaagcagttgaaattttaaaatctaaagaaaaagattatgtttgtgaaggtgaaattcaatttgatgcagcctttgataaaaaaactagagataagaaatttaaaaattgttcattattaaaacaaacaccagatatttttgtttttccagatataaatgctggaaatatcggttataaaatcgctcaaagaatgggtggttttgaagcaattggaccttttgttttagggttaaatcaaccagttaatgacctaagtaggggtgcaacatttgtagatgtattaaatacagctattatgacactatacttatcttattaa

SEQ ID NO: 818 - DNA, 969 bp, Mesoplasma florum L1
atgtattcagtagaacaaatcaaaaaaattctagtagactcagatcataaaaaaaccatagttttacccgaaggtgaagaacctaaaattcaagaagtagctaatactcttgttaaagaaaatatttcaaaagttattatgttatttcaaaaatcagaatcaataccgtcatcattagattcaaaaattgaagttattgcaattgataaattggataaacaaccattaattgaaaaatttatggatttaagaaaagacaaaactaatttagaacaagcaactaaattgatgggacaggccaattacataggtgcaatgttggttaaaatggaaaaagctgattgtatgctatgtggaataacatatacaacagctgatactataagacctgcattacaaattattaaaacatcaccaaatgttgcgttagcagctagtgtgtttattatgaacaaaggtgaagaaaattacttctttacagattgtgcattaaatttaaaacccacaagtcaacaattagctgacatatcaaaaatgacagcaaaatttgctcaatcatttgatgttaaaaatcctgaagttgctttattaagttactcaacagcaggatcaggggctggtgaagacgtagttcgtgttaaagaagctgttgaattattagactctcaaacagttgattttaattatgctggagaaattcagtttgatgcggcttgggataaagaaataagagataaaaaatttaaagattgtaaattaactaaacaaacacctgacgtgtttgtgttccctgatattaatgcaggaaacattggttataaaattgcccaaagaatgggtggctacgaagctataggtccattcatccttggattcaataaaccagttaatgatttaagtcgtggagctacattaacagatattatgaatacagctattattacaatttatcaagcattggaggcgtaa

SEQ ID NO: 819 - DNA, 978 bp, Spiroplasma citri
atgaacatattagaaaacataattgaaaaaattaataccttttctcaaaaaataaaaattatttttccagaaggaaattatgaacggattcaaacagtagctaaacaattaattggcacaaatattacgccaattcttgtttttgcaacacgagcagaagttccttcaacaattgacgaattacaaagtgaagtccttgttgcagaagaacaaaatgaaatagaattagcagaatatttagttgaattacgtaaaggaaaagtttcattatcagaagctaaacagttagttcgtgaatgcaattatttggcaattttatgagttaaaaaaggattagctgatggaatggttggtgggattacttatgatacaaaagatatcattggtccagcgttacgaattattaaaacaaaaccaaacgtaaaattagtttcatcattttttttaatggttcgtaatactgagcgctatatttttactgattgtgctttaaatattgatccaacagctgaggaattagcagatattgcttatttaggatatgaggctagtcaagtttttgcctttcaaaatccaaacatggctttattatcattttcaacaaaaggttcaggacgtggggcttctgttgataaagttcgtactgcttatgaccttgtacgagcaaagaatttaaaaaattgttatgttgacggtgaatttcaatttgatgccgcatgagatgatactattcgtaataaaaaagcaccatcatcacctttaaaagctcctgttgatatttttgtttttccaaatttagatgcgggaaacatcggatataaaattgcacaacgattgggaggatttgaagcaattggtccaattttgattggattagaccggccagttaatgatttatcacgtggtgccactattaatgatatttacaatactgttttagtaacagcgtatttatgtatacataaatcaaatgattag

SEQ ID NO: 820 - DNA, 963 bp, Mycoplasma genitalium G37
atgagtgttattgatatttttaaaaaacgattacaagctgttagtaaaaaacctgtaattatctttccagaaggttgatcagcaagtgttttaaaagcagttgaaatgcttaatgaatctaagctgatccaacctgcagttatctttcataatcgtcaggaaatccctgcaaattttgataaaaaaataactcattatgtgattgatgagatggatttaactagctatgctaactttgtctatgaaaaacgtaagcataaggggatggatttaaaagaagcacaaaagtttgtacgtgatcctagttctttagctgctaccttagttgctctaaaggttgttgatggtgaggtttgtggtaaagaatatgctacaaaagatactttaagaccagctttacagttactagcaactggtaattttgtttctagtgttttcatcatggaaaaaggtgaagaacgtttgtacttcactgattgtgcttttgctgtttatcctaactcccaagagttagcaacaattgctgaaaacaccttcaattttgccaaaagtttaaatgaggatgagataaaaatggcttttttaagctattcaacgcttggcagtggtaagggtgaaatggtggataaagttgttttagcaactaaactatttttagaaaaacaccctgaattgcatcaaagtgtttgtggtgagctccagtttgatgctgcttttgttgaaaaggttaggttacaaaaagcacctcaactaacttgaaaaaatagtgctaatatctatgtttttcctaatttagatgctggtaacattgcttataaaatcgcccaaagacttggagggtatgatgcaattggtcctattgttcttggactttcaagtccagtgaatgatctttcaaggggagctagtgtcagtgacatttttaatgttggaattatcactgccgctcaagcaattaaataa

SEQ ID NO: 821 - DNA, 963 bp, Mycoplasma pneumoniae M129
atgagtgttattgatcttttaaaacaacgtgttcaaagtgctggtaaaaagccagtgatcattttccctgaaggttgatcgccaaccgtaatggaagcagttaaccagctccagcaagcgggtattttaaccccaccggtgatcttccgcacccgcagtgaagtaccagctggttttaacaccgccatcaagcactatgtgattgaggaaatggacttgacaaagtacgctaacttcgtttatgaaaagcgcaagcacaagggcatggaaatgcgtgaagcacaaaagtttgtccgtgatgccagttccctagcagccactttagtagcactcaacgaagtggatggggaagtgtgtggtaaggaatacgctacgaaggatactctccgtcctgctttacaactgttaggtactggtaactttgtgtcgagtgtgttcatcatggaaaagaatgaggaacgcttgtactttaccgactgtgcttttgctgtttacccttcaccccaagaattagcagttgtagcggaaaacacctttaagtttgcccaaagtatgggggaaccagaactcaagatggtctttttgagctattcaacactgggcagtggtaaaggggaagcggtggacaaagtagtcagtgcgacccaaatcttcttggaaaaacaccccgaactcaaagctaatgtttgtggtgaattacagtttgacagtgcttttgtggaaaaggtacgcaaacaaaaagcccctaatttgacttggaatggatcagctaacatctatgtgttcccgaacctagatgctggtaacattggatacaagattgcgcaacgtttaggtggttatgaagcaattggtccaattgttttaggtctagcacgtccttttaacgacctttcccgtggtgccagtgtcagtgatgtctttaacgtgggcattattaccgcagcgcaaacacttaaataa

SEQ ID NO: 822 - DNA, 993 bp, Mycoplasma gallisepticum R
atcaatggtgaaaatatgagtacattaatagaagaattaaaaaataagatcaagaattctaaaaaagttcctcagatccttttagtagaaggatgaaatgcttgcgtacaagaagctgctaaacaactagttgcagaaaaattggttaaaccagttttaatgtttagaacaatggacgaaattccagctgattttgatccgagaatcaaacgttacgtaattgaaaaaatggatttatctaagtatgcgacatacttatttaaattacgtgaaaagaagggaatgacactagaagtagctcaacaagaagtgcaaaagcctaatgtgttagcttctttattagtaaaacttgatgaagttgatggtgaagtatgtggtaaggaatacacaactaaagagacactaaaaccagctttacaaattattaagacttcagaaactgctaaaattgtttcttcagtaatggttcttgaaaaaaaccaagaacgtttagtttttgctgactgtgcaattaatgtatatccaacagctgaagagttagctgagattgctaaatcaacaattaagtttgctaaagatgttttacaaattgaaaagatcaatttagcaatgttaagctattcaacccttaactcaggtgtaggtgaatctgttgataaagttaaagcagcaactaaattagtagaagaatctgacgtgggtaaattagcttcaatctgtggtcctatgcaatttgatgcggcttatgttgaagaagtaagaaaacaaaaagcgcctaaattagactgagaaaaaggtgctaatgtattcatcttccctaatattgatgctgggaacattggttacaagattgctcaacgcttaggtggctatgacgcaatcggtccagtacttactggtttagctaaacctgtaaacgatctaagtcgtggtgctaatgctcacgaaatttactcagttgctatcattactgcttgccaagctgtagcataa

SEQ ID NO: 823 - DNA, 975 bp, Mycoplasma penetrans HF-2
atgaaaattattcaaaatattaaaaaagatgtttcatcacttggttacaaaccgactattgtatatgcagaaggatgaaacaaaactattcaagaagctgcaactcaagttaaaaatgaaaacttagttgatgttgtagtaatttttagaactcaagaagagttaaatggatttaataacactgcaaatgtgaaaactattgttattgaaaatagtgacttatcacaatatgctaaccttctttttgatttaagaaaagaaaaaggtttatcttatgaagatgctgttaaactttcaaaagaaccaaattaccttgcttgtttaatggtgaaaagtaatgaaaactgaggggcaatttgtggaattgaatatactacaaaagatactttaagagcagctttacaagttattaaagctaaaaaaggaagtattgtaaacagtatcatgattttagaaagagaagataaatcaatttttgcttcagatattgggttagttattaacccatcagctgaagaactttcaaagattgtatataactgtgtagatttcattgttaatacattaaaaattgtaaataataatgttgcaatgctaagttattcaactaatggaagtggtgctggagaatctgttgataaagtaaaacaggcatttgaactttataaaactttaccacaaaaccctcatgcaaatgtatatggtgaaatccaatttgatgcagcagtagattctaaaattagatctaaaaaaagtccagactgtacatgaagtggagatgcaaatgtatttgttttcccaaacttagatgctggaaatatctcttataaaattttacaaagatatgcaggatttgaaccaactggaccaattattattggattagataaaccagtaaatgatttaagtagaggtgcaggtttatttgaagtagtttctttaagctatgttactgctttacaaactaaaaactaa

SEQ ID NO: 824 - DNA, 954 bp, Mycoplasma hyopneumoniae 232
atgacataccaagaatatcttcaagcaagacttgagcaacaaaatgagacaaaaagtttacgctcagttctaattattgatggcgctgatccgcgagcaattgccgcggcaaaacttttaaaggaaaaaaatttagtaaaaccggttttactagttgatgaagaaattccaaatcttgacgttgatcaacatatagttaattttcaagaaaaaatggaatttattaaggaatttcttaaattccgcaagggaaaagaaactcctgagtcagccgaaattcaatttcaatcaaatgctttttatggaacaatgctactaagaaagaaaaaagtagatgcagttgtcgggggtcttaattacccaacagccgaaattttacgagcagcttttaaaataatcgggccaaaaccaaacataaaaacaatttcatcagtaatgattatgcataaagatcaggaaaaatatttatttagtgatatttcagtaaatattgctccaaatgagaatcaacttgttgatattgctaaaaatgcccttgattttgctattcagttaggttttgatccaaaaccagcttttctttccttttcaacaaaaggatcagcaaaatcaccgcagtcagaattagtggctaaagcgacgcaaatgtttaatgcaacatccccaattgaagcttatggtgaaattcagcttgatgccgcccttgatattgaagttcgccgccaaaaatatgaagtaaatgtaggtaaaaacgccaatattttaattttcccgaatcttgatgcaggaaatattggctataaaattgcccaaagattgggaaattttggggcaattggcccaataattaccggaattaatgccccaattaatgatttatcccggggatcaacaactcaagatgtctttaataccgtgctaattagcgctctacaagttgaagaaggtaaatag

SEQ ID NO: 825 - DNA, 972 bp, Mycoplasma conjunctivae
atgaaaggaaaaaatatgaattaccaaaaggaattagaaaaaagtgtcattgataatcaaaaagatagtggactaaaaactattttaataatcgatggggaagacaaaagagcaattaaagcagctgagttattatcaaaaaataagctagttgaaccaattttattaactaaaaataaaattgaaaacactagtgtaaaacaacatatttttaatgaaacagaatatcaagaatttgttgaaaaatttgttgaactacgtaaaggaaaagaaacccttgaagctgcccaaaaacagatgtcaagccttcctttttatggaacaatgctactaaaattaaacaaagtagatggtgtcattggtgggctaaattacccaacagctgatattttaagagctgcctttaaaattatagggcctacccccggaattaaaacaatttcttcagtaatgattgttcacaaagaagaacaaaaattcttatttagcgatatttcagtaaatattgcaccaacagttgaacaattggtcgatattgcaaaaaatgcaaatgattttgcacttcagttaggttttgatccgcaattagcttttctttctttttcaacaagtagatcagcagttgctccacaatctgaattagtcgaaaaagcgagtcaaatttataatgaaagtgctactaaaaaagcacttggagaaattcaatttgatgctgccttagacgaggctgtgcgaagtcaaaaatacaaaggtgaactaccaaaaagtaatgcaaatgttttaatttttcctaatttagatgcaggtaatattggttacaaaatagcacaaagattaggtggctacggtgcaattgggccaattattaccggaattgcaagcccaattaatgacttgtcaagaggagctacagttgaagatatttacaacacagcactgattaccgcactacaagctaaaggagataaataa

SEQ ID NO: 826 - DNA, 957 bp, Mycoplasma agalactiae PG2
atggattttgaaaaacgcctaaaaggcatagtaaacacacttccaaaaactaaaatattacttattgatggtagtgacaatagaagcattgaggctgcaaacaaattagctgaatttagcaatctagaaattacattattagttgaaaacgatgaaaaaattgaaactaaagctaatgttgtaaacatgaacaaagatgccaataaattagagttattggctcaaaagtatgttgaattacgtaaaggaaaagaagacattgaagctgctagaaaagcactaagcacacgtcctttttatgcaatgatgcttttagcaacaggtgaaattgatggcgttgttggtggcctaaattactcaacagcagacattttaagagctgcttttaaagcaattggccctaaaccaggaatcaaaactatttcatcagttatgattatgcataaagaagaaaaactttacttctttagtgacatttcagtaaatcctaaacctgatttaaatggattagttgatatagcaagtaatgctgctgagtttgctaaaacatttattgatgaaccaaaagtagcctttttaagcttttcaacaagttgatcagcagttacacctgaaactaaattagttgctgatgctacagttgaatttaacaaagtataccaaggcactaaagcaattggtgaagttcaattagatgctgctgttaatgaaggcgtaagaaaaagcaaatacaagggagaaacttttgctggcgaagctaatgtgttagttttccctgatttaggagctggaaatattggttataaaattgctcaaagatttggcggttttggtgctgttggaccaattattacaggtgttaaaaaaccagttaatgacttatcacgtggaagcttaactgacgatgttgttaatacagttttaattacagcaattcaagcaaacaacaaggagtag

SEQ ID NO: 827 - DNA, 954 bp, Mycoplasma fermentans PG18
atgaaatttacatctttaattgaaaaaagaattaaagcaatgaaaactaaaaaaagaattgcttttatagatggtgatgatagtagagcactagataccattaaacaattagaacaatttcctaatgttgaattaactttattagttgaaactgatgttaagtcaaaaaccaatgttaagtttataaacattaataaagataaacaaaaacaaaatgatttagctcaaaaatattttgaattaagaaaaggcaaagaaacaattgaacaagctcaaagaaacctaaaaacaagacctttctatgctatgatgcttttagctacaggtgaagttgatggggtagttggcggacttaattatgcaactgcagatatcttaagagcagcttttaaagctataggcgctagagaaggagtaaaaactatttcttcagttatggtagtacataacgaaaaaaatacttacttcttcagtgacatttcagtaaatgttaagcctgatcaaaaagctttagtagaaattggacttaatgctgctcaatttgctcaaagcatggggatagaacctaaaatagccttcttaagtttctcaactaactattcagcaaaaacacctgaaagtgaattagtacacaatgctgttgaagaattcaataccatttatcaaggtactaaagctattggagaaattcaattagatgctgctttagatttagaagttagaaaagctaaatataaattagattactataaagaaccagcaaatactttaattttccctgatttagatgctggaaatataggctataaattagctcaaagattaggaaattatggggcaattggacctattgttgttggtactaaaaaaccagtcaatgatctttcaagaggttcaagtgtaaaagatgtaattaatacaattttaatcactgcattgcaggcagagaaatag

SEQ ID NO: 828 - DNA, 960 bp, Mycoplasma synoviae 53
atgaactacgaactaaatctaaaaagtcaagtagacgctttaaaaagcgttaaaaaaattgttttaatcgatggcgatgaccaaagagcacttgacgcagttagagaacttaaagctcaaaaaaatattgaagttttactactaactgaaaagcaagaaaattctagcgaatttgaatttgtaaatatttttgccgacgaggcaaaaactaaaaaatatgtagagcaatatttagaacttagaaaaaataaagaaaccttagagcaagctgagaaagcaatggcaagccgtccatttcacgcaatgatgatgcttcataataatgaagttgatggagtggtcgggggacttaaatttaccactgctgatatattaagggcagcttttaaagtaatagggcctaaacctggaattaaaaccatttcttcaattatggttatgcataaagaagaacaacaaatggtatttagtgatatttcagttaacgtttcgccaaatgctcagcagctttctgaaattgcaaccaatgccgctgaagctgcagagctacttggttttcctaatcctaaagttgcattcttaagtttttctacatcaggaagcgctgttactgaagaaagcaaactagtaaaagaagcaactgatttatttaatgcatcatatgctaaaactaaagcaattggagaagttcaacttgacgctgcaattgacttaagcgttagaaaatcaaaatacaaacaagactcatatgatgagaaagctaatttactagtgtttcctaatttaagcgctggaaatattggatataaattagtgcaaagatatggaaactttggtgcaataggacctatcattgtaggaactaaaaaaccagtaaatgatttatctagaggaagctcagttaatgacgttgtaaataccgttttaattacagcactacaatcagaaggaagcaaataa

SEQ ID NO: 829 - DNA, 957 bp, Mycoplasma pulmonis UAB CTIP
atgaattttaatgactatattatttctagagtcaaaaaacttaaagaaaaaaaacgtatcctactagttgatggaaacgatccaagatctcttgaagctgccaaagaacttcaaaaatatccaaatattgaagttagccttttggttgagtctaaaagcgatgttaaagatggatttaactttgttgttttagatcaagatcaaaaacaatacgaaagtttttgtcaagatctttttgaatcaagaaaaggaaaagactctcttgagtctgttcaaaaagctcttaaaactcgtcctttttatgcaatgatgctactaaaaaaaggcttttttgatggagttgttggtggacttttatatacaacagctgatattttaaaagctgcttttaaggttgttggtcctaaagctggtgtaaaaactattagctcattaatgattatgtctaagggcgaagatactaaaatttttgcagatatttcaatcaatgttaacccttcagctgatcaattagttgacattgctaaaaacagcgttgagtttttagaacaaatgggtattgaagcttttccttcatttttatctttttcaactcaaggctcagctgttagtgatgagactaaaaaagtagttgaggccaaagaaaaatttaatgctctagcactaaaggccaaagctctaggagagattcaatttgatgcagccgttgatcttaaaacaagatcttcaaaatacaaaaacccagagtttagtcaagagtctaatttactaatttttcctgacttagaagctggaaacattggatataaaattgctcaaagaatgggtaaatatggagcttttggacctattgtaactggaacaaaacttccaattaacgatctttcaagaggagcatcagttgaagatgttgccaatactgttttaattactgcactgcaaagcgagggaaaataa

SEQ ID NO: 830 - DNA, 969 bp, Mycoplasma mobile 163K
atgttatttacagaaaaaatcaaaactagtgttaaaaatctagctaaaaaatacaaggtacttcttgttgatggagatgattcaagagcccaagaagcagctcgtatgttacaagactctgatttagtggaagtgagtttgctagttgaaaatcctacaaatgcaaaaggattaaaattcataaacatgaatgataacaaaaatcttaagactgaattcataacaaaaatcttagaatttagaaaaggaaaggaaactgaagagagtgctaaaagtgcagttgaaactagacctttttatgctgcaatgcttttaaaggaaaattattttgatgcagttgttggtggtttattatataaaacatcagatattttaagagccgcatttaaaatcatcggaagcaaaaaaggtcaaaaaaccatttcatcttcaatgattatgcataaaaatgatgaggcatttttatttagtgatattagtgtacaaataaaacctgatgctacacaattggctgaaattggattaaatgcttctgaatttgcaaaagctttaggtttaaaagatacagttgcatttttatcattttctactgctaaaagtgcagtttcacctgaatctgaaactgtttcgcaagctacagaaatttataattccaaaacaagtggaataaaagcaataggtgaaatccaattagatgctgcaattgatttaaaagttagagaagcaaaatttggaaaatcttcttttgaatcaaaaccagatgtatttgtttttccagatttaggagctggtaatataggttataaattagttcaaagatttggtaattatggtgcaattggtccaattgtaaatgggatatctaaacctatgaatgatttaagtagaggttctacatctgaagatgttttttatacagtgttaatttcagtattacaagctgcacacaatgaaaaagagagcaaataa

SEQ ID NO: 831 - DNA, 975 bp, Mycoplasma agalactiae PG2
atgcacagtacttcaaaatttagtggctatattaactctttattaagagaaaagagccaaaagcaaatactgtcagttttgttcattgatggtgatgataaaagggctagagaagctgcattgtatttcaaaaataacaacttagctaaaccaattatgctgctagaaaatgaaagccaagttgttgatgatggactagaaaacataatcttaagtaaggaaagtgaatcaattacggcatatgcgcaagagttagttaaacttcgtgctggcaaagaagattatgaaacttgttttaaaaatatgcaaactagaccatattatggtgcaatgatgataaagcttaaagctgttgacagtgctgttgggggcttaatttactcaactgctgacattttgcgtgctgcttttaaatgcattggggcaaagccaggaattaaaactatttctagtgttatagttatgcataaagatgatgagcaacttatttttactgacccatcaacagtgcaaaaaccaaatgctgagcaattagttgatatagctgctaatgctattaattttgctaatatgatgaatatgaatagtctaggagcatttttaacttattcaactaataactctggcaagggtgaaaatcctgacttagttagagaagcagtaaaaatagctacttcaaagagcctaaatgtaattaatggtgagatgcaatttgattcagcttatgatctaaatgtcagaaaatctaagtttcctagtgcaccacaaaaagaagcaggagtatttatttttcctaatttagaaagctgtaatattggttgcaaaatagcacaaagaatgggtaattatggcgctgttggagcaattttgcaaggaataaatggggcaattaatgactttagccgcggggcaactgtagctgatgttattgatgttacttctattactattttgaacggatatacctttaaataa

SEQ ID NO: 832 - DNA, 987 bp, Buchnera aphidicola str. Cc (Cinara cedri)
atgaaaaaatattcagaaaattttaaattatttttacaagaaaaagcacgttcatgtgtaaaaacaattatttttccagaaggaaataatttaaaaattattaaatctgcattaatttgtagtaaattaaaaatatctaaatgtattttattaggaatatataaagatattcaagaattaatgaaaaaaaataatttatctttaaatgaagatatagaaattattaatcctaataagattcgtcataattattcttatgatttatttcaattaagaaaaaataaggatatagatagtgaacttactgctttaaatttattaaaaaataatataattttatctcttatgatgttacataatggagatgtagatggtgttatagcaggaataacttgtcctacagcagcagtaattagacctacatttcaaataattcaaaataattctataaattcttttgtttcttctgttttttttatgttattttctaataaaatattagtttatggagattgtgctattaatcgatatccaaattctaaaatgttagctgaaatcgctattcaatctgcaaatacagctaaatctataggaatattacctaaaattgcaatgttatcatattctactggaaattcgggatttggaaaatcagttaatagaattaataatgctataaaaattgtgaaaaaaaaacaaccaaattttttaatagatggtccgctacaatatgatgctgctgtttctaagaaagtagcaaaaataaaattatctaattcagtagtttcaggtcgagcaaatgtattaatttttccagatttaaatgctggtaatattacttataaagctgttcaaagatcttctaacgtcatttctatcggacctattttgcaaggtttgaataaaccagtaaatgatttatcaagaggtgcatcaattgatgatattgtatatactacagccatgactgttattcagtctttataa

SEQ ID NO: 833 - DNA, 999 bp, Clostridium botulinum B str. Eklund 17B
atgcaacttatggaaaaaatgtggcttagagccaaatcagataagaagaatattgtattgccagagggaattgaagaaagaaatatagctgctgctagaaaaatagtagataatggtttagcaaatcctattctaattggagatagggaaaaagtgctaaaaaaagcagatgaaataaatgtgaatttggaaaatatacaaataatagatccaaatgattcagacaagctagaaatttatataaaaaatttctacgaacttagaaaaaataaaggaatgactatggccaaggccgaaaagatagtaagagaccctctttattttgcaactatgatggtaaaattagatgatgcagatggaatggtttcaggagcaattcatactacaggagatttattaagaccaggattgcaaattataaaaacaatgccaggagtatcaatagtatcaagtttctttattatgaatgtaccaggaaaagaatttggtactgatggaactttaatatttgcggactgtgcagttaatccaaatccaaatgaagacgaattagcagctatagctatagcaacagcagagacagcaaagaagctttgtaaaatggaaccaagagtagctatgctatcattctcaacaatgggaagcgctgacaatgaacttgtagataaagtaagaaatgctactgccaaagccaatgctttaagacctgatctaatgatagatggagaattacaattagatgctgcaataattgaaaaagtagcagctcaaaaagctccaaatagcaaagttgcaggaaaagcaaatgtactagtttttccagatttacaatcaggaaatataggatataaattagtacaaagatttgctaatgcagatgcgattggcccagtttgccaaggatttgcaaagccaataaatgatttatcaagagggtgtagtgctgatgatatagttaatgttgtagcgttaacagcagttcaagcacaagaggtttaa

SEQ ID NO: 834 - DNA, 1002 bp, Clostridium beijerinckii NCIMB 8052
atggaccttatgaaaaaaatatggactgcagcacaatcaaataaacaaaaaattgttcttccagagggaaacgaggaaagaaatatagcagctgcagaaaaaatacaaaaattaggattagcttacccaattttaataggtaacaaagaagaaataaataataaggcaaaggaattagatgtaaatttatcaggaattgagattatcgatccaaatgaatcagataaattagaaaagtatattgaagccttctatgaacttagaaagacaaaaggcgttacaatggaaaaggcagataaaatagtcagagatcctctatattttggtacgatgatggttaaattagatgatgcagatggaatggtatcaggagcaattcacacaactggagatttattaagaccaggattacaaattataaagacagcaccaggggtatctgttgtttcaagcttctttataatgcaagttccaggatcatcttatggtgaagaaggaacattaatattctcagactgtgcagttaaccctaaccctaacgaggatcaattagcagcaattgcaatagctactgcagaaacagctaagaatttatgtaacatggaacctaaggtggcaatgttatcattctctactatgggaagtgctgataatgaattagttgataaggttagaaatgctactcaaaaagcaaaagaaatgagacctgacttagatatagatggtgagctacaattagatgcagctatagttggaaaagtagcggctcaaaaggcaccagaaagtactgttgctggaaaagctaatgttttagtattcccagatttacaagctggaaatataggttataaattagttcaaagatttgcaaatgctgaagctattggacctatctgtcaaggttttgcaaaaccaatcaatgacttatcaagaggttgtagctcagatgatattgtaagtgttgttgcgcttacagcagttcaagctcaaacaaacaaatag

SEQ ID NO: 835 - DNA, 1002 bp, Clostridium sp. 7_2_43FAA
atggaacttatgaataaattatgggatgcagctaaagctgataaaagaagaatcgttcttccagaaggtgatgaggatagaactttagtagcagctcaaagaatacaagaacttggtttagcttatccagttttagttggagacaatagtagaattaatgaaaaagctaaagaattaggagtaaacttagaaggaatagaaatagttgatccgaataattcagagagattacaaacttatattaatgagttttatgaattaagaaaaaacaaaggtatgactttggaaaaagcagagaaaatagtaaaagatccattatattttggaactatgatggttaagttagatgatgctgatggaatggtatcaggtgccgtacatacaacaggagatttacttagaccagggttacaaataatcaaaactgctccaggtgtatcagttgtttcaagtttctttataatgatggtgccaggatcaacatatggagaagaaggtatgcttttattctctgattgcgcagttaatccaaatccaaattacgaacaattagcagcaatagcaatagctacagctgatacagctaaaaatctttgtaagatagaaccaagagtggcaatgctttcattctcaacaatgggaagtgcagatcatgaaatggttgataaagttagaaaagctacagaacttgcaaaggaattaagaccagatcttttaatagatggagaattacaattagatgcagctatagttggtaaagtagcagcacaaaaggctccaaatagtaatgttgctggtaaagctaatgtattaatattcccagacttacaaagtggaaatataggatataaattagttcaaagatttgctaatgcagaagctattggacctatgtgtcaaggttttgcaaaaccaataaatgatttatcaaggggatgtagctctgacgatatagttaatgttgttgcattaactgctgttcaagcacaagctcaaaaataa

SEQ ID NO: 836 - DNA, 1002 bp, Clostridium butyricum 5521
atggaacttatgaaaaaaatatgggaagctgcaaaatcaaataagaaaaaaatagttcttccagaaggtaatgaagaaagaactattgctgccgcccaaaaaatatatgatttaggattagctcatcctatacttgttggtgacaccaatgaaatccttgcaaaagcaaaagaattagatgtggatttatcacatgttgaaataataaacccaaatgaagcagaaaatttacaaaagtatataaatgcattttacgaattgagaaaagcaaaaggcgtaactatggaaaaagctgaaaaaatagttagagacccattatattttgctacaatgatggtaaaattagacgatgcagatggtatggtatcaggtgctgtccatacaacaggagatttattaagaccaggtcttcaaataataaaaactgctccaggagtatcgtgtgtatcgagcttcttcataatggaagtaccaaattcgccttatggagataatggattattgttctttgcagactgtgcggttaatccaatgccaaatgaagacatgttagcttcaattgcaattgcaactgctgataatgcaagactattatctaaaattgatccaaaagttgcaatgttatcgttctctacaatgggaagtgcagatcatgaagtagtagataaagtgagaaatgctacaataaaagcaaaagaattaagaccagatttagatatagatggtgaattacagttagatgctgcaatagtacctaaggttgcaaaacaaaaggctccagaaagtaaagttgcaggaaatgcaaatattttagtattccctgatttacaagcaggaaatataggatataagttagttcaaagatttgcaaacgcagaagctataggaccagtttgtcaaggatttgctaagccaattaatgatttatcaagaggatgtagttcagaagatatagttaatgttgtagcattaacagctgttcaagcacaagggattaaataa

SEQ ID NO: 837 - DNA, 1008 bp, Clostridium perfringens str. 13
atgaacatggaacttatgaaacaaatatgggaaagtgctaaaaataatagaaaaaaaatagtacttccagaaggtgatgaagagagaactcttgtcgcttcacaaagaataaaagaagaaggacttgctgacgtttacttagtaggttcagaacaagtaataagagaaaaagctgaagctttaggcgtaaacttagagggagtaaacatagttgatcctgaaacttcagataaattagacacttatataaacgaattttatgaattaagaaaagctaaaggaatgacagttgaaaaagctggaaaaatcgtaagagatcctttatacttcggaacaatgatggtaaaaatgggtgatgcagacggaatggtatcaggtgctgtacacacaactggtgaccttttaagaccaggtcttcaaataataaaaactgctccaggagtatctgtagtatcaagtttcttcataatgatggtaccaggttcacaatatggagaaggtggaatgttattattctcagactgtgctgttaatccaaatccaaatgcagaccaattagctgctatagctatagctactgctgatactgctaaaaatctttgcaaaatggatccaaaggttgcaatgctttcattctcaacaatgggaagtgctgaccatgatttagtaacaaaggtaagagtagcaacagaaaaagctaaagaattaagaccagatttagatatagatggtgaattacaattagatgctgctatagttggaaaagttgcttcacaaaaagctccaaatagtaaagtagcaggaaatgctaatgttttagtattcccagatttacaagctggaaatataggatacaaattagttcaaagatttgctaatgcagaagctattggaccagtttgtcaaggtttcgctaaaccaataaacgacctttcaagaggatgtagttcagaggatatagttaacgttgttgcaataactgctgttcaagcacaagcaactaaatag

SEQ ID NO: 838 - DNA, 1005 bp, Clostridium carboxidivorans P7
atgaaattaatggatgagatttggaaaaaggcaaaagctaataaaaaaacaattgttttgccagaaggtgaagaagaaagaacacttaaagcaagtgcaaaaatagcagaagaaggacttgcaaatttagttcttgtaggaaatgaaaaagtaataaaagaaaaagctgcaagtcttggagttagtttagaaggagtaaaggtagtagatcctgaaacttcagagaatactgcaaaatatgctaatggattttatgaattaagaaagaaaaagggaatgactccagaaaaagcagacaaaatagtaagagatcctctatattatggaacaatgatggtaaaattaggggatggagatggaatggtttcaggagctatccatactactggtgaccttttaagaccaggacttcaaataattaaaactgctcctggagtatcagtagtttcaagtacgtttattatgaatataccaaattgtgaatatggaaaagatggaatgcttctttttgctgattgtgcggttaatccatgtccaactgcagaagaattagcttcaattgctgtaagtacagcagaaactgcaaaaaatctttgtggaatggatccaaaagttgcaatgttatcattctcaactatgggaagtgctagccatgaattagttgacaaagtaacaaaggctactgaacttgcaaaatcaatgagaccagatttagatatagatggagaattacaacttgatgctgctatagttcaaaaagtagctgatttaaaagctccaaatagtaaaatagcaggaaaggcaaatgtattagtattcccagatattcaagctggaaatataggatataaactagttcaaagatttgctaaggcagaagctgtaggaccagtttgtcaaggatttgctaaaccaatcaatgatttatcaagaggatgtagtgctgaagatatagttaatgttgttgctataactgcagttcaagcacaagcacaagaaaactaa

SEQ ID NO: 839 - DNA, 1002 bp, Clostridium kluyveri DSM 555
atgaaattaatggaaaatatttttggtttagccaaagcagataagaaaaaaattgttttggcagaaggagaagaagaaaggaacattagagcttccgaagaaataataagggatggtattgcagatataattttagtaggaagtgaaagtgtaataaaagagaatgcagctaaatttggggttaacttagctggagtggaaatagtagatcctgaaacttcaagtaaaactgcaggctatgccaatgctttttatgaaattagaaagaataaaggagttacactggaaaaagcagataaaatagttagagatcctatatattttgcaacaatgatggtgaaacttggagatgcagatggtttagtttcaggtgcaatacatacaacgggagatcttttgagaccaggacttcaaatagtgaagacagttccaggtgcttctgtggtttccagtgtatttttaatgagtgtaccagattgtgaatatggagaagatggattcttgttatttgctgattgtgctgtaaatgtatgtcctactgctgaagaattatcttcaattgcaataactacagcagaaactgcaaaaaatttgtgtaaaatagaaccaagagttgccatgctttcattttctactatgggaagtgctagtcatgaattggtagataaagttacaaaagcaacaaaacttgctaaagaagctagacctgatttggatatagatggagaacttcaattggatgcttccctagtaaaaaaagttgcagacttaaaagctccgggcagtaaagtggcaggaaaagccaatgtacttatattccctgatatacaagcaggaaatataggatataagttagttcaaagatttgcaaaagctgaggctataggacctatatgtcagggatttgcaaagcctataaatgatttatcaagaggctgcagcgttgatgatatagtaaaggtagtggctgtaactgcagttcaagcacaggcacagggttag

SEQ ID NO: 840 - DNA, 999 bp, Clostridium sporogenes ATCC 15579
atggacttaatgaaaagcttatgggaaaaagctaaaagtgacaaaaagaaaattgtacttgcagagggagaagaagaaagaaatattgaaggttgttcaaaaatattaaaaaatgaattagctcacatgattttaataggaaatgaagaaaaaataaacgaaacagcaaaaaaattaaatgtttctatagatggtgcagaaataatagatccacagacttcagaaaaagtttctacatatacaaaagaattttatgaattaagaaaacataagggcgttactatggaaaaagcagaacaaatagttaaagatcctatatattttgctacaatgatggttaaaatgaaggatgcagatggattagtatctggtgctatacacactacaggagatttattaagaccaggactacaaatagttaaaacggctaaaggagcctctgttgtttcaagtacattcataatggaagtaccaaattgtgaatatggtaaaaatggtatgcttttatttgcagattgtgctgtaaatcctaatccaacagcagatgagttagcttcaattgctatatccacagcagaaactgctaaagctttatgtgatatggaacctaaagtagctatgttatctttctcatcaaagggaagtgcaaagcacgacttagtagataaagtagcagaagctacaaaaatagcaaaagaaaaaagaccagatcttgatatagatggggaattacaattagatgcggctatagtacaaaaagttgcagatttaaaagctccaaatagcaccgttgcaggaaaagctaatgttttagtattcccagacctacaagcaggaaatataggatataaattggttcaaagattcgcaaacgcaagtgctataggaccaatatgtcaaggttttgcaaaaccaattaatgacctatcaagaggttgtagcagtgatgatatagttaatgtagttgctgtaacagcagttcaagcacaaaatatgtaa

SEQ ID NO: 841 - DNA, 1020 bp, Clostridium tetani E88
gtgaagggagataatacgtacatgaaattaatggaagaaatttgggctaaagcaaaagctaataaaaagaaaattgttttacctgaaggtgaagaagaaagaaatattgaggcttgtagtaagataatagaaaacgcgatagcagatgtagttctagtaggaaatcctgaaaggattaaagaaatagcaaataaattaggagtaaatgtggatggggcagaaatagtggaccctgaaacttcagataagacagcagattatgctaaagcactttatgaacttagaaaacataagggagtaactattgaaaaagcagaaaaaataattagagatccattatactttggaacaatgatggttcagaaaaatgatgttgatggcatggtatctggtgcaatacacactacaggagaccttttaagaccaggacttcaaatagttaagacagcaccaggaacatcagtagtatctagttcttttataatgatggttccaggttctaaatttggaaatgaaggacttttactatttgcagattgtgcagtaaatccaaatccaacagcagaagatttagcatcaattgctatatcaacagcagaaacagctaaaaatttatgtggattagatcctaaagtagcattattatccttctcaactcaaggaagtgctagccacgatttagtagataaagttgtaactgcaactaaacttgcaaaagaaaaaagaccggatttagcaatagacggagaattacaattagatgcggctatagttaaaagtgttgcagatttaaaagcaccaaatagcgaagttgcagggaaagcaaatgttttagtgttccctgatttacaagcaggaaatataggatataaattagttcaaagatttgctaatgcagaggctataggacctataactcaaggttttgctaagccaataaacgatttatcaagaggttgtacttcagatgacatagtaaacgtagtagctgttactgcagtgcaagctcaaaaccaataa

SEQ ID NO: 842 - DNA, 996 bp, Clostridium botulinum D str. 1873
atgggatttatggatgaaatgaaggaattagcgaaaaaggatttaaaaactattgtcttaccagaaggggaagaagaaagaaatctcattgcagcaggaaagattaatgacaattcattagcaaatttagttttaataggaaatgaggaaaaaataaaagctaaagctaaagaattaaattcaaatattgaaggattaaaaatagttgatcctgaaacatacgaaaaaactgaagagtatgctaaggaattatatgaaataagaaagaataaaggaatgactttagaaaaagcatcagtgataataaaagatccactatacttttcaactgttatgcttaaattaggtcatgtagatggaatggtatcaggtgcaatacatacaacaggtgatttattaagaccaggacttcaaatagtaaaaacaaaaccaggaataagagcagtttctggagtagttatgcttgaagtaccaaattgtgaatatggaaaaaatggattagtattagtagcagatgctgcagttaatccaaatccaaatgcagaagaattagcatcaatagctattgcaactgctgaaacagctaaaaatttatgtggtatggatccaaaagttgctatgctttcattttctacaaagggaagtgctgaacatgaacttgtagataaagtaagaaaagctactgaaattgcaaaagagcaaagaccagaccttgatatagatggagaattacaattagatgcggctatagttgaaagtgttgcaaatttaaaggctccaggaagtaatgttgcaggaaaagcaaatgtgttagtgttaccagatttacaatgtggaaatattgcatataagttaattcaaagatttgcaaaagcagaagctacaggtccaatatgccaaggatttgcaaaacctataaatgacttatcaagaggatgtagtgctgatgatattgtaaatgttgttgttattacagcaatacaagctcaaaactag

SEQ ID NO: 843 - DNA, 999 bp, Clostridium novyi NT
atgggatttatggatgaaatgaaacaattagctaagaaggatttaaaaactatcgtattgccagagggagaagaagaaagaaaccttattgcggcaggaaaaataaatgatagtgcattagcaaatttagtattaataggtaatgaagaaaaaattagagctaaggctaaagaattaaattctaatattgaaggattaaaaatagttgatcctgaaacatatgaaaaaacagcagaatatgctaaagagttatatgaaataagaaagaaaaagggtatgactgaagaaaaagctgcagttattataaaagaccctctatattttgcaacagtaatgcttaaattaggacacgtagatggaatggtatcaggggctatacatacaacaggagacttattaagaccgggtcttcaaatagtaaagacaaagccaggaataaaagctgtatctggagttgttatgcttgaagttccaaactgcgaatatggaaaaaatggattagtattagttgcagatgctgctgttaatccaaatcctaatgcagaagaattagcatcaattgctattgcaactgctgaaacagctagagatttatgtggaatggatccaaaggttgctatgctttcattctctacaaagggaagtgctgaacatgaacttgtagataaagtaagaagagcaactgaaattgcacaagaacaaagaccagatcttgatatagatggtgaattacaattagatgctgctttagttcaaagtgttgcagatttaaaagcaccaggaagtaaagttgcaggaaaagcaaatgtattagtattacctgacttacaaagtggaaatatagcatataaattaatacaaagatttgcaaaagcagaagctacaggccctatatgtcaaggttttgcaaaacctatcaatgacttatcaagaggatgtagtgcagatgatattgtaaatgttgttacaattacagcaatacaagctcaaaataattaa

SEQ ID NO: 844 - DNA, 999 bp, Clostridium cellulovorans 743B
atggaatttatgcagaagatttggaaacaggctagaagttccaaaagaagaattgtacttgcggaaggtgaggaaagaagaaacttaattgctgcaggtaaaattattgaaaataacttagctgatataattttggttggagatacaaatgccataaaagaaaacgcagaagctcttggagttgatataagagaagctacaattgcggaccaacatacatacccacataaggaagaaatgataaaagaactttatgaaatcagaaaaagtaaaggtatgactttagagaaggcagctgaattagtactagatccattatactttggtactatgatggtgaaaatgggttatggtgatggaatggtttctggtgccattcatacaaccggtgacttattaagaccagggctacaaataattaaaacggctccaggagtatctgcagtttctggattttttgtaatggttattcctaactgtaattacggagaaaatggaactttaatatttgccgattgtgctgtaaatcctaagcctacttcagaacaattagcatctatagctataactacagcggaaacagcagagaaatttgatcttgatccaaaggttgcgatgttatctttctcaacaatgggtagtgctagccatgaaatggtagataacgttagaaatgcagtcgatatggcgaaatctttaagacctgatttagcaatagatggagaattgcaactagatgctgctatagttccggatgttgcggagctaaaggcaccaaatagtccagtggcaggaaaagctaatgttttaatattcccagatttacaaactggtaatattggttacaagttggttcaaagatttgcaagagcagaagctataggacctatatgtcaaggatttgcaaaaccaattaatgacctttctagaggttgtagtccagaagatatagtaaacgtcgtagcaatgacagcagttcaagcacaaaaaggaatttaa

SEQ ID NO: 845 - DNA, 1002 bp, Clostridium acetobutylicum ATCC 824
atggatttaatagaaagcatatgggagtgtgctaagcaagacaaaaaaaggataatattagctgaaggtgaagaaaaaagaaatctaattgccgcagataaaattatcaaagagggattagcagagcttgttcttgtaggtgatgaaaataaaattaaagaaaaagcaagtgagttgaatcttgacatttcgaaggctgaaataatggatccagagacatcactaaaaacagaaacatatgctagagatttttatgaacttagaaaacacaaaggaatgactattgaaaaatctgaaaaaatggtaagagatcctctttattttgcaacaatggctttaaaagatggctatgttgatggaatggtttcaggagctgttcacacaactggagatttattaagaccaggacttcaaattataaaaactgcaccaggagttaaaatagtatcaggattctttgttatgataatacctgactgcgattatggtgaagagggtcttttattatttgcagattgtgctgtaaatcctaacccaacatcagatgaactagctgatattgctataactacagctgaaacagctagaaaattatgtaacgtagagcctaaagttgcgatgctttcattctcaactatgggaagtgcaaaaggcgaaatggtagataaggttaaaaatgctgttgaaatcacaaagaaattcagaccggatcttgctattgatggtgagcttcagcttgatgctgcaatagatagtgaagtagcggctttaaaagcaccttctagtaatgttgcaggaaatgcaaatgttcttgtattcccagatcttcaaacaggaaacattgggtacaagcttgttcaaagatttgcaaaagcaaaagcaataggacctatatgtcaaggatttgcaaaacctattaatgatttatcaagaggctgtagctcagaggatatagtaaatgttgttgctataactgttgttcaggctcaaagaggtatataa

SEQ ID NO: 846 - DNA, 987 bp, Thermoanaerobacterium saccharolyticum
atgagcattattcaaaacatcattgaaaaagctaaaagcgataaaaagaaaattgttctgccagaaggtgcagaacccaggacattaaaagctgctgaaatagttttaaaagaagggattgcagatttagtgcttcttggaaatgaagatgagataagaaatgctgcaaaagacttggacatatccaaagctgaaatcattgaccctgtaaagtctgaaatgtttgataggtatgctaatgatttctatgagttaaggaagaacaaaggaatcacgttggaaaaagccagagaaacaatcaaggataatatctattttggatgtatgatggttaaagaaggttatgctgatggattggtatctggcgctattcatgctactgcagatttattaagacctgcatttcagataattaaaacggctccaggagcaaagatagtatcaagcttttttataatggaagtgcctaattgtgaatatggtgaaaatggtgtattcttgtttgctgattgtgcggtcaacccatcgcctaatgcagaagaacttgcttctattgccgtacaatctgctaatactgcaaagaatttgttgggctttgaaccaaaagttgccatgctatcattttctacaaaaggtagtgcatcacatgaattagtagataaagtaagaaaagcgacagagatagcaaaagaattgatgccagatgttgctatcgacggtgaattgcaattggatgctgctcttgttaaagaagttgcagagctaaaagcgccgggaagcaaagttgcgggatgtgcaaatgtgcttatattccctgatttacaagctggtaatataggatataagcttgtacagaggttagctaaggcaaatgcaattggacctataacacaaggaatgggtgcaccggttaatgatttatcaagaggatgcagctatagagatattgttgacgtaatagcaacaacagctgtgcaggctcaataa

SEQ ID NO: 847 - DNA, 987 bp, Thermoanaerobacterium thermosaccharolyticum DSM 571
atgagcattattcaaagtattattgagaaagcaaaaagcaacaaaaagaaaatagttttgcctgaaggtgcagagccaagaacgctgaaagcggccgatatagtgctgaaagaagggattgcagatttagtacttttaggaaatgcagatgagataagaaatgccgctgaaggattagatatctcaaaagccgagattatcgatcctctaaagtcagaaaaatttgataaatatgctactgacttttatgaactcagaaaaaataaggggattacgctagagaaagctaaagagactattaaagacaatatttattttggctgtatgatggtaaaagaaggttatgcagacggattggtatctggagctattcatgcaactgctgatttactaaggccagcatttcaaattgtaaaaacagctcctggtgcaaagattgtatcaagctttttcataatggaagttcctaattgtgaatttggtgaaaatggagtatttttgtttgctgattgtgctgttaatccatcaccaaatgcagaagaacttgcatctattgcagtacaatctgcaaacactgcaaaaactttattaggaatggaaccaagggttgctatgctttcattttcaacgaagggcagtgcatcacatgaattagtcgataaagtgagaacagctactgaaatcgctaaaaatttgataccagatgttgcaatagatggtgaattgcaattagatgctgcacttgttaaggaagtagccgagttaaaagcacctggaagtcctgttgcaggacgtgctaatgtacttatattccctgatttacaagcaggtaacattggttataagctcgtacaaagattggcaaaggcaaatgctataggtccgataacgcaaggaatgggagcgcctgtaaatgacttatctagaggatgcagttataaagacattgttgatgtaattgctacaacggctgtacaagctcaataa

SEQ ID NO: 848 - DNA, 996 bp, Thermoanaerobacter tengcongensis MB4
atgtctgtgatggacaatattatacaaaaggcaaaggcaaacaaaaagaaaatagttcttccagaaggtactgaaccaaggactttaaaagctgccgaaatagtgttaaaagaaggaattgcagatttagtattattgggaaaagaagaagagataagagaaaaggcaaaaggacttgatatttcaaaggcagaaattgtagatccggagaaatcacctaaccttgaaagatatgcaaaggaatactacgagctaaggaaaaataaagggatgacagaggaagaagcagaaaggcttatgagggacccaatgtattacgggtgcatgatggttaaattaggggatgtagatggaatggtttcaggagcaatacacgcaacagccgatgtcttcaggccagcttttcagatcataaaaactgctcctaatgtgaaggtggtttctagtgccttcataatggaagtgcctgagtgcaagtatggcagcgatggggtgttcatttttgctgactgcgccataaacccaaacccgactgccgaagaattggccgcaattgccattgcctcggctcataccgctaaagttctggcaggaattgaacctaaggtggccatgctttctttctctacaaagggcagcgctagccatgaattagtagataaggtgaaaagagcgacagagatcgcgaaagagttggcacctgatttgctaattgatggtgagttgcaagtggatgctgcaattgtaaaagaagtaggcgagttaaaagcgccgggcagtcctgttgctggacaggccaatgtgctgatattccctgacttgcaggcgggtaatataggttataagctggttcaaaggcttgcaaaggcgaatgcgattggacctatctctcaaggactggcaaagcctgttaatgatttgtcaaggggatgcagcgtagaagatattgtaaatgttatagcgataacgagtgtacaagctcaaggaatagtgtaa

SEQ ID NO: 849 - DNA, 999 bp, Thermoanaerobacter sp. X514
atggcagtaatggatagtatcatacaaaaggctaaagctaataaaaaaaggattgtgcttcctgagggaagtgaagctcgaactttaaaagctgctgaaaaggttattaaagaaggtattgctgatgtagttttattagggaaggaagaagaaataaaagaaaaagcaaagggattggatatctcgaaagcagaaattatagaccctgaaaagtcgcctcttttacaaaaatatgctgaagaatattataatttgagaaaaaacaaaggagttacagaagaacaggcatatcaaattatgaaagaccctatgtactatgggtgcatgatggtcaaattagacgatgttgatggtatggtatctggggcgattcacgctactgctgatgttttcagaccggcttttcaaattgtaaaaactgctgcaggtgtcaaagtagtatccagcgcctttataatggaagtacctaattgtacttatggaagcgatggagtatttatttttgctgattgtgcaataaatcctaatcctaatgaagaggaattagcagcaattgccattgcttctgcccatactgcaaaagtccttgctggaattgagcctagaattgctatgctgtcattttctactaaaggaagtgcaaaccatgaattagtagataaggtgaaaaatgcgactaaaatcgcaaaagaattggcgcctgatttgctaattgatggtgagcttcaattagatgctgcgattgtcaaagaagtaggagagttaaaggctccaggaagtcctgtagcggggaatgcaaatgtgcttattttcccagatttgcaagcgggaaacattggatataagctagttcaaagacttgctaaagctaatgctatcggaccaatttctcaaggtcttgcaaaacctatcaatgacttgtcaagaggttgtagtgtagaagatattgttaatgttatagcaataacttgtgtacaagctcaaggggtgcaaaaataa

SEQ ID NO: 850 - DNA, 999 bp, Halothermothrix orenii H 168
atgggtattctgaagagatttaaagaaaaggcaaaacaggatacaaagacaattgttttgcctgaaggaaaagaacccagaattttaaaggcagcggaaaaaattacggaagagggtttggcagaattaattgtattgggaaatgaagatgaggttaatgagattgtccaacaagaaggggttaatctcagaggggtcaatataattgattctgctaaatctaaattagttaatgagttcacagatgtgttttatgaattgcgtaaacataaaggtatttcccgtgaggatgctgcgaaaacagtcaaggatcctctatattttggtactcttctggtacatacgggacacgctgatggtatggtggctggttcaattaatgcaacaggagatgtattacgtccggcttttcagattataaagaccaagcctggtatttctattgtgtccggggcctttgtcatggaagttccagagtgtgagtacgggaatgacgggattttcctttttgcagattgtgccgtaaacccatctcctgattctaatcagcttgctgaaattgccctttcttctgcaagaactgccaggacccttctgggactggacccccgggttgctatgttatccttttcgacaaaaggaagtgcccgtcatgaactagttgataaagtaagaagggctacggaaatagccagagaaaaagctcctgaccttattctcgatggtgagttgcaggcagatgcagccctcgttccctcagtagccaaaacaaaggcgcctgaaagtaatgtggctggacaggcaaatgttcttgttttccctgatttacaggcaggaaatattggttacaaactggtacagcgcctggctggagcagaagctattggtccaattttacaggggattgccaaaccggtaaatgatctttcccgtggttgttctgttgaggatattgtgaatctggtagctattacatcggtccaggcccaggataattaa

SEQ ID NO: 851 - DNA, 1005 bp, Desulfotomaculum acetoxidans DSM 771
gtgaatctgttggatcaaattaaagccagagccaaagctaacccacagactattgtactgcccgaatcagaagatgaaagaacaattaaggcagcagaagccattatcaaagaaggtattgccaaagtaacattattaggtaatgttgatactgtaaaaacatcagccgccagcctgggcgtaagcttagatggcattggcattgtagacccggcaaccactgataaaatgaccgaatatgccgaaaaactggcagaaatccgtaaatcaaagggtatgacagctgatgaagccaaagccttactattaaatcccctttatttcggagccatgatggtcaagctgggtgaagctgacggtatggtggcaggcgctataaacactacaggagatgtattaagaccggctttacaaataattaaaacctccccaggcatctcaacagtatcaagctgctttgttatgattatgcctactgcagaatatggacaagaaggtgtaatgatttttgctgactgtgctgtcaatcccaaccctaatgcggaacaaatggctgaaattgcttatgcctcagctcaatcggccaagtctatcgctaacataactgaacccaaagtaggcatgctttccttctctacaaaaggcagtgcaaaacacgaactggtaagcaaagtccaggaagctaccaaaattgctaaagaaagatatgctgatctggtggtggacggtgaattccaggctgacgccgctattgtcgctaaagttggagcatccaaagcacctggcagtgaggttgcggggaaatgcaacgtgctggtattccctgatctgcaggcaggcaatattggctacaaattagtccagcgattagccggcgccgaagctatcggacctgttttacagggtattgccaagccggtaaacgatctgtcacgcggttgcagcgttgaagacattgttaacgtaacagctattacagtttgtcaggcacaggcaactaaataa

SEQ ID NO: 852 - DNA, 999 bp, Natranaerobius thermophilus JW/NM-WN-LF
atgagtgaattgttaacacaaatcaaaaataaggcttctcaacaaaagaaaatgattgctttacctgaggcaactgaacctcgaatggtaaaagcaactcaacaaattttacaggaaggttttgcagatatcaccttaataggtgatcaagatgaaattgaaaaagtggcaaataatgaaggagtagacttatctggagccgaaattttaaatcctaaagaaactgataagaatgatgattacgctgaaaagttatttgagttaagacaacataaaggaataaccatggaagatgcacagaaaattgtagaagatcctctctattttgctgcattgatggtcaaagctggcgatgcagatggatatgtaggaggggcagtaaataccactggtgatacttttaggccggctttacaaattatcaaaaccgcaccaggaatctctgtagtttcaagtagttttatcatgctagttcctgattgtgagtacggtgataatggagtatttgtattttctgattgtgctttgaatccaaatcctgataaaaaccagatggctgaaatagctataacaactgctgaaactgctaaaaatctagctggaattgatcctaaggttggtatgctatccttctctaccaagggaagtgcggatcatgaactagcacaaaaggtcgttgaagcaacaaaaattgctaaagataaagagccagatatgatgatagatggtgaactacaattggatgctgctattatgccttcagtaggtgagaaaaaagcgcctggcagtgaagttgctggaaatgctaacactctaatattccctgatctacaatcaggtaatattggatacaaattagttcaaaggcttgcaggtgctagagcggttggtccagtaactcagggatttgccatgcccgtaaatgacttatcaagaggttgtagtgttcaagatatagttgacattgcagcaataacttcagtgcaagctcaaggttaa

SEQ ID NO: 853 - DNA, 1005 bp, Carboxydothermus hydrogenoformans Z-2901
atgttaaattttattgaaaaagtgaaaagcaaagcccgagaatttaaaagaacaattgtacttccggaaagtaaagatgatcgtgttattaaagcttcgagtgaaattatcaatcaacaattagctaaaataattttattaggcaacgaaaaagaaattgccgaaagagcaaaaaatttaaatgtagatcttaatggagttactatcattgatccgttaaaagataataaccgggatagatatgctaatcttttgtatgaacttagaaaaaataagggaatgaccttggaaaaagcgtatgaactaataaatgatcccctttactatgcaacgcttatggttaaagctgaagatgccgatggtttagtggcaggatcattaagtccaacccccaatgttttacgtccggccttacagataataaaaaccaagccggagttttcagttgtttccggagcatttattatggtaattcctaatccgcaatttggcgagcatggaataatgctttttgccgattgcgctgttaaccccgatcctaattcccagcagttagcggaaattgctattgcatcagctatgactgcgcaaaagttgttaggaataactccttatgtgggattgttatctttttcaactaaaggaagtgccgaacatgagttggttgaaaaagtgcgggaggccgcacgaattgccaatcgtctccgacccgatttaaaaattgaaggagaacttcaggtagatgcggcaattgtccctgcggtaggtgcccagaaagctcctggaagtgaagtggccggacgagcaaatgttttgatattccccgatttgcagtcgggaaacataggatataaacttgctcagagaatgtctgggggagaagcgatcggaccaatattgcagggtatggccaagccggtaaatgatttgtcccggggctgtagtgtggatgaaattgtaaacttggtagctataactgcggttcaatcatattatggtatttaa

SEQ ID NO: 854 - DNA, 1014 bp, Bacteroides sp. 2_1_33B
atggatttaatgcaagacattattgcgcgcgctaaagctgacaagcagcgtattgttcttcccgaaggtaccgaggaaagaactcttaaagctgccgaccgattactggccgacggtgtagcagacattatcttaattggaaaccccgctgagatcaaggagttggcggctggtttcggactgaaccacatcggtgaggcaactcttgtcgatccgaaaaatcacgagaagaaagccgcgtatgcagacttgcttttccaactgcgccaaaagaagggtatgactcccgagaaggctgcggttctagttgaagatcctttgttcttggcttgtttgatgatcaaggcgggtgacgctgacggtgagatcgccggtgctgagaatacgacgggtaatgtattgcgtcctgctttgcaaattatcaagacggctccgggcatgaagtgtgtttccggtgcgttccttatgttcacgaagacacctcaatatggggatgatggtattttggtatttgccgattgtgcggttatgccgaatccgaatgcggaagagttggctagcatcgctgtcgctaccgccgctacggctcgtaatatcgtaggcgttgagcctcgtgtggctatgttgagcttctctacgaagggtagcgcttctcacgagatggtagacaaggtagtggaggctactcgtttggctaaggagatggctccggacttgaagatcgacggagagttgcaggccgacgccgctttggttgaggctgtaggtagcaagaaagctccgggtagcgagatcgccggtaaagcgaatgttttggtattcccgactttggaggtgggtaatatcgcttataagctggttcaacgtttgggtggcgctgaggctgtcggtcctatccttcaaggtatggccgctccggtgaacgacttgtctcgcggttgttccgtagacgatatttataagatggtagcgatcgcttgtaatcaatccatcggtttgaaatccgcaaaataa

SEQ ID NO: 855 - DNA, 1014 bp, Parabacteroides merdae ATCC 43184
atggacttaatgcaagagattattgcacgcgctaaagcaaacaaacagcgtatcgttcttcctgaaggaacagaagaaagaacattgaaagctgccgaccgtttagtggccgacgaagttgcagacattatcctgattggcaaccccgctgaaatcaacagcctggctgctcagtacgggttgaaccacatcggacaaactactattatcgatccgaagaatcacgaaaagaaagccgcttacgcagacctgcttttccagctgcgccagaaaaagggtatgactcctgaaaaggctgccgttttagtagaagatcctttgtttcttgcctgcctgatgattaaatccggcgatgccgacggtgaaatcgctggtgcacagaacacgaccggcaatgtgttgcgtcccgctttgcagattatcaagactgctccgggtatgagttgcgtttcaggtgcgttcttgatgtttacaaagactccccagtatggtaaagaaggcattttggtatttgccgactgtgccgtaatgccgaatccgacagcaccagaattggcaagtatcgctattgctacagctgctacagcccgcgatatcgtaggaatggaaccgcgtgtcgccatgctgagcttctctacgaaaggcagtgcctctcacgagatggtcgacaaggttgtcgaagctacccgtctggcaaaagaaatggctcccgacctgaaggttgacggagaattgcaggccgatgccgctttggttgaaaaggtcgcttcattgaaggctccgggcagcgatgttgccggacaggctaacgttttggtattcccgactctggaagtgggcaatatcgcttataagctggttcagcgtttaggaggtgcagaagctgtaggtcctatcctgcagggtatggctgctccggttaacgacctgtctcgcggttgctctgttgacgatatctataagatggttgcgattgcatgtaaccagtcgataggtttgaaagcaaataaataa

SEQ ID NO: 856 - DNA, 1011 bp, Porphyromonas gingivalis W83
atggatctcattcaagacgttatcagacgtgctcaagagaacaaacaacggatcgttctgcccgaagggctggaacctcgtacattggaagctgccgaccgtctcatggccgacaaagttgtaaacatcattctgatcggtaatgtcgatagtgtgaaagccaaagtggcggaactcggtttgaagaacttggccgaggctgtgatcattgatccgaataaccatcccaagaagcaacaatacactgaccttctgctgcaaattcgccaaaaaaaggggctgacacccgaaaaggcggccgaactcgtagaaaaccccctctatctgggttgtctcattgtaaagagtggagatgccgatggactgattgccggcgcacagaatactaccggcgatgtacttcgtccggctcttcaagtcatcaagacagctccgggcatgactagcgtgagcggtactttcttactcttcaccaaagccaaagaatatggcaaagacggacttttgcttgttgcagactgtgctgttatacccaatccgacagcagatgagttggcacagatcgctgtcgctacggctcgtacggcgaaagccattgccgatattgaaccgcgtgtagctatgttgagcttctctacgaaaggcagtgcaaaacatgaaatgacagataaggtcgtagaagctactcgtatggctcaagaaatggctcctgatttgttgatcgatggcgaaatgcaagccgatgcagctttggtagaaagagtggcagcactcaaagctccgggaagcaatgtagcaggaaaggccaatgtacttgtattcccgacgcttgaagtcggcaacatcgcatacaaacttgtagagcgtctgggccatgcagaagccgtaggacctattctgcaaggaatggctgcacctgtaaacgatttgagccgcggatgctcggtcgaagatatatacaggatggttgccatcacggccaaccaagctatcgcagccaaggagcaataa

SEQ ID NO: 857 - DNA, 1008 bp, Porphyromonas uenonis 60-3
atggaactacttcaaaagaacgtacagcgcgctaaggctaacaagcagcgcatcgtactccccgagggtctcgagcctcgcaccctccaagctgctgatcgcatcctcgctgacggcatcgctcacatcatcctcctaggcaaccccgctgagatccaggctaaggctgctgagctagggctcaagcacattgaccaggctgagatcatcgatccgcaaaatcacgcacgccgtgaggcttatcgtgacctcctgatggagctgcgtaagtctaagggcatgacccgtgagcaggctgacgagctagtggtcaatccgctctacctcgcctgcctgatgatcaagtctggcgacgctgacggtgaggtagctggtgcacacaacacaacgggcaacgtgctccgtcctgcactacagcttatcaagactcgcccagggctcaaggtggtcagtggcgcattcctcatcttctctccgctcaaggagtatggcgagaacggcttcttcatctttgccgactgcgccgtcacgcccaatcctgacagcaacgagcttgctcagatagctatcgcttctgccgatacggctcgtagcattggcgacatggagccacgcgttgccctcctaagctactctacaaagggctctgccaagagcgagatgatcgacaaggttacggaggcttacaagattgctaaggagatggctcctgatctactcatcgacggtgagctacaggctgacgctgctatcgtaagcaagatcgctgagctcaaggctcccgagagtcccgtggctggtaaggcaaacgtcctcgtcttcccgaacctagaggtgggcaatgtcgcttacaagctcgtcgagcgtctcggtcgtgctaccgctgtcggtcctatcctacagggtatggctgctccagtcaatgacctaagccgtggttgctctgtagacgatgtctacaatgtgatcacgatcacttgcaaccaggctatcgcagctaagaagtaa

SEQ ID NO: 858 - DNA, 1008 bp, Porphyromonas endodontalis ATCC 35406
atggatttgatgaaagaaatcgtagcgcgtgctgctgctaataagcaacgcattgtgctgcccgaggggacagaacctcgtactctacaagctgccgacaggcttttggctgatggtgttgcaaacctcgttctcattggcgaacctgccgctatcaaggctaaggctgctgagttggggcttacccatatcggtgaagcagaattgattgaccccaattgccacgccaaaaaagaggcttaccgtgatctccttatggagcttcgtaagtctaagggaatgacccaagaagaggccgataaactcgtggtaaatcctctctacttggcttgtcttatgattaaggcaggcgatgcagatggcgaacttgccggggcacaaaatacaacgggcaacgtgctaagacctgccctccagctcatcaaaacaatgcccggccttagctgtgtgagtggagcattcctcctctttacccaagcaaagcaatacggcagagaggggcttcttgttgtggcagactgtgccgttacccccaaccccaatgccaacgaactagggcaaatcgctgtggcttcggctactacggctcgcgctattggtggtatggagccccgcgtagctatgcttagctactctaccaaggggagtgccaagggcgaacttgaagataaggtggtagaggggttgcgcgtggccaaagaattggctcccgacctcgctattgatggagagttgcaggcagacgcggctcttgtggaggcagtggcatccctcaaagcccccgatagccctgtggctggtaaggcaaatgtgctcgtattcccctctcttgaggtgggtaacatcgcctacaagttggtagagcgcctcggtggtgctatggctgtagggcctatcctccaagggatggctgctcctgtaaacgacctcagccgtggctgctcggtagacgatatttacaagatggtggctatcaccgccaatcaagctattgctgctaaacaataa

SEQ ID NO: 859 - DNA, 1020 bp, Bacteroides uniformis ATCC 8492
atgcaaagattaattaacgaaattgttgagcgtgccaaagcaaaccgccaacgaattgttcttcccgagggtacggaagagcgtacactgaaagctgccaatcaaatcttgactgacggagtagccgacttgattatccttggaaaacctgccgagatagaggcttgtgccaaagagtgggggctgggaaatataaacaaggctaccattatcgacccggaagaccatcctaagaaagaagaatatgcccaactgctttgcgagctccgcaaaaagaaaggcatgaccatcgaagaggctcgcaagttggttgtcgatccgctttatctgggctgcctgattataaagaacggcgatgctgacggccagttggcaggtgcacgcaacactacgggtaatgtacttcgccctgctttgcagattatcaagacttccccgggcatcacttgcgtttcgggtgccatgctgctgctgacacatgctcctgaatatggaaagaacggtatcctggtgatgggtgacgtggctgtgactccggtgcccgatgcagaacaattggcacagattgccgtatgtacagcgcgtacagcccaggcagttgccggtctcgacccgaaagttgccatgctgagcttctctaccaagggctctgccaagcacgaagtggtggacaaggtggtcgaggcattgaagattgccaaggagatggctcccgatattgccatcgacggtgagttgcaggccgatgcagctttggtaccggaagtaggtgcaagcaaggctccgggttcttctatcgccggacatgctaacgtattggttgtccccagcctcgaagtgggcaacatctcctacaaactggtgcaacgtctgggacatgctgatgccgtaggacctatcctgcaaggtatcgcccgtccggtgaacgacctttcacgcggttgctccatcgaggatgtgtaccgcatgattgccatcactgccaaccaggccattgctgccaaaaagaatgctgaataa

SEQ ID NO: 860 - DNA, 1017 bp, Bacteroides eggerthii DSM 20697
atgcaaagattaattaatgaaattttagagcgtgcgaaagccgatcgccaacgcattgttcttcctgaaggtacggaagaacgcacattgaaagctgccaatcaaattttgacagacggtattgcagacctcattcttttgggcaatcctgctgaaatcaacgcttgcgcaacagagtggggacttggtaatatttccaaggctactattattgatccggagaacaatccgaagcaggaagaatatgcacagctgctgttcgaactgcgtaagaaaaaaggcatgactattgaagaagcccgcaaattggttaccaatccgctttacttgggttgtttgattatcaagaacggcgatgcggacggtcagttggcaggcgcccgcaatactaccggtgatgtgcttcgtccggctttgcagataatcaagacagctccgggcattacttgtgtctctggtgcgatgttgctgttgacacatgctcctgagtatggaaagaacggtgttctggtgatgggagatgttgctgtaactccggttcctgatgcttctcagctggcacagatcgctgtttgtacagcacgtacggctaaggctgttgcaggacttgatcccaaggtggcattgttgagtttttctacgaagggctctgcaaaacacgaagtggtggacaaagtggtggaagccttgaaaattgctaaagaactggctcctgacattgctattgacggtgaattgcaggctgatgcagcgctggttcctgaggtaggcgccagcaaagctccgggttctgccattgcaggcaatgcaaatgtgttggttgttccgagtcttgaggtaggtaatatctcttacaagttggtacagcgtttgggacatgccgatgcggttggtccgatcttgcaaggtattgctcgcccggtaaacgatttgtcacgcggttgctccatcgaagatgtttatcgtatgattgcaattactgcaaaccaagctattgcagctaaacataataaataa

SEQ ID NO: 861 - DNA, 1017 bp, Bacteroides cellulosilyticus DSM 14838
atgcagagattaattaatgaaatcgttgagcgtgcgaaagccgaccgccaacgtattgttcttcctgaaggaacggaagaacgcaccttgaaagctgccaatcaaattttgacagacggagttgctgacctgattcttctgggtaatccggatgaaattaatgcttgtgcaacagaatggggacttggaaacatcagcaaggctacaatcatcgatccggagaatcatccgaagaaagaggagtatgcgcaattgctttgtgaacttcgcaagaaaaaaggcatgactatcgaagaagctcgtaagttggtagttaatccgctctatctgggctgtctgattattaagaatggcgatgctgacggtcagttggcaggtgcacgcaacaccacaggcgatgtacttcgtccggcattgcaaatcattaagacaactccgggcattacttgtgtatccggtgcaatgttgttgttgacgcatgctcctgaatatggaaagaatggtattttggtaatgggggatgtagctgtgactccggtgcccgatgcagaacagttggctcagattgctgtttgtacagctcgcacggctaagtctgtagtaggcatggaaccgaaagtggcaatgctcagcttctcaaccaaaggctctgctaagcacgaagttgtggataaagtgattgaggctgtaaagattgcacatgagatggatcccgacttggctctcgacggtgaattgcaggctgatgctgcattggttccggaagtaggtgccagcaaagctccgggttctgcaattgcaggaaatgcgaatgtattggcggttccgagccttgaagtaggtaatatttcttataaattggtacagcgtttaggtcatgcagatgcggtaggtcctattttgcagggtattgcccgtccggtgaacgacctgtcacgcggttgctccatcgaagatgtttatcgcatgattgcaattactgccaaccaggctattgcagcaaagaatcaaaaataa

SEQ ID NO: 862 - DNA, 1020 bp, Bacteroides fragilis YCH46
atgcttaatttaattaactctatcgttgcgcgtgcgcaagcaaatcgtcagcgcattgtccttcccgaaggtacggaagaacgtactttaaaagctgctaaccagattttgacagatgaagttgcagatttgattcttttgggtaacccggaagaaattaatgcagctgctgccaaatggggactcggaaatattaatagggctactattatagatcctgagaaccatccgaagaaagaagaatatgcgcagttattgtgcgagcttcgtaagaaaaaaggtatgactatcgaagaagcccgtaagttggtgctcgatccgttgtacttgggttgtctgatcattaaaagtggcgatgctgacggtcagttggcaggtgcccgcaacactacgggtgatgtacttcgtccggcacttcagattattaagacttctccgggaattacatgcgtttcgggtgctatgttgttgttgacacatgctccggaatgtggtcagaatggtttgctggtgatgggtgacgtagccgtaactccggttccggatgcttcgcagttggcacagatcgctgtttgtactgcacgtacggcacaggctgtagcaggaattgctgaaccgaaagtggcaatgcttagtttctctactaaaggttcggcaaaacatgagaacgtggataaggtggtagaggcattgaaattagctaaagaaatggcaccggatttgaatatcgacggtgaaatgcaggcagacgctgcattggtgccttcggtaggtgcaagcaaagctccggggtctccggttgccggcgaggctaatgtactgattgttcctagtttggaagttggtaacatttcttataaactggttcagcgcttggggcatgccgacgcggtaggaccgattcttcaaggtattgcacgtccggtgaacgacctttcacgcggatgctctattgaagacgtatacagaatgattgcaatcacagctaatcaggcgattgctgcaaagaatggtaaataa

SEQ ID NO: 863 - DNA, 1020 bp, Bacteroides sp. D1
atgctcaatttaatcaaccaaatcgtggcgcgtgcgaaagcaaatcgccaacgtattgttcttccggaaggaactgaagaacgcacattgaaagctgccaatatgattttgacagacgaagtagccgatctaattttactgggtaaaccggcagaaattaatgaacttgctgcaaaatggggattgggaaacatcggtaaagctactatcattgatcctgaaacttctccgaaacacgaagaatatgcgcagttgttgtgtgaacttcgtaaaaagaaggggatgactatcgaagaagcccgcaagttaacgaatgatcctttattctttggttgtttaatgattaagagcggtgatgctgacggtcagttggctggtgcccgtaacactactggtaatgtattgcgtcctgctttgcagattatcaagactgcgccgggaatcacttgcgtgtctggtgctatgttgcttttgactcatgctcctgaatacggaaagaatggcattttggtcatgggtgacgtggccgtaaccccggttcctgatgctaatcaattggcgcagattgcagtttgtacagcgcagactgccaaggcggttgccggtatcgaaaatccgaaagtagctatgttgagtttctctaccaaaggctctgctaaacatgaagtggtagacaaagtagtagaagcaactaaaatagctaaggaaatggctccgactcttgatttggacggtgaactgcaggcagatgcggctcttgttcctgaagtaggtgcaagcaaagctccgggttcggaggtagccggacaagcaaatgtactgattgttccgagcctggaagtaggtaacatttcttataagctagttcaacgtttgggacatgctgatgctatcggcccgatccttcagggtatcgcttgcccggtaaacgacttgtctcgtggttgttctattgaagatgtatatcgtatgattgctatcacggctaaccaggctattgctgcaaaggcaaataaataa

SEQ ID NO: 864 - DNA, 1020 bp, Bacteroides coprophilus DSM 18228
atggatttaatttctcaaatcgttgagcgcgctaagtcaaacaaacagcgcattgtccttccggaaggaacggaggaacgtactttgaaagctgccaaccaggtgttgacagacggtgtggcagaccttatccttttgggtaacccttcagaaatcatggatctggcccgcgaatggggacttggaaacatttcccgcgcaaccatcatcgatccggagaaccaccccaagcaagaggaatatgctcagttgctttgccagctccgccagaaaaaaggcatgacaattgaagaagcacgtaaactggtacgcaaccctctttatctgggttgtttgatcatcaaggctggtgatgctgacggacagttggcaggtgcccgcaatactaccggagatgtgttgcgtcctgcactgcaaatcatcaagactgaaccgggaatcacctgcgtttccggagccatgctgatgcttactcacgctcctgaatgcggagacaacggtgtaatcgtcatgggtgacgtagccgtaactcctgtacctgatgccggacaattggcacagatcgctgtatgtacagcccgcacagcaaaagctgttgccggtatcgatccccgtgtcgctatgcttagcttctcaaccaagggatctgccaagcatgaagtcgtagacaaagtggtagaagcactgaaactggctcgtgaacttgatcctgaaatgaagatcgacggcgaaatgcaggctgatgctgcactcgttccgcgcgtaggtcaaagtaaggctcccggatcagaaattgccggacgcgccaacgtattggtcgttccttgtctggaagttggtaacatctcttacaaactcgttgaacgtctgggacacgcaactgccatcggtccgatcctgcagggtatcgcacgtcctgtaaacgacctgtccagaggatgcagcgtagacgatgtttacaagatgatcgccatcacagctaaccaggctattgcagctaaggaacaagaaaacaaataa

SEQ ID NO: 865 - DNA, 1011 bp, Bacteroides plebeius DSM 17135
atggatttaatcagtgaaatcgttgaacgcgctaaagcaaacaaacagcgcatcgtgcttccggaaggaacagaagaacgtactttgaaagctgccaatcagatattgacagacggtgtagcagaccttattttgttgggtaaccccgatgaaatcatgaacctggccaaagaatggggattgggtaatatccacaaagctaccatcattgacccagaaaacaatcctaaacaagaagaatatgcacagctgctgtgcgaacttcgtaagaaaaaaggaatgaccatcgaagaagctcgcaaacttgtgctgaatcctttgtacttgggctgtctgattatcaaggctggcgacgcagacggacaattggcaggtgcacgcaatacaaccggtgatgtacttcgtcctgcattgcagattatcaagactgctccgggcatcacttgcgtttcaggtgctatgctgatgctgacacacgctcctgaatgcggagacaacggtgtattggtaatgggcgacgtagctgtaactcctgtacctgatgccaaccagctggcacaaatcgctatctgtactgctcagactgcaaaagcagtggcaggcatcgacccgcgtgtagctatgctgagcttctctaccaaaggttctgcaaaacacgaagtagtagacaaagtggtagaagcattgaaaattgcaaaagaattagacccgacattgaagattgacggtgaactgcaggcagatgctgcactggttccaagagtaggtgcaagcaaagctccgggttctgaaatcgccggaaaagccaacgtattggttgtaccttgcctggaagtaggaaacatctcttacaagctggttgaacgtctgggccacgctactgccgtaggacctatcctgcagggtatcgctcgtccggtaaacgacttgtcacgcggatgtagcatcgacgacgtatacaagatgattgccatcactgccaatcaggctatcgctgccaaggcacagtaa

SEQ ID NO: 866 - DNA, 1014 bp, Bacteroides vulgatus ATCC 8482
atggatttaatttctcaaatcgttgagcgcgcgaaagcaaacaaacagcgcattgttcttccggaaggaactgaagaacgtactttaaaagctgccaaccaaatattgacagacggtgttgccgaccttattttattgggaaaccccgatgaaatcatgagcctggctaaacaatgggggttagggaacatcggtaaagccactattatcgatcccacagaccacccgaaaaaagaagagtatgcacaattgctgtgcgaactccgcaagaaaaaaggtatgaccatcgaagaggcccgcaaactggttgtcgatccgctgtatctaggatgtctcattatcaaggctggtgatgccgacggacagttggccggcgcacgcaacacaacaggtaacgtacttcgtcccgctttacagattatcaagactactccgggtatcacttgcgtatccggtgccatgctgttgctgactcatgctcccgaatacggaaataacggtgtaatcgtaatgggtgacgttgctgtaaccccggtaccggatgccaaccaactggctcaaattgcagtttgtaccgctcagaccgccaaagctgttgccggaattgatcctcgcgtagctatgttaagtttttcaaccaagggttctgccaaacatgaagtggtagataaagtggtggaagctttggcaatcgctaaggaaatggctcccgatttgaagattgacggtgaactgcaagctgatgcagctttggttccgcacatcggtgcaagcaaagccccgggatcagaaattgcaggtaaggcaaacgtattggttgttccttgtctggaagtaggtaatatttcttataaattagtagaacgtctgggacacgctaccgctatcggcccgatcctgcaaggtatcgctcgtccggtgaatgacctgtcacgcggttgctctatcgacgatgtttataagatgattgccattactgccaatcaagcaattgccgctaaagaaaacaaataa

SEQ ID NO: 867 - DNA, 1017 bp, Prevotella tannerae ATCC 51259
atgagtatcacacaaaatctgattgaacgggcgcgtgctaataagcaacgcatcgtacttccggaagctttagaagagcgcacactgaccgctgccgataaagtcttggccgatggctttgccgaaatcattctgattggcaaccctgacgcgattcacacgctggcagccaaactgaacctacagcatatcgacaaggcggagatcgtagatccggaaaacaatcctaaaatggaggaatacgctcaactattgtttgaactgagaaagaaaaagggaatgtctatcgaaatggcgcgcgacttggtgaaggatccgctctatttaggatgcttgattatcaagagcgatgacgccgatgggcagatctcaggcgcactcagtacgacgggcgaaacgctgcgaccggctttgcagattattaaatgtgcgccgggcgtttctgtcgtgagcggtgcaatgctcttgttgactcaagctgaagaatacggacaggacggcattattgtaatgggcgacgtagctgttacgccgatgccggatgccgagcagttagcacaaatcgcttattgtacggctcaaacggctaaaagcgtagccggaattgatgaaccacgtgtggcgatgctcagtttctctacgaaaggcagtgcaaagcacgaagtcgtggataaagttgttgaggctacacgcatcgcaaaagaaatgtatcccaaccttcaagtggatggcgaactgcaagctgatgcagcactcgtgccctctgtaggtgagaagaaagcgccgggcagcaatattgccggcaaagcgaatgttttgatcgcgcccaacttggaagtgggaaatattggctacaaactcgtgcaacgtttaggtaaggctgaagcacttggccccatcttgcagggtatcgcgcgtccggtcaatgatctttcgcgtggatgtagtgtagaagatatttataaaatggtagccataacagcgaatcaagctattgctgccaaagaagaaaaataa

SEQ ID NO: 868 - DNA, 1050 bp, Prevotella bergensis DSM 17361
atgaatttattagaaagcattgtagcgcgtgctaaggctgacaagcagcgcatcgttctgcccgaagcagaggaggaacgcacattgagagcagccgacaaggtgctggccgatgaaatggccaatttgatactcatcggcaatcccgataacatcaggaaaaaggctgaggagtggggattgaagcatatagacaaggctaccttggtcgacccgtcgaactgcgacaagaccgaggaatatgcaaccttgctggctgaactgcgcaagaagaagggcatgacggttgatcaggctcgcgaattggtgactaagaacaatctctatttgggttgtatgatcatcaagactggcgatgccgacggtcagatctccggagcattgagcaccacgggcgacacactccgtccggctctccagattattaagtgcgcacccggcgttacctgcgtgagcggtgcaatgctgttgctgaccaacgagcagcagtatggcgaaaatggtattgtggtgatgggcgatgtggccgtgacacctaatccaaccgccgaccagttggctcagattgcctataccacggctcagacggcccgtagcgttgcaggaattgaacaaccacaggttgccatgctgagcttctctaccaaggggtcggctaaggatgccattgacaagcagacgggcaagagcgtctatattatcgacaaggtgttggaggcaacgaagatagccaaggagaggtatcctgatctgaaattggatggggaacttcaggccgacgcagcgctcgaccctaaaacggcttcaacgaaagcaccgggtagtgaggtggccggtaaggccaacgtgctcgtagtgcctaaccttgaggtaggaaatattggttataaattggtgcagcgcttgggtggtgcaacggctatcggcccaatcctccagggtattgctcgtccggtgaacgacctcagtcgtggctgctcggtagatgacatctattatatggtggccattacggcttgtcaggcgcaggaagcgaagggcaattcataa

SEQ ID NO: 869 - DNA, 1047 bp, Prevotella veroralis F0319
atggatttattagagcaaatcgttgcacgcgctaaagccgataagcaacgtatcgtgctccccgaggcagaagaggagcgaacccttagagcggctgatagggtattagccgatgacattgccaatctaatcctcattggtaaccccaccaacatacataaactcgccacagagtggggacttaagaacattgataaggcaaccattgttgacccagagaataaccctaagtgcgaagaatatgctgctaagttagccgaactacgccagaaaaagggtatgaccatcgatcaggcacgtgagttggtgacgaagaataatctctatttgggctgtatgattattaagacagagggtgctgatggacagatctcaggtgcactctctacaactggtgacacgcttcgccctgctttgcagattattaaatgtgcaccaggtatcacttgcgtgagtggagctatgctcatcctcactcacgaacagcagtatggtgagaatggtattgtcgttatgggtgatgtagcagttactcctaacccaactgccgatcagttggctcaaatagcttataccactgctgagaccgcaaagagcgttgctggattccaagacccacatgttgctatgttgagtttctctactaagggatcggcaaaagacgccatcgaccgtgagacgggtaagagtgtttacattatagataaggttgttgaggcaacaaagattgccaaggagaagttcccaacactgaaggttgatggtgaattacaggctgatgctgctcttgttcctgctgttgctgctaagaaggcaccaggttcggagatagcaggtaaggctaatgtgcttgttgttcccaaccttgaagtaggtaacatcggctacaagttaatcgaacgtcttggtggtgctaaggcgataggacctatcctccaaggtattgctcgccctgttaacgacctgtctcgtggctgttgtgtagatgatatctactatatggtagctatcacagcatgccaagcccaagatgcgaaaaagctataa

SEQ ID NO: 870 - DNA, 1038 bp, Prevotella sp. oral taxon 472 str. F0295
atggacctattacaccaaatcatagaacgcgccaaaagtgacaaacagcgcatcgttttgcccgaagcaagcgaagatcgtacgcttcgtgccgccgatagagcattggccgacgagatcgccgacatcattctcattggcaacccctctgaaattcataagctggcagaggctcgcggactggtaaacattgacaaggcaaccatcatcgaccccgaagacaatcccgatagcgaagagttggcacaactgctagccgaacttcgcaagaagaaaggtatgactttgatgcaggctcgcgaactggtgaagaacaacctataccttggttgtatgctcattaaaaccgatcgggccgacggacaaatatctggcgcactcagcacaacgggcgacacgcttcgacctgcattgcaaattatcaaatgcgaaccaggtgtcacttgcataagtggtgctatgctgctcgtaaccgaccaaaaagagtatggcgaagacggtgtggtggtgatgggcgatgtagccgttacacccatgcccgatgccaatcagctggcccaaatagctgtttgtaccgctgctacggcacgctgtgtggctggatttaaagatccgcgcgtggctatgttaagcttctctaccaagggaagtgccagtcacgaggtggtagacaaggtggttgaggccacccgattggccaaaaccatgaaccccgacttgcgtatcgatggcgaattgcaggccgatgctgcactggttccatctgttggacagaaaaaagcacctggaagtgccatcgccggtaatgccaatgtgctggtggtgcccaacctcgaagtgggaaacattggctacaagctggtgcaacgcctgggaaacgtccaagccattggcccaattttgcagggcatagcacgtcccgtgaacgacttgagccgtggttgctcggtagacgacatctattatatggtggccatcactgcttgtcaggcacaagatgctaaggctaaggcctgcaccctttccgctgacaagtaa

SEQ ID NO: 871 - DNA, 1002 bp, Candidatus Azobacteroides pseudotrichonymphae genomovar. CFP2
atgaatttaatgcatcaaattataactaaagctagaaataggaggcagaggattgttctttcagaaggtacggaagagcgtacattgagagctgcggatagagccattgctgataagatagctgatatcattttgcttggaaatatagcagaaattaaagctcttactattaaatatggattgagaaatgtgcttcaagcagtaattgtagatcctattaagaacgagagaaagaacgcttatgctgttttattgatggaattaagaaaaaatagaggaatgactattgtagaagctcaaaaattagtagaaaatcctttatacttaggttgtttgatgattaaaaacggagatgctgatggagaaattgctggtgcacaaaatactaccagtgacgttttgcgtccagctttacaaattattaagaccactccaggtattaatgttgtttcgggtgcttttttgatgctttcacagaatgaagaatatggagctaatggtgtattgatttttgctgactgtgccgtagtccctaatcccaatgcaaaagaattggcagaaatagcagtttctactgcaataactgcaaaaactcttataggtatagaaccaattgttgctttattgagtttttctacgaagggaagtgcttcacatgaattagtggataaaataaatgaagctgtttgcattgctaaatcgatttctcccgagttgataatagacggagaattacaagcggatgcagcattagtacccttcattggacaaagcaaagctccaggaagcttagtggcaggaaaagctaatgtattggtatttcctaatttggaatgtggaaatattgcttataaattagtgcaacgattaggaaatattcaagctataggtcctattctgcaaggaatagctgctcctgttaatgatctctcgcgtggttgctcggtagaggatatatatactatgatagctatttgtgctaaccaagctattatgaaatga

SEQ ID NO: 872 - DNA, 993 bp, Syntrophomonas wolfei subsp. wolfei str. Goettingen
atggatcttatagcacaaattaaagaaaaagcagcaaaaaatgtcaaggccattgttcttcctgagggaactgaggaaagaacaattcaagctatcaagggaattgttgatagcaaggtggctcgtcccattcttctgggcgatgagggagctatcaagggcatagccagtaaaattggagcggatatctccggcgctgaaattatcaacccggaaaaggctccattttttgatgattttgtacaggctttctatgaaatgcgcaagtcaaaaggtgttgacctggacaaagccaaagccaccatgctcgatcccctcttttttgcatcgatgatggttaaaatggataaggctgatggtgaggtagccggagccgagaacactaccggcaatgttttacggcctgctctccagatcattaaaacttctcccggtatctctgccgtatcaggcgcttttattatgatcgtgcccaactgctcctatggtgacaacggagtatttgtattcgctgactgtgcggttaccattgacccgaccgcagcacagctggctgaatttgccaaggcttcagtagggacggctgttgacctttgcggaatgaaagatccgaaaatcggcatgctttctttctctaccaagggcagtgccagccatgaaatggtagataaaatggttcaggcaacggctattgccaaagagaaattccctgaactgaaggttgatggagaattccaattggatgcagctatagttcccagtgttgggtcctccaaagctccgggcagcccggtagcaggtgactgcaatgtgcttatcttcccggatatccaggcaggaaatattggctacaaactggtgcagaggacagccaaagctgaggctattggtccgattctacagggaatagccaagccggttaacgacctttcccgcggctgcagtgttgaggatatcgtcaatgtggtagcgatgacggcagttagatcataa

SEQ ID NO: 873 - DNA, 981 bp, Collinsella aerofaciens ATCC 25986
atgagcgatttcctaaaccgtatgaagtctgccgccaaggccgaccttaagacgatcgtcctgcccgagggcgaggatccgcgcactatcgtcgcggccaccaaaatcatcgaggagggcctggcaaagatcgtcatcctgggcaaccccgacgagatcaacgttcccggcgctaccgtcatcgacccgcgcaatgccgagaagcacgaggagtacgcgcagaagtttgccgagctccgcgccaagaagggcgttaccatcgagcaggctcgcgcccaggtgatggacgccacctactttggcaccatgatggtcaagatgggcgatgccgacggcctggtctccggcgcctgccactccaccgccgacaccctgcgccccgcgcttcagatcctcaagaccgccccgggcaccaagctggtctcggccttcttcgtgatgtgcaccgacaccccgcagttcggcactgacggcacgctgatcttcgccgactgcggcctcaacatcaacccgtcctccgacgagctctccgagatcgccatcgcctccgctcactcctggtccaccttcatgggcaacgttgagccgcacgtggccatgctctcctactccaccatgggctccgctggcggcgaggtcgccaagaaggtccaggaggccgtgaagttctgcaaggagaaggctcccgagctcgccatcgacggcgacctgcagctcgacgccgctatcgtccccaccgtcgcccagctcaaggctcccggctcctccgtcgccggtaaggccaacgtgctcgtgttccccgacctcgaggcaggcaacatcggctacaagctggtccagcgcttcgccggcgccgacgcttacggccccatcctgcagggcatcgccaagccggtcaacgacctgtcgcgcggctgctctgccgacgacatcgtgggtgtcgtagccatcaccgccgtccaggctcagatggctgagtag

SEQ ID NO: 874 - DNA, 981 bp, Collinsella stercoris DSM 13279
atgagcgatttcctgacccgcatgaaggccgccgccaaggccgacaagaagaccgtcgtcctccccgagggcgaggaccagcgcaccatcgacgccgccaagatcatcgtcgaggaggacctcgccaacctggtcatcctgggcgaccccgacaagatcgacctgccgggcgtcaccgtgatcgaccccaagtgcggccccaagcacgaggagtacgcgcagaagttcgccgagctgcgcgccaagaagggcgtgaccatcgagcaggcccgcgcccagatgaacgacgccacctactacggcaccatgatggtcaagatgggcgacgccgacggcctcgtgtccggcgcgtgccactccaccgccgacaccctgcgccccgcgctgcagatcctgaagaccgccccgggcaccaagctcgtctcggcgttcttcatcatgtgcacgagcaccccgcagttcggcaccgacggcacgctgatcttcgccgactgcggcctgaacatcaaccccacctccgacgagctgtccgagatcgccatcgcgagcgccaagagctggcagaccttcatgggcggcgccgagccgcacgtggccatgctctcctactccaccatgggctccgccggcggcgaggtcgccaagaaggtccaggaggccgtcgccttctgcaaggagaaggcgcccgaggtgcccattgacggcgacctgcagctcgacgccgccatcgtgcccaccgtggcccagctcaaggccccgggctccccggtcgccggcaaggccaacgtgctcgtgttccccgacctcgaggccggcaacatcggctacaagctggtgcagcgcttcgcgggcgccgaggcgtacggccccatcctgcagggcatcgccaaaccggtgaacgacctgtcccgcggctgctccgccgaggacatcgtgggcgtcgtggccatcacggcggtccaggcccagatggccgagtag

SEQ ID NO: 875 - DNA, 999 bp, Collinsella intestinalis DSM 13280
atgacgaggagcgtttgcatgagtgatttcctgggccgcatgaaggccgccgccaaggccgacaagaagaccatcgtcctgcccgagggcgaggacccgcgcaccatcgaagcggccaagaagatcgtcgaggaggaccttgccaacctcgtgatcctgggcaaccccgacgagatcgacgtccccggcgccaccgtcatcgacccccgcaacgccgagaagcacgaagagtacgcaagcaagttcgccgagctccgcgctaagaagggcgtgaccatcgagcaggcccgcgcccaggtcatggacgccacctacttcggcaccatgatggtcaagatgggcgacgccgacggcctggtctccggcgcctgccactccaccgccgacaccctgcgcccggccctgcagatcctgaagacggcccccggcaccaagctggtctccgccttcatgatcatgtgcactcagaccgagcagttcggtgccgacggcacgctcgtgttcgccgactgcggcctgaacatcgcccccacctccgacgagctctccgagatcgccatcgcgtcggccaactccttcaagaccttcatgggcgatgtcgagcccaaggtcgccatgctctcctactccaccatgggctccgccggcggcgacaccgccaagaaggtccaggaggccaccgcattcgccagggagaaggcccccgagctcgccatcgatggcgacctgcagctcgacgccgccatcgtgccgtccgtcgcagagctcaaggcccccgagtccaaggtcgccggccacgccaacgtcctggtcttccccaacctcgagaccggcaacatcggctacaagctggtacagcgcttcggcggcgccgaggcctacggcccgatcctgcagggcattgccaagccggtgaacgacctgtcccgcggctgctccgccgacgacatcgtgggcgtcgtggccatcacggccgtccaggcgcagatggccgagtag

SEQ ID NO: 876 - DNA, 1146 bp, Atopobium rimae ATCC 49626
gtgcataatagccatgtaaacctccatgaagcgccttcgtttggcgagaagcgccttccggtgacagtatttctcgtccctaattttatcacgcactcctataatgaggttcgtatggcacaaattatctttttgataggagttcttttcatgggaaagtttcttgaacagatgaaagcagccgctcaagctgataaaaaaaccatcgtgcttcccgaaggtgaagatccccgcaccattgcggccgcaaaggtcatcatcgcagaaaaccttgcaaatcttgtaatcctcggaaatccggatgagattgacgttgccggcgcgaccgttatatgctctgccaccgatgagcgccatgaggcttatgcgcagaaatttgccgagttgcgcgcacgcaaaggcgtcaccattgagcaggctcgcgaaaccatgaacaacaacacctactttgccaccatgatggtcaagatgggcgatgccgacggccttgtttcaggcgcctgccactccaccgcagacacgctccgacctgcgctccagatcatcaagaccgctccgggaaccaagcttgtttccgcgttcttcattatgagcacggacaagcctgagtttggcgaagacggtacgctcctctttgccgactgcggcctcaacattaaccccaacgccgatgagctttccgaaattgctctggcatccgcacagtcatggcgcgctttcatggatcaagagccgcgcgtggccatgctttcttactccaccatgggctctgccggaggagagactgccgagaaggtccaggaggcaacaaaacttgccaacgagaaagctcctgatctggcacttgacggcgatctccagcttgacgccgcaatcgttcctgaagtggcaaagctcaaagccccctattccaaggttgccggacacgccaacatcctcgtcttcccgacgcttgaagcgggcaatatcggctacaagctcgtacagcgcttcagcggtgccgaggcttacggtcctcttcttcagggcatcgcacgtccggtcaatgatctttctcgtggctgctcggctgacgatatcgtaggtgtggttgccattaccgccgttcaggctcaaatggccgttgcaagcgagaagagcaaatag

SEQ ID NO: 877 - DNA, 981 bp, Atopobium parvulum DSM 20469
atgagcaagtttcttgaccgtatgaaagaaaccgctaagtctgacgtaaagaccattgttcttccagaaggcgaggatcagcgtaccatcgatgctgctaagaagattgttgcagagggtattgcaaaggtcattattcttggcaatcctgagcagattaatgttccgggcgcaactgtagtagaccctgccactgatgagcgccatgaggcatatgctcagaagtttgctgaactacgtgctcgcaagggcgtcaccattgaggaagctcgcaagcagatgaacgatgctacctactttgcaaccatgatggtcaagatgggtgacgctgatggtctggtttctggtgcttgccactcaactgcaaacactttgaggcctgcgctgcaaatcatcaagactgctcctggtactaaactggtttctgcattctttatcatgagcacctctactggctttggtgaggatggcaccttgctctttgctgactgtggcctcaacattgatccatccgcagaggaactctccgagattgctcttgcttccgctgattcttggcgcgcgttcatgagcgacgagcctcgcgttgctatgctctcctactccaccatgggctctgctggtggcgcaactgccgagaaggtccaggaggccacaaagcttgctcacgagaaaaacgctgagcttgcacttgacggcgaccttcagcttgacgcagctcttgttcctgaggttggtaagctcaaggctccattctccaaagttgctggaaacgctaacatccttgtcttccccaaccttgaggctggcaacattggctacaagcttgttcagcgtttcagtggtgctgatgcatacggaccaatccttcagggtattgctcgtcctgtcaacgatctctcccgtggttgctctgctgacgatattgttggtgttgttgcaattactgctgttcaggctcaaatggcagacaataactag

SEQ ID NO: 878 - DNA, 975 bp, Atopobium vaginae DSM 15829
atgagttcgtttttacaaactattaagcaaagagcacaggctcataaaaaaacaatcgtattgcccgaaggagaagatccgcgtactcaagaggccgcacagaagattgttgccgaaaatcttgcagatcttattgttttgggaaatcccgacgaaattaagctcgacggtgtcagcgttattgatccgcatagcgcaccaaagcacgaagcatacgcgcaagcattttatgaactcagaaaaaataaaggtatgaccatagaaaacgctcgtaaacagatggacgatccaacctactttgccactatgatggttaagtgtaacgacgcggatggcctcgtatcaggtgcttgtcattccaccgcaaataccctgcgtccagctttgcaaattttaaaaaccgctcctggaaccaaacttgtatctgcattctttatgatgtgtacttcttgtcccgaatttggcgaaaatggtgttgttttgtttgcagactcgggtctcaatattgatcctgatgccgatcaactttctgaaattgccctttcatctgcaaaatcatggaaaagctttatgaacgacgacgcaaaagtagcaatgctatgctactcaaccaagggctcggctggcggagactgcgctgcaaaagttattgaagcaacaaaactggctcaagaaaaagagccagatcttctagtagacggtgaaatgcagcttgacgcagcccttgttccaagtgttgcacaatccaaggcacccaactcaaaagttgctggtcaggcaaatattttaattttcccagatttagcatcgggtaatattggatacaaactggtacagcgttttgcaaaagctgaagcatatggcccgcttctccaaggaattgctgctcctgttaacgatttatctcgcggctgcagcgccgacgatatcgtgggcgtagttgcaataactgctgtacaagcgcaaatgatgtaa

SEQ ID NO: 879 - DNA, 1053 bp, Oribacterium sinus F0268
atggcaaggaagagttttatcatgtcagaaaaaggagagaatatgtcatttattgaggatgtaaaagcaaaagcaaaggcaaagcagaagaccatcgtattaccggaatctgaagacaagagagttcttcaggcggcagaacagattcagaaagagggattttcccgtttgattcttcttggagagaaggagcaggtggagaaggatgccaaagcctggggagtagacctttccggtattgaaattgtgaacccgaagacttatgccaagttagacgaatatgtttctactctggtagaacttagaaagtcaaaggggatgacggaagaagaggcaagaaagctgctgacagaaagcaacacctattttggtgttatgatggttaagaagggagaggctgacggtttggtttccggagcgaaccactctaccgcggataccctccgtccatctcttcagatcttaaagacaaagccgggcacaaagcttgtttccgctttctttgttatggttgttcctgattgtgaatacggagagaagggaacctttgtcttctctgattgcggtttaaatcaaaacccgacttctgaagagctggcagcaattgcagagtcttccgcagagtccttccgtttcctggtaggggctgagcctaaggtggctatgctgtcttactccaccatgggatctgcaaagcatgaagaggttaccaaggtacaggatgctaccaagattgtgaaagagaataatccgaatcttttagtggatggagaattacagttggatgccgctttggttgaatccgtagccaagttaaaagctcccggctccaaggtggcaggtcatgccaatactttgattttcccggatttagatgcaggaaacatcggctataagcttgtgcagagattggcaaaggctgaagcttatggacctatgactcagggaattgcaagaccggttaatgacttatcccgtggatgtaatgttgccgatattgtaggtgttgttgcgattactgcagtgcagtgtcaactttacgataataactaa

SEQ ID NO: 880 - DNA, 1062 bp, Abiotrophia defectiva ATCC 49176
atgcatttttccataatatttataatatttataattttatatagtttgaaaggagcaaaagtcatgtcatttattgatcaaatcaaagcaaaagcaaaaacttcaaagaaggtcatagttcttcctgaaagtgaagatatgagaacactggaggctgctgacaaagtacttaaggaggagattgctgagcttgttcttcttgggaaagaggagaagattttagaagacgctaaaaagggcggatttgatgtgaccggtgccaaaataatcgatccggaaaaaagtgataagttagattcttatgtagcagccctggttgaacttaggaaaagcaaggggatgacagaggaagaagcaagaaagattcttactgaaagtaatacctattttggtgtaatgatgattaaaatgaaggatgcagacggacttgtttcaggtgcctgccattctacggccgatactttaagacctagtcttcagattcttaagactaagccggggactaaactggtttcatctttctttatagttgaagtaccaaattgtgacatgggagaaaacggaacctttgttttctctgactgcggtcttaaccagaaccctaatgcggaggaacttgcagctatagcgaagtcttctgcggagtcatttaggaatctggttcaggctgaaccaagggtggctatgctatcatactcaactatgggttcggctaaacatgatgatgttaccaaggtgcaggaagctacaaagcttgcaaaggcagaaaatccgggactggcacttgacggcgaacttcagcttgatgccgcgctagttgcttctgtcggtgaatttaaagctccgggaagtaaggttgcgggacatgccaatacacttattttcccaaatctcgatgctggcaatattggttacaaattggttcagcgtcttgcaaaggctgaggcttacggtcctcttacacagggaattgcaggtcctgtaaatgatctttcgagaggctgctcagcaagtgatatagtaggagtagttgccataactgctgtacaggcacagatgtag

SEQ ID NO: 881 - DNA, 1005 bp, Oribacterium sp. oral taxon 078 str. F0262
atggcttttattgatgatgtgaaggaaaaggcgaggggcagcttgaagacgattgtcctcccggagtccgaggaccggaggactctggatgcggcggacaggatccttagggagggtttcgcaaagctcattcttctcggaaatgaggagaagatccgtgcggacgcggcggctctgggagacaagctcgagggggcgcggatcgtggaccccaaaaagagcgaaaagctggagagctatgtcgaaacgctgacggagcttcggaagaagaaggggatgagtgaggaggaggcgaggaagcttctcacagaatcgaatacctacttcggcatgatgatggtgaagatgggagatgcggacggcctggtctccggggcctgccattccacggccgacacactccgtcccgcgcttcagattctgaagacaaagcccgggacaaagctggtgtccgccttctttgtcatgaatgttccggactgtccctacggggagaacggcagctttgtcttttccgactgcgggctcaaccagaatccgacatcggaggagctcgcggcgatcgcggaggcctccgcggattccttccgcttcctgatcggaaaggagccgaaggtcgcgatgctctcctactcgaccaagggctccgcgaagcacgatgatgtcacgaaggttcaggaagcggttcggatcgcaaaggaggagaggccggagctcgccctggacggggagctgcagctggatgccgcgctggtccccgctgtcgccgccctgaaggctccgtcctccgaggtcgcagggcacgcaaacaccctcatcttcccgaatcttgacgccggaaatatcggctataagctcgtccagaggctcggaaaggcggaggcctacggccccatgacgcaggggatcgcaagaccggtgaacgatctctcccgcggctgcagcgcggatgacatcgtcggcgtcgtcgcaatcacctcggtacagtgtcagctctttgattaa

SEQ ID NO: 882 - DNA, 1002 bp, Clostridium sp. M62/1
atggcatttattgatttaatgaaagcaaaggcaaaacaggataaacagacgattgttttacctgagagcaaagataaaagaactctgattgccgctgcaaaggtgcttgaggagggtactgcagacctcatcatggttggtaaggaagagaagatcatggacggtgccggatggctggaagttgatttaaccggattaaaggtagttgatcctgatacagatccaaagtttgaccactatgcagagactctttttgagctgagaaagcacaaaggaatgacaaaagagaaggctgaggagatcttaagaacagactacatcacatacggtgttatgatggttaaggaaaaggatgcagacggtctggttgcaggtgcatgccatgcgacagcagacaccttaagacctgcccttcagatcttaaagacagctcctggcacagagcttgtatccggcttctttatcatggatgttccgaactgcgagtatggagcaaacggaaccttcttatttgctgactgcggactgaatcaggatccgaactctgaggagctggcagccatcgctgactccagtgcaaagagcttccgcgctctggttggcgagaagccggttattgccatgctgtcccactccacaaagggaagcgcaaagcatgccctcgttgacaaggtagtgaaggcagttgagatcgctcatgagaagtacccgcagcttgatctggatggagagcttcagttagatgcagctctggtaccggaggttgcaaaatccaaggcaaagggaagcaccgttgcaggccatgcaaatgttcttattttcccgaatctggactgtggaaacatcggctacaagctggttcagagacttgccaaggcagaggcttacggcccgatgcttcagggtatctcaagaccggttaacgacttatcccgcggctgctctgcagaagatatcgtcggcgtagtagctcttactgctgtacaggctcagatgtcataa

SEQ ID NO: 883 - DNA, 1032 bp, Ruminococcus sp. 5_1_39BFAA
atgaaaggagccattttaatcatgggatttattgacacactcaaagaaagagcaaaagcaaacgtaaaaacaatcgtacttccggagacagaagataagagaactctggcagctacagagaaaattttaaaagaaggaattgcaaaggttatccttgttggtaacgaagaagctgttaaaaagagtgcagctgaagacggatatgacatttccggcgcacagatcgtagatcctgctacatcagagaaaacacagggatatattgacaagttagtagaattaagacagaaaaaaggcatgacaccggatcaggctaaagagattcttcttaaccagtatctgtactatggtgtaatgatggtaaaaatgggcgatgcagacggtatggtatccggtgcatgtcactctacagctgatacattaagaccatgtcttcagatcctgaaaacaaaaccaggtacaaaacttgtatccgcattcttcttaatggtagttccgaactgcgaatatggcgcaaacggcgcatttgtatttgctgattccggtctgaaccagaacccgacttcagaagagcttgcagcaatcgcagcatcttctgcagaatccttcgaacttcttgttcaggagaaaccaatcgttgcaatgctttcacactccactaaaggcagtgcaaaacatgctgacgtagataaagtagtagaagctacaaagatcgcaaaagagcagaatccggaacttgcacttgacggagaatttcagcttgatgcagctatcgttccaagcgtaggcgcttctaaagctcctggaagcgaagtagctggtaaagctaacgtacttgtattcccagaccttgatgcaggtaacatcggatacaaacttgtacagcgtcttgcaaaagcagaagcttacggacctgtaacccagggtatcgctaaacctgtaaatgacttgtcccgtggatgctctgcagacgatatcgttggtgtggtagctatcacagcagtacagtgccaggctgacgacaacaaataa

SEQ ID NO: 884 - DNA, 1170 bp, Ruminococcus obeum ATCC 29174
atgatgaaattgcacttcaaaaaataccactctttggaagaatctgacggacaactacttgaaaagcgccagaactgggggtataatgaacctagctgtgaggtcatattttggacgctcacacggtctgatgaccgaaataacgaaaggagccatttaatcatgggatttgttgatttactcaaagaaagagcaaaaaaaagcatcaaaactatcgtactgccagagacagaggatatgagaactatcgaggcaacagataagattctgaaagagggagttgctaagattatcctcatcggtaacgaagaagaaatcaataagaaagctgcagaaggcggattcgatatctccggagcaaccatcgttgatcctgagacatctgacagaactcaggcatacattgataaatttgtagaactgagagctaaaaaaggtatgacacctgaaaaagcaaaagaaatccttcatactcagtacccatactatggtgtaatgatggtaaaaatgggtgatgcagacggtatggtatccggtgcatgccattctacagcagacacacttcgtccatgtctgcagatcctgaaaaccaaaccgggaacaaaacttgtatccgcatttttcctgatcgtagttccggattgcgaatatggtgcaaacggtgcatttgtatttgctgactctggtctgaaccagaatccgactccggaagaactttctgcaatcgcagcatcttcagcagaatccttccagcttcttgttcaggaagaaccagtcgttgcaatgctttcacactctacaaagggaagtgcaaaacatccggacgtagataagatggtagaagctacaagaatcgcaaaagaagaacatccggaactcaaactggatggagagttccagcttgacgcagcaatcgtacctagcgttggtgcttctaaagctccgggaagtgaagttgcaggtaaagcaaacgttcttgtattccctgaccttgatgcaggaaacatcggatataaacttgctcagcgtcttggaaaagcagaagcttacggacctgttacacagggtatcgcaaaaccagtcaatgacctctccagaggatgctctgcagatgatatcgttggtgttgttgctatcacagctgtacagtgccaggctgaagacaaataa

SEQ ID NO: 885 - DNA, 999 bp, Bryantella formatexigens DSM 14469
atgggatttattgacgtaatcaaagaaagagcaagaagcaataaaaaaacgattgtgcttccggagacagaagaccgcagaacttttgaggctgcggagaaaattctgaaggagggcatagcggacatcatcctggtaggcagcgaggaagctgtcaaaaagggcggcgaagggctggaccttaccggcgcggtggttatcgacccggctacttccgataaaacacagggttacatagacaagctggtagagctgcgctccaaaaagggcatgacgccggagcaggcgaaggaaatccttctgaaccagtatctctactatggcgttatgatggtaaaaatgggcgatgcggacggtatggtttccggcgcatgccattccacagcagataccttaagaccgtgtctgcagattctgaaaacgaaaccgggcacaaagctggtatccgctttcttccttatcgtagttccggactgcgaatacggcgcaaacggcgcatttgtattcggcgacagcggacttgtgcaggacccgaatccggaagagctggcagcgattgccgcatcctccgcggattccttccgcctgctggtacaggaggagccggtggtggctatgctttcccactccacaatgggaagcgcaaagcatgcgctggttgacaaggtagttgaggcgacaaagattgccaaagagcagaatccgggtctgaagctggacggcgagctgcagcttgacgcggcgatcgttccgagcgtaggttcctccaaggctccgaacagcgacgttgccggaaaagcgaacgttctgatcttcccgaacctggatgccggaaacatcggctacaagctggcgcagagactggcaaaggcagaagcttacggacctatcacacagggtattgcaaaaccggtgaacgatctgtcccgcggctgctctgcagacgatattgtcggcgttgtagctatcacggcggtacagtgccaggctgaggactaa

SEQ ID NO: 886 - DNA, 1035 bp, Blautia hydrogenotrophica DSM 10507
atgagaaaagtgaataaatacgaaaggggccaattaatcatgggatttattgacgtaattaaagaaaaagcaagagctgacaagaagacaattgttcttccagagagcgaggacagaagagtcttagaagctaccgctacaattttgaaagaaggattggcgaatgtggttttgataggtaacgaagaacagatcaaaaaagatgcagctgatctggatatcgcaggagctatcattgtagaccctgcaaccagtgataaaacccaggcttatattgataaactggtagaattgagacagaaaaagggtatgactcaggagcaggcgagagaaatcatgctgaatcagagaacgtattatggtgttatgatggtaaagatgggagatgcagacggaatggtatccggtgcgtgccattctaccgcagacactttgagaccaagcttgcagattctgaagacaaaaccaggaacaaaattggtatctgcgtttttcctgatggaagtaccgaactgtgagtacggtgagaatggaactttcgtatttggtgactgtggactgaatcagaatcctacttctgaagagctggcagcgatcgcagtgtcttctgcggagagcttcaagatgctggtgggtaaagagccaaaggtggctatgctgtcacattcttccatgggcagtgcgaaacatgcggatgttgataaggttgttgaggcagtgaagatcgcgaaagagactgctccggagttgatgctggacggcgaattgcagcttgacgcggcaattgttccttctgtgggagcctctaaggcaccgaacagccaggttgcgggacaagcgaacgtattgatcttcccagatctggatgcaggaaatattggatacaagcttgtacagagactggcaaaagcagaagcttacggtccgatgactcagggaatcgcagctccggtcaacgatctgtccagaggatgctctgcaagtgatatcgtaggtgttacggcaatcacagctgtgcagtgtcagaaccagtaa

SEQ ID NO: 887 - DNA, 996 bp, Clostridium nexile DSM 1787
atgggatttattgatgtaattaaagaaaaagcgaaagcagacaaaaaaacaattgtacttccggagacagaagacaagagaacttacgaagcagcagaggcagtgctcaaagaaggtacagctaatcttgttctcgtgggaagcaaagaagagattgagaaaaacggagcgggatttgatatcagcggagcaacgattgttgatccggcaacatatgaaaaaacagaagcatatattgcaaaattggtagaattgagacagaaaaaaggaatgacagaagagcaggcaagagaattgctgcttacaaactatctgtactatggggttatgatggtgaaaatgggagatgctgacggtatggtatccggagcgtgtcattcaacagcagatacattgagaccatgcttacagatcttaaaaacaaagcctggaacaaaattagtatccgcatttttcgtaatggtagtaccggattgtgatatgggagcaaacggaacatttatctttggtgattcagggttagagcagaatccggatccggaaaaattagctgcaattgcgctttcttcagcggaatcattcaaattgttggttggggaagagccaaaagttgctatgctttctcattctacaaagggaagtgcaaaacatgcagacgttgacaaagtggtagaggctacacgtcttgcaaaagagatggcaccggaacttcagttggacggagaacttcagctagatgctgcaatcgttccggaaatcggagaatcaaaagctcctggaagcaaggttgcaggacatgctaacgtactgatcttccctgacttggatgcaggaaatatcggatacaaattagtacagagacttggaaaggcggaagcgtacggacctttgacacagggaattgcaaaaccggttaacgatttgtcacgtggatgcagtgctgctgatatcgaaggtgtagtagcaatcacagctgttcaggcgcaggctcaataa

SEQ ID NO: 888 - DNA, 996 bp, Ruminococcus gnavus ATCC 29149
atggcgtttattgatgaaattaaagcaagagcaaaagctgacaaaaagacaatcgttcttcctgagacagaagacgtaagaacttaccaggctgcagaggcagttttaagagaggggactgccgacctgatccttgtaggaagcaaggaagagatcgaaaagaacggagccggatttgatctcacaggagctgtgatcgtagatcctgctacaagcgacaagacagagggctatattgcaaaactggtagaactcagacagaaaaaaggaatgacagaagagcaggcaagagagattcttctgacaaactatctgtactacggtgttatgatggtgaagatgggagatgctgacggtatggtatccggagcatgtcattctacagcagatacacttcgtccgtgtctgcagatcctgaagacaaaaccgggaacaaaattagtatccgcattctttgtaatggtagtgccggattgcgatatgggtgcagacggtacatttatttttggagattccggactggagcagaatccggatcctgaaaagcttgcaaatatcgcactttcttccgcagaatctttcagaactctgacaggaaaagagccggttgtggcaatgctttcacattctacaaaaggaagtgcaaaacatgccgatgttgataaagttgtagaggctacaagacttgcaaaagagatggcaccggaactgaaactggacggagaactgcagcttgacgcagcgatcgttccggcagtaggagagtccaaagcacctggaagcccggttgcaggacatgcaaatgttctgatcttccctgatctggatgcaggaaatatcggatacaagcttgtacagagacttgcaaaagcagaagcatatggtcctctgacacagggaattgcagcaccagtcaacgatctgtcccgtggatgcagcgcagaggatatcgaaggtgtagtagcgattacagcagtacaggctcaggcacagtaa

SEQ ID NO: 889 - DNA, 996 bp, Ruminococcus lactaris ATCC 29176
atgggatttattgatgaaatcaaggcaagagcgaaagcttgcaaaaagacaatcgttctccctgagacagaggacgaaagaacttataaggcagcagaggcagtattaaaagaaggaattgctgatctggtgcttgttggaagcaaagaggagattgagaaaaataaaggtacatatgatatctccggtgctgcgatcgtagatcctgctacagatgcaagaacagaaggttatattgcaaaactggttgaactgagacagaagaaaggtatgacaccggagcaggcaaaagagctgcttctgaataattacctttattatggggtaatgatggtgaagatgggggatgctgacggtatggtatcaggagcatgccattctacagcagatacacttcgtccgtgccttcagatcctgaagacgaaaccgggtacaaagctggtatccgcattcttcctgatggtagttccggattgcgatatgggtgcagacggaacatttgtatttgcagatgcaggtctggagcagaatccagatccggaaaagcttgcaaatattgcaatttcttcagcagattctttcacgcttcttgtaggaaaagagccggttgttgctatgctttctcattctacaaaaggaagtgcaaagcatgcagatgttgataaggtagtagaagctacaaaaattgctcagggacttgcaccggagcttgcacttgacggagaacttcagcttgatgcagcgatcgttccggaagtcggagcatccaaagcaccgggaagcaaagttgcaggacatgcaaatgtacttgtattccctgacctcgatgcaggtaatatcggatataagctggttcagagacttggaaaagcagaagcttacggtcctctgactcagggaattgcagcaccggtcaatgacctttcccgtggatgcagtgcggaagatattgtaggtgttgttgcaatcacagcagtacaggcacaggctgaataa

SEQ ID NO: 890 - DNA, 996 bp, Ruminococcus torques ATCC 27756
atgggatttatcgatgaaatcaaggcaagagcaaaagctgataaaaaggtgattgttcttcctgagacagaggacgaaagaacttataaggctgcgcagacggtcttaagagaagggattgcagatttgattctcgtaggaaacgaagaagaaatcgagaaaaataaaggcgcatatgatattacaggcgctgtgatcgttgatccggctaaaaatgataaaacagaagagtatattgcaaagcttgttgaattaagacagaaaaaaggaatgacagaagagcaggcaagagagctcctcctgaataattatctgtactacggcgttatgatggtgaaaatgggagacgccgacggtatggtgtccggagcatgtcattctacggcggatacacttcgtccgtgtcttcagatcttgaagacaaagccgggaacaaaacttgtatctgcattctttttaatggttgttcctgactgtgatatgggagcggacggaacgttcatcttcggagatgccggacttgagcaaaaccctgatccggaaaaactggcaaacattgcactttcttccgcagaatctttcgagacgctgacaggaaaagaaccgattgtagcgatgctttctcattctacaaaaggaagtgcaaaacatgcagatgtcgataaagttgtagaagcaacaaagatcgcgcacgaacttgcgccggaattaaaattagacggagagcttcagcttgacgccgctatcgttccggaagtcggagcatcgaaagctccgggcagtgaagtggcaggtaaagcgaacgtgttgatcttccctgatcttgatgccggcaatatcggatataaacttgtacaaagacttggaaaggcagaggcatacggaccgcttacacagggaatcgcagctcctgtcaacgatctgtcacgcggatgcagcgcagaagatattgtgggtgttgttgcaattacggcggtgcaggcacaggcagagtaa

SEQ ID NO: 891 - DNA, 1023 bp, Clostridium scindens ATCC 35704
atggaaaggagtctatcaatcatgggatttatagatgaaatcaaagcaaaagcaaaaacgaacaaaaagacaatcgtacttccagagacagaagacatcaggacttatgaagctgctgaagcagtactgaaagaggggaccgccaacctgattctggtcggaagcgaagaagagatcgctaagaacaaaggttctttcgatattaccggagcaacgattgtagaccctgcaacatatgaaaaaacggatgcatacatcgcaaaactggtagaactcagacaaaagaagggaatgacagaggagcaggcaagagaactgctgcttaccaactacctgtattacggagtcatgatggttaagatgaaggatgcagacggcatggtatccggagcatgccactcgacagcagataccttaaggccatgcctgcagatcctgaagacgaagccgggaaccaaactggtatctgcattcttcgtaatggtagtaccggactgtgatatgggcgcagatggaacatttgtatttgcggatgcaggcctggagcagaatccagatcctgagaaactggcagccattgccctttcttccgcagaatctttcgggcttctgacagagaaagagccgatagtcgctctgctttcacattctacaaagggaagtgcaaagcatgcggatgttgacaaagtcgtagaggcaacccgcatcgccaaggagaatgctccggagggactgcttcttgacggagaattccagctggatgcagccatcgttccatccgtaggagcgtccaaggctccgggaagcccggtagcaggcaaggccaacgtacttgtgttcccagatctggatgccggaaatatcggatacaagctggtacagagacttgcaaaggcagaagcttacggacctctgacacagggaatcgcagcgcctgtcaatgacctgtcccgcggatgcagcgcaaaggatatcgaaggcgtagttgcgatcacggctgttcaggcaatggcagaagagtaa

SEQ ID NO: 892 - DNA, 1023 bp, Clostridium hylemonae DSM 15053
atggaaaggagtctattgatcatgggatttatagatgaaatcaaggcgaaagccaagacaagcagaaagacgatcgtgcttccggagacagaggatatcagaacttatgaggcggcagaggcagtgataaaagaaggcacagccaacgtggtacttgtagggagcaaagaggagatcgagaagaacagaggctctttcgatgtcagcggagcgactgtcgtggatccggccacgagtgaaaagacggacggctatatcgccaaactcgttgaactgagacagaagaaaggaatgacggaagagcaggcaagagagctgctccttacgaactatctgtactatggggtcatgatggtcaagatgaaggatgcagacggcatggtatcaggagcatgccactctacggccgacactttgaggccatgccttcagatactgaagacgaaaccgggaacaaagctcgtgtcagcgtttttcgtcatggtagtgccggactgcgatatgggtgcggacggaacatttgtatttgcagacgcaggacttgagcagaatccggatccggagaagcttgcggctatcgcgctttcctccgcagattctttccggcttctgacaggagaggagccggtggtggcgctcctttcacactctacaaagggaagtgcaaagcacgcggacgtggacaaggtagtggaagctgcgcgtatcgcaaaagaagctgcgcctgagggacttatgatcgacggtgaattccagcttgacgcagctatcgttccggagatcggcgcgtccaaagcgccgggcagcccggtggcagggaaagcaaacgtactcgtatttcctgacctggatgccggaaatatcggctacaagctggtgcagaggcttgcaaaggcagaggcatacggaccgctgacacaggggatcgcggctccggtcaatgacctgtcacgcggatgcagcgccaaagatatcgaaggcgtagtggcgatcactgcagttcagtgtatggctgaaaactag

SEQ ID NO: 893 - DNA, 1005 bp, Dorea formicigenerans ATCC 27755
atgggatttattgatgatattaaagcgagagcaaaaacaagtaaaaagacaattgtacttccggagacagaggatatcagaacatatgaagcagcagaagcagttctgaaagaaggaacagcaaacctgatccttgtcggcagcgaagaagagattgcaaagaacaaaggttctttcgatatcagcggagccacaatcgtagatcctgcaaagagcgagaagacagacgcctacatcgcaaaacttgtagaattacgtgagaaaaagggaatgacagaggaaaaagcaagagaacttcttctgactaattatctctactatggtgttatgatggttaagatgaaagatgctgacggaatggtatccggagcatgccactcaacggcagatacattaagaccaagccttcagatcctgaagacaaaacctggaacaaagctcgtaagcgcattctttattatggtagtaccagattgtgagatgggtgccaatggaacattcctgtttggtgattccggacttgagcagaatccggatccggagaaacttgcagcaatcgcactttcatccgcaggctcctttagacttctgacagaaaaagagccagttgtagcacttctttcacattcaacaaagggaagcgcaaaacacgctgacgtagataaagttgtagaggctacaaagattgcaaaagagaatgctccggaaggacttctcattgatggagaattccagcttgatgcagcaattgttccgtcagtaggagcatctaaagcaccgggaagcccggttgcaggaaaagcgaatgtactgatcttcccagaccttgatgctggaaacatcggatacaaattagttcagagacttgcaaaagcagaagcttacggtcctcttacacagggaatcgcagcgcctgtcaatgatctctcccgcggttgcagcgctaaggatattgagggtgtaatcgcaattacagcagttcaggcaatggcagaagataaataa

SEQ ID NO: 894 - DNA, 996 bp, Dorea longicatena DSM 13814
atgggatttatagatgaaatcaaagcaaaagcaaaaagttgtaaaaaaacaatcgttcttccagagagcgaagacatcagaacttatgaggcagcagaggcaattttaaaagaaggaacagctaacctgatcctgatcggaagcgaagaagagatcgctaagaataaaggggatttcgacatcacaggagctacaatcgtagaccctgctacatatgagaagacagacgaatatgtagcaacacttgttgaactgagaaagaaaaaaggaatgacagaagagcaggcaagagagattcttcttactaattacttatattatggtgtaatgatggttaagatgaaagatgcagacggaatggtatccggagcatgccactctacagctgacacacttcgtccatgccttcagatcctgaagacaaaaccaggaacaaagcttgtatctgcattctttgttatggtagtacctgactgcgacatgggagagaacggaacatttgtattcgctgactgcggactgaaccagaatcctacatccgaagagcttgcagcaatcgctcagtcttcagcagaaagcttcaaacagctcgttggtgctgatccaagagttgctatgctttcttactcaacaatgggaagtgcaaaacacgatgacgtaacaaaagtacaggaagctgttaagatcgcaaaagctgagaatccggatcttatgttagacggagagatgcagcttgatgcagcacttgttccttctgttggagcagctaaagcaccaggaagccaggttgcaggaaaagccaatactctgatcttccctaaccttgatgcaggtaacattggatacaaacttgttcagcgtcttgcaaaagcagaagcttacggaccaatgacacagggaatcgcagcacctgttaacgacctttcaagaggatgcagtgctaaggatattgaaggtgttgttgcaatcacagcagttcagtgccagaatcagtaa

SEQ ID NO: 895 - DNA, 996 bp, Clostridium phytofermentans ISDg
atgggatttattgatgacatcaaggcaagagctaaacaaagtattaagactattgttttacctgagagtatggacagaagaacaattgaggcagctgctaagactttagaagagggcaatgctaacgtaattattatcggtagtgaggaagaagttaagaagaattcagaaggtcttgacatttcgggagctacaatcgttgaccctaagacatcggacaagcttccagcttacattaacaagcttgtagaacttagacaggcaaaaggcatgacccctgaaaaagcaaaagagcttttaacaacagactacattacatacggtgtaatgatggttaagatgggcgatgcagatggtttagtatctggtgcttgtcactctacagcagataccttaagaccatgtcttcagattttaaaaactgctccaaatactaagttagtttctgctttcttcgtaatggtagtacctaattgtgatatgggcgcaaatggaactttccttttctctgatgctggtttaaatcagaatccaaatgctgaagagttagcagcaatcgctggttccacagcgaagagttttgaacaattagttggctctgaacctatcgtagctatgctttctcattcaacaaagggaagcgcaaagcatgcagatgttgataaggttgtagaagcaactaagattgcaaatgaattatacccagaatataagatcgacggcgagttccagttagatgcagcaatcgttcctagtgtaggtgcttcaaaagctcctggtagtgatattgctggaaaagctaacgtattaatcttcccagaccttgatgctggtaacattggatataagttaacacagcgtcttgcaaaggcagaagcttatggaccattaactcagggtattgcagctccagtaaatgatttatcaagaggttgttcttctgatgatatcgttggtgttgttgcaatcactgctgttcaggcacagagtaaataa

SEQ ID NO: 896 - DNA, 996 bp, Clostridiales bacterium 1_7_47FAA
atgggatttattgatgttattaaagaaaaagcaagagcagataagaagaccattgttcttccggagtctatggaccgcaggacatgggttgctgctgaaaagattttaaaagaggatctggcaaatctggtcattatcggaacaccggaggatatcggcgagcacagcaagggactggatgtgtccggagcaaccatcatcaatccgcagacatatgagaagacacaggaatatattgatttattcgtggaactgaggaaagccaaaggaatgaccgaggaaaaggccagggaaaccatcctgaacgattatgcatactacggctgcctgataatcaagaagggcgatgccgacggcatggtatccggcgcctgccactccactgccaatacactgcgtccctgcctccaggtcatcaagaccaagccaggcaccaagctggtatccgcattcttccttatggaagttcccgactgccagttcggggataacggaacctttgtatttgctgactgcggtctgaaccagaacccgaacccggaagagctggctgccattgcagtatcctctgctgagagctttaagctgcttacgggaagggatgccaaggttgcgatgctttcccattcctccaagggtagcgcaagccacgcggacgtggacaaggtggttgaggcaaccagactggccaaggagatggctcctgagctggaactggacggcgaactccagctggatgcagccattgttcctgaaatcggcgagtccaaggcaccgggcagcaaggtggccggacatgccaatgtactggtattcccggacctggatgcaggcaatatcggctacaagctggtgcagaggcttggcaaggcagaggcctacggtcctatgtgccagggcattgcaaagcctgttaacgatctgtccagaggctgctctgcagatgatatcgtaggcgttgtggccattaccgctgtacagtgccagaataattaa

SEQ ID NO: 897 - DNA, 996 bp, Clostridium bolteae ATCC BAA-613
atgggatttatcgatttagttaaagctcgtgccagggctgacaaaaagaccatagtactgccagagtctatggacaggagaacctgggaggcggccgaaacgatattaaaagaggacatcgccaatctgatcatcataggaacaccggaggatattgcagaccacagcaagggactggatgtatcaggagcaacagtgatcaatcctcagacctatgagaagactcaggagtatattgatttatttgtagagctgaggaaatcaaagggaatgacaccggaaaaggcaaaggaaatcatcatgtccgattatgcctactacggctgtcttatgattaaaaacggagatgcagacggactggtgtccggtgcctgccactccacggccgacacattaaggccatgtctgcagattgtcaaaacaaaaccaggcacaaagctggtatctgcattcttcctcatggtagttccggactgcgaatatggagcagagggaacctttatttttgccgattcaggactgaaccagaatccgaatccggaagagctggcagcaatcgccaaatcatctgctgattcatttgaactgctggtacagaaggaagcaagggttgccatgctgtcccattctaccaagggctctgcaaagcatcctgacgtggacaaggtagtggaagccaccagaatcgcaaaggagctttatccggagcttaagctggacggggaactccagttagatgcagcccttgtaccggaggttgcttcctccaaggcaccgggcagcgaagtggcaggcaaggcaaatgtactgatgttcccggatctggatgccggtaatatcggatacaagctggttcagagactggccaaggcagaggcttacggccctgttacccagggaatcgcaaagccggttaacgatttgtccaggggttgttgtgcagatgatattgtgggtgtagtagcaattacggccgttcaggcacaggctgaataa

SEQ ID NO: 898 - DNA, 996 bp, Butyrivibrio crossotus DSM 2876
atggcatttattgatgaaattaaagaaagagccagagctgagaaaaaaagaataattctccctgagggtatggacaggagagtatgggaagctgctgtaactgtcattaaagaaaatgttgccgatgtgactgttattgccacagaggaagaagtaaaagaattttcggaaggactggatatagagggaatacatattatcaatccgtttacatatcctgatcttgacaggtttataaatgaccttgttgaacttagaagaatgaagggtatgacaccgggagaggcaagggaattacttacttctgattatatttattttgcatgtatgatgcttagggagaatcaggcggatggtatcgtttcaggagcctgtcattctacagccaatacgcttcgtccggcattacagcttgttaaggcaaaaccgggaagccgtcttgtttcagcatttttcataatggtagtacctgattgcgaatatgggtataatgggaccttcctgttcggagattgtggtcttgaacagaatcctgaacctgagaagcttgcaggaatagccattgcctcggcagaatctttcagatatcttgtgggaggcgagccatacgttgcaatgctttcatattcgacaaagggaagtgcgagacatgcggatgtagataaagtatataacgcatataaaatagcgagagataatgcaccatatcttaaaattgatggagaattacagccggatgcggcattggttcccgaaattgcggcatataaagcaccgggaagtaaagttgcaggtaaagctaatgtacttattttccctgaccttgatgcaggtaatatcggatataagcttgtgcagagacttgcaaaggcagaagcatatggtcctattacccagggaatgaacaagcctgtaaatgacctttcaagaggatgctccgctaaagatatcgtaggtgttgttgccataacagcggtacaggcacagaaagagtaa

SEQ ID NO: 899 - DNA, 1032 bp, Eubacterium ventriosum ATCC 27560
atgattggtgaatataaggatttaaggagaatagaaatgggttttattgagcaactaaagatcaaggcaaaatctaacaagaaaactattgtgcttcctgaaggaatggatagacgtacatatgaggcagcacaacagattgttgaagaagatttcgcaaacattattattttggccagtcccgaagaggcggagaaatatgggaaaggttatgacatagaaaatgtaacaatcatagatcctaaggattgtgttaagactaaagaatatgctgaagagttttatatgcttagaaaggctaagggaatgacagaaactcaggcttatgcaatgctcgtaagcgattatatgtattttgcatgtatgatggttagagcgggagatgcagacggcgttgtttcaggtgcctgtcactcatctgccaatacacttagaccatcattgcagattattaagactaagccgggaagcaagcttgtttcggctttctttgtaatgtgtgtacagaacaaagaattaggcgctgatggggtatttgttatgggagattgtggacttaaccagaatcctaatccggtgcagttggcagatatagctgcaagtagtgcagagtcatttgaatatttggtaggggagaaggcaagagtagcaatgctttcacattcaacacatggaagtgcagcacatccggatgtagacaaggttgttgaagcaacaaagattgcacagaaggaatatcctcagtttttgattgacggagaacttcagactgatgctgcagttgttccagaggtggcagcacttaaagcaccggacagcccggtagcaggaaaggctaatgtacttattttccctgatttggatgcaggcaatattggttacaagttaattcagagacttggaaatgcagaggcatacggtccactttgccagggaattgcaaagccggttaatgacttatcaagaggatgtagtgcaaaagatattgtaggtgttgtggcaataacagcagttcaggcgcagattaattaa

SEQ ID NO: 900 - DNA, 996 bp, Eubacterium eligens ATCC 27750
atggcatttattgacacaattaaagaaagagcaaaggcagacaagaagactatcgtattaccagagtctatggataagagaacttatgaagctgctgagaagattttaaaggaaggcattgctaatttagttatcattggtactcctgaagagatcgagaagtatggtaagggctatgacatttctggcgccacaatcgtagatccatttaacgatcctaataagcagaagtatattgataaattcgttgagttaagaagcaagaagggtgttacacctgagatggctaaggaacagatggagaaggattacatgtactatgcatgccttatgtgtaaatgtggagatgctgatggagcagtatctggtgcatgccactcaacaggtaacacaatccgtccagctcttcagttattaaagactaagccaggtatcagctcagtttcaggtttcttccttatggaagttccagactgtgaattcggtgagaacggtctttttgtattcgctgactgtgctgtaagcccagattatgattcagagaagcttgctgaggttgctaagctttcttcagattcattcaagagctttgtaggaaaggacgctaaggttgctatgcttagcttctcttcatacggaagtgctaagcatgacagagtaactatggttgctgatgctgttaagattgcaaaagaaaagtacccagatatcactgttgatggtgagcttcagttagatgctgctttagttccagaagttgctgcacttaaggcacctgagagcccagtagctggtaaggctaatacacttgtattccctaaccttgaagctggtaacattggttataagcttgttcagagacttgctaaggctggagcttatggtcctgttcttcagggactttctatgccggttaacgatctttcaagaggatgctttgctgacgatatcgttggtgtagtagctatgacagcagttcaggctcagaatgcataa

SEQ ID NO: 901 - DNA, 1020 bp, Helicobacter pullorum MIT 98-5489
atgagtcttattgaaaacatcaaagaaaaagcaaagtcttttttgcaaaccattgttttgcctgaaaccaatgatatgcaaaccctagaagccgcacacactatcttaaaagaaggcattgcgaatcttattttaatcggagatgagctaagtatccaaaaacaagccaaaaaagccaatcttgaccttcaaaaagcaacttttatcaatcctgcatcatgtgatgaattagaagattatgtagaactttttgttaagcttagagcacacaaaggcttgagtgaaaaatccgctagaactttacttttggaaaatcctctttattttggagtagccctagtaaaatccaaaaaagccgatggaatggtggcaggtgctatcaactctacggctgatgtcttaagatcttctttgcaaattttgggcacaaagcaagattccaaactcgtatctgcatttttcttaatggtagtccctaattgtgaatatggagaaaatggaactttcatctttgcagatagtggtttggtgcaaaacccaaatgcacaagagcttgcttccatagctattgattctgctaaaagcttccaaactctagtaggcaaagaacccattgtcgctatgctttcacattctaccaaaggaagtgctaaacaccctgatgtagataaagttatagaagctaccaaaatcgcacaaagtctagcaccgcaaatagccatagatggagaatttcaattagatgccgctattgtcccaagtgtaggaaagtccaaagccccagatagcaaaatagcagggtatgctaatgtgcttgtttttcctgatttagattctggaaatatcggatacaagcttacccaaagacttgcaaaagctgaagcttatggacctattactcaaggcattgctgcacctattaatgatttatcaagaggttgcagcagtgaagatattgttggtgttgttgccattacagccctccaagcacaacaacaaaaagaaacaaaaggagcataa

SEQ ID NO: 902 - DNA, 1002 bp, Helicobacter canadensis MIT 98-5491
atgggttttattgaaaccattaaagaaaaagcaaaggcaaacctaaaaactattgtcctccctgaaaccaatgatataaggacactagaggcagcccataaagttttagaagaaaaaattgcaaatctcattttactaggagatgaagctaccctcaaagcagaagcagcaaaatctaatttaaatctagatggtgcaacttttatcaatcccacttcctgtgatgaattagaaagctatgtggagttatttgtgaagcttagaggtcataaaggcttgagtgaaaaatctgctagagctttacttttagaaaatccactttattttggagtggctttagtcaaatcccaaaaagctgatggaatggtagctggggctattaactctactgctgatgtgttacgcgcaagcttacagattcttaggacaaaaaaagattctaaactcgtttctgctttctttttaatggtagtcccaaattgtgattatggtgaaaaaggtatttttatctttgccgatagtggtttagtgcaaaatccaaatgctcaagagcttgcttcaatcgctattgattcggcaaagagttttcaatctcttgtgggtaaagatcctattgtggcaatgctttctcattcaaccaaagggagtgcaaaacaccccgatgtggataaagtcatagaagccacgaaacttgcccaaagccttgccccgcaaattgctattgatggtgaatttcaacttgatgcagccatcgttccaagtgtgggtaaatcaaaagctcctgaaagcaaaattgctggatacgccaatgttttagttttccctgatttagattcgggaaatattggttataaactcacacaaagactagcgaaagctgaagcttatggaccaattactcaaggcattgccgcaccagttaatgatctctcacgaggttgcagtagcgatgatattgttggagttgttgccattacagcactccaagcacaacaaaaatag

SEQ ID NO: 903 - DNA, 996 bp, Helicobacter winghamensis ATCC BAA-430
atgggatttattcaaagcattaaagataaagcaaaagccaatccaaaaaccatcgttctcccagaaacaggagatttacgcacgctagaagccgcacacaccgcgctaaaggaaggaatcgcaaagattattttaatcggtgatgaaaaagaaattaaagcgcgcggaaatgggcttgatttaaacaaggcaacttttattgatcctagaagttgtgattcactagattcttatgtagaattgtttgtaaaacttcgcggacataagggtttaagtgagtcttctgcacgcgcattgttactagaaaaccccttgtattttggcgtagcacttgtaaaaacaggcgttgctaatggaatggtggcaggtgctgttaattccactgctgatgtcttacgcgcttctttacaaattctaggaacaaaaaaggattccaaacttgtttcagcttttttcttaatggttgttccaaattgtaactatggagaaaatggaatctttatttttgccgatagtggtttggtgcaaaacccaaatccccaagagctagcttctattgcgattgactcagcaaaaagctttgaatctctcgtgggtaaagaagcagttgttgcaatgctctcacactctacaaaaggaaatgcgaagcaccctgatgtggataaggtaattgaagccacacaaattgcaaaagcacaagccccaaatatcgctattgatggagagtttcaactagatgcggcgattgttcctagtgttggtaagtctaaagccccagatagcacgattgcaggaagagcgaatgttcttgtattcccagatttagatgcaggaaatatcggctacaaacttgttcaaaggcttgcaaatgcagaagcctatggaccaattacccaaggaattgcaggagcggttaatgacttatcgcgcggttgcagcagtgaagatattgtaggcgtgattgctatcacagccttacaagcacaccaaaactaa

SEQ ID NO: 904 - DNA, 996 bp, Helicobacter hepaticus ATCC 51449
atgagttttattgatacaattaaaacacaggcaaggaagaataaaaaaacgattgttcttcctgaaacatcagattctaggacaatagaggcagcggtaaaaattctaaatgaagactttgcagagcttattttaattggagaacaagaacaaatcctctccacataccaagataatgctcaagtgcttaaaaaagcgacttttctccattcttcagataccgcattgcttgatgaattgattgaattacttgtcaaattgcgcgctcacaagggtatggataaatctaaggcgcgtgaaatcctcgtaaatgataatctctattttggcgcagcacttgtgaaagcaggtagggctgatggtatggtagcaggagcaattcacgcaacctctgatgtattgcgcgcagcactacaaattgtcggcactgctccagattctaaacttgtatcaagtttctttgtaatggtagtgcctcaatgtgattatggattaaatggcacatttgtattctctgattgcggactttgtcaaaatccaagtgctgaagagcttgcacatattgctctttcaagtgcaaaaagcttcgcgtccattatgcacgaagaacctatggtagctatgcttagtcattcaacttatggcagtgcaaaacacccagatgttgataaagtcgttgaagcaacaaaaattgctaagagtttagataagaatcttaaagttgatggggaacttcaattagacgcagcaatagtgccaagtgtaggtgcttctaaagcaaaaggttcaaatgtagcaggaaaagcaaatgtgcttgtattccctgatttagatgcaggaaatattggatacaaactcgtgcaaagattcgcaaaagcggaagcctatggacctatcacgcaaggtatgggtgcgcctatcaacgacctttcacgtggttgtagcgctgatgatatagtgggtgtagtagctcttactgcacttcaagccaaataa

SEQ ID NO: 905 - DNA, 1017 bp, Helicobacter cinaedi CCUG 18818
atgggttttattgacacgattaaagctcaagcacgagcaaataaaaagaaaatcgtcctgcctgaagtgactgatttgcggacgattgaagcggctgtaaagattttgagcgagggctttgcagacattgttcttgttgggcaaaaagatgagattcttactcaagctaaaggcttgagccaagctcacctgccgcttatagaagctttaaataacgccacttttcttaatgctaaagacagtgcattgcttgatgacctaacagccttgcttgtgaagcttcgtgctcataagggaatggatagcacacaggctagagagctacttgtcaatgataacttatattttggtgcagcacttgtcaaaagtggcagggctgatggtatggttgcaggagcgatacacgccacagccgatgtgttgcgtgcggcattgcagattgttggcacagcggcagattcaaagcttgtttcaagcttttttattatggatattccacattgtgattatggcttgaatgggacatttgtcttttctgattgcggtttatgtcaaaatcctaccgctgaagaactcgcccacattgctatctcaagtgcaaaaagttttgaatctgttatgcatagtgaagctatggtagcaatgcttagtcattctacttatgggagcgctaagcacgccgatgtggataaagtggtagaggctacgaaaatagctaaaagtttagcacctaatcttaagattgatggggagttgcagcttgatgcggcgattgtgccaagtgtgggagaatctaaggcaaaaggctcaagtgtcgcaggaaaggcaaatgtgcttgttttcccagatttagatgcggggaatatcggctataaactcgtgcagagatttgctcgtgcagaagcctatggaccaatcacgcagggtatgggtgcgccaattaatgatctttcgcgtgggtgcagtgctgatgatatagtgggcgtagtggctttaacagcacttcaagccaaataa

SEQ ID NO: 906 - DNA, 1005 bp, Anaerostipes caccae DSM 14662
atgagttttattgatgtgattaaagaacgagctaaaagtgagaaaaaaaagattgttttgcctgagaccggagatccccgtactcttgaggctgcagacacagtgctgagagaagggatcgccgacattattcttgtgggaaacgaggaggaaattttaagccgcgcagagggactggatctttccaaggcctgttttgtagatcctaacaactgcgaaagactcaatacatacattgaatctttgtgcgaagccagaaagagcaagggactgctcccggaggatgcaaaagaaatcctgctttctaatccgctgtttttcggagcgactatggtgcgtgccggagatgcggacggcatggttgcgggggcagtgaattcatccgccaacgttctgcggtctgcccttcaggttgtcaagacggctccggggacaaggatcgtttctgccttcttcctgatggtagtgccggattgtgaactcggcgccaacggtacttttgtatttgcagactgcggactgaatcagaatcccaattcagaacagctggcagccattgccggaagttctgcgcagacatttaaacagctggtgggagaagaaccaagggttgcaatgctttcccattccacagtgggaagcgcaaaacacgacgatgtgacaaaggttgtggaagcaacggcgatcgcaaaaagagattatccggacacactgatctgcggagaactgcagctggatgcggcgatcgttcctgaggtggcggcatcgaaggcacccagaagtgaagtggcaggaaaagccaatgtactcgtcttcccggatctggatgcaggaaatatcggatacaaattagtccagagactggcaaaagcggaagcctacggcccggttacccaggggattgcaaagccggtcaatgacttgtcccgcggatgcaaggcggaagatatcgtcggagttgtggcaatcacggcagtgcaggcacagcttacggagaataattag

SEQ ID NO: 907 - DNA, 1014 bp, Clostridium sp. SS2/1
atgagtgttattgatgagattaaaaacaaggcaaaagcaaataagaaaactgttgtactgcctgaaactacagacatgagaacattaacagcagcagcagaggttatcagtgaagggatcgctgatattattttagttggaaaagaagacgagattaaggcaaaagcagaagcagaaggattagatttagccaaagcttcttttgttgatccagagaactgtgatcatttaaatacatatatcgaatctttgtgtgaagcaagaaagagcaaaggactgcttccagaagatgcaaaagagatcctgttatccaacccactgttcttcggagcaacaatggtaagagttggagatgcagacggaatggtagcaggagcgatcaactcttctgcaaacgtacttcgtgcagcacttcaggttgttaagactgcacctggtacagaaatcgtatcagccttcatgttaatggatacacaggctaaagatatgggtgaaaacggatgtttcgtattcgctgactgtggactgaaccagaatccaaatccagaacagttagcagcaatcgcttcaagctcagctaagacatttgagcagttgatcggagcaacacctagagttgcaatgttatcccattctacatgtggaagtgcaaaacatgacgatgtaacaaaagttgtagaagcaacaaacatcgctaaagaaaaataccctcagtacctgatctgtggagaattacagcttgacgcagcgatcgtaccagaagttgcagcaagtaaggctccaagaagtgaagttgctggtaaagcgaacgtattagtattcccagacttagatgctggtaacattggatataaattagtacagagattaggtggagcacaggcattcggacctatcacacagggaatcgcaaaaccggtcaatgacttatcacgtggatgtgtagcatcagatatcgttggtgcagtagcgatcacatgtgtacaggcagcagcactggaagcagataaataa

SEQ ID NO: 908 - DNA, 1068 bp, Coprococcus eutactus ATCC 27759
atgtgtgttttcattattttaaagggggacataaacatgaagtttatcgaacagttaaaagaacgagctaaacagaataagaaaaagatcgtattgcctgagacatcagacatgagaaccatcgaggcagccggcaaggtattggcagaaggcattgcggacattattctggtaggagacaaggaagatatcatcagcagagcaggcgacatcgacctgagcagagcgtcatttgtagatccagagaattatgataaatttgacgaatatgtagatgcttttgttgagatgagaagaaagaagggcatgacaccggcgagagccaaggaactgcttttgacaaatccgttatatttcggatgtatgatggttaagcaggatgacgcagacggtatggttgcaggagctatcaatgcatccgcagacgtacttagagctgcacttcagacactcaagacagcacctggaacaagaattgtatcagcattctttctagtagttgtacctgattgcgaatatggtgcaaatggagcatttgtattctccgatgcaggattaaaccaaagtccatcagcatcagagctggcagatatcgcagagcagtcagcaaagtcatttcagcttctcgtacaggaagagcctgttgtggctatgctttcacactcaacaaagggcagtgcaaagcatcctgacgtagataaggtgatagaggctacagagatcgtaaatgcagaattccctgatctcttgtgtgatggcgagcttcagtctgatgcagcacttgtaccggaggttgcttcatccaaggcacctggaagtaaggtggcaggacatgccaacgttcttgtatttcctgatttggatgctgcaaatatcggatataagcttgtacagagacttgcaaaggctgatgcctacggtcctgttacacagggtatcgcaaagcctgttaacgacctttcaagaggctgtgtagctgacgatatagtaggtgttgttgcaattactgctatccaggctcaggctcaggaggcaggacttatgaaggtaactcctaaggagagataa

SEQ ID NO: 909 - DNA, 999 bp, Epulopiscium sp. 'N.t. morphotype B'
  misc_feature (117)..(117): n is a, c, g, or t
  misc_feature (222)..(222): n is a, c, g, or t
  misc_feature (226)..(226): n is a, c, g, or t
  misc_feature (837)..(837): n is a, c, g, or t
atgtcatttttaaattctataaaacaaatcgctaaaggtttacaaaaaactatagtactaccagaatctcatgatatgcgtacactacaagctgcagatacaattttgaaagaaggnttggccaaacttattttaattggagatcccaaaaaaatagctgcggatgctgttggtctcgatttatctaaagcaactatcatagatccaaaacactttagtcanatgnatgaatatatcaacgaattatataatcttagaaaatccaaaggactcacattagaacaagcaacagagcttttaactaccaaagatttatttctcggagttatgatggttaaaatgggcttggctgatggaatggttgctggcgctgccaattctagtgcaaatgtattgcgccctgcacttcaaattcttaagactgctcctggaacaaaaattgtttctgcattctttattgtagttgtacctgattgtgagtatggagataacggtgtgttcttatttggagactgtggattaaacgaaaatccaactgccgaacaacttgcggagattgccaaaagttctgcagaaagcttccaacaattaactcaacacgagcctagagttgctatgctttcttactctacacatggttctgctcacaatccacttgtagacaaaatgcaagatgctaccaaattagctaaagagctttgtccaaatactttaatcgcgggagaattgcaactcgatgccgctattgttccagaaatctgttctctcaaagcaccaacatgtgaacttcaaggtaaagccaatgtactaatattccctaacctcgatgccggaaanattggctacaaactggttcaaagacttgctaaagcggaagcctatggccctgttactcaaggtatagcaaagcctgtaaatgatctatctcgcggatgctctgctgatgacattgttggtactgttgccattactgctcttcaaactcaacacgttaaataa

SEQ ID NO: 910 - DNA, 999 bp, Eggerthella lenta DSM 2243
atgagttcattcctggaaacgatgctcgcccgcgccaaagcggatcgccagacgatcgtgctgcccgaaggcgacgacgagcgcaccctggcggcggccgagcgcatcttggccgacgacatcgccgacctcgtcatcctcggcgacgcccacgccatcgcggccagcccctacaagctcagcggtgcgcgcatcatcgacccgcgcacgtccgagctgcgcgaagggttcgccgaggcgctctacgagctgcgcaaggccaaggggatgacgcccgagcaggcgatgggcctcatggacgacgtgctgtacttcggcgtgatgatggtgaagaccggcggcgccgacggcatggtggccggcgcatgccatgccacgggcgacgtgctgcgcccctgcctgcagatcctcaagaccgcgccgggcgtgaagctggtcagctcgttcttcgtcatggtggtgcccgactgcgacctgggccaagaggggacgttcctgttctcggactgcggcctggaagtgcagcccgatgccgaaaagctcgcgcacatcgccgtgaactccgcgaagtcgtggaagacgctcatgggcaccgagcccgccgtggcgctgctgtcgcattcgacctacggctcggccaagaacgacgacgcggccaaagtggtcgaagcaacggccatcgcgaaggagctggcgcccggtctcgcgctcgacggcgagctgcagctggacgcggccatcgtcgagtccgtgggctcctcgaaggctcccgactcccccgtcgcaggcaaggccaacgtgctgatattccccgacctcgatgccggcaacatcggctacaagctggtgcagcgcctggcgaaggccgaagcctacggtccgatcacccaaggcatcgccgcccccgtgaacgacctttcccgcggctgcaccgccgacgacatcgtcggcgtcatcgccatcacctgcgtgcaggctcaagcgaagcaggcggagtaa

SEQ ID NO: 911 - DNA, 1002 bp, Cryptobacterium curtum DSM 15641
atgagtgcctttattgaatcaatgatcacccgcgcgcaaacttctcgtcagactattgtccttcctgaaggaaacgaccagcgaaccctgcaagcagccaaagccgttatggaacgcggtattgctgatgttattgtgcttggtaacgctactgaaattacttcaaccgccggagatcttgctggcgcgcgtattgttgacccagctacatccaacgcagcatcttcatatgccgaaactttctttgaactgcgtaaacacaaaggaatcaccctagaagatgccatcgctcagatggctgaccccatctactttggcgccatgatggttaaacaaggagacgcagacggtatggtctgtggtgcatgccacgcaacggctgatgttttacgggcagcgctgcaaatactcaaaacggctcctggggcttctgcggtatcaagcttctttattatggctctccctgatactacctacggggacgatggtgtactgatgttcgctgactgcgggctcaccattcagcctgatgccgccgcacttgcacaaatcgcggtgagttgttcggaaagctggcacgctttgtttgaatcagagccacgcgttgcgcttctttcccattccacgcacacctctgcggtggctaaccctgatcgcgacaaagtaatcgaagccacacggcttgcacatgaaatggcacccaacctcgcacttgatggcgaactacaggccgatgccgccctcgtgcccgccgttgccgcgacaaaagcagcggattcctcggttgcaggcagcgccaacatcttggtattccccgatctcgatagcggcaatatcgcctataagctcgttcaacggctcgcgcatgctgaagcctatggtcctattacccagggaatcgcggcacccgttaatgatctgtcacgcggtgcatcggttgaagacatcattggcgttatcgctattaccgccgtccagtgccaagctactgaacgtgtttag

SEQ ID NO: 912 - DNA, 996 bp, Slackia heliotrinireducens DSM 20476
atggcaaagttcaacgacttcatgatcgagcgcgccaaagccgacgtgaagaccatcgtgcttcccgagggcgccgacccccgcacgctcgaggccgccgagatcatcctggccgagaagattgccgacctgatcatcatcggcaacgaggccgacatcgtcgccagcggacgcaacctggaaggcgccacgattatcgacaacaccacgtccgagctgcgtgccgagctggccgagcagctctacgagattcgcaagaacaagggcatgacccccgaggacgccatggcactcatggacgacgtcaactacttcggcaccatgctgctcaagacccgccgcgctgacggcctggtcagcggcgcggcccactccaccgccgacgtgctgaagccggcactgcgcatcatccgcaccgcgcccggcaccaagaccgtgagctccttcttcatgatcgaagttcccgactgcccctacggcgaagacggcctgttcatgttcagcgactgcggcgttgtgattcagccctccgccgaggagctgagcgagatcgccatcgccgccgcgcactccttcgaggacctggtgcagaagcccgcgcgcgtggccatgctttcgcactccaccaagggcagcgccaaggacgccgacgccgacaaggttatcgaagccacacgcctggcccaggagaaggcccccgatctggccatcgacggcgagctgcaaggcgacgcggcaatcgttccccatgtgggagaatccaaggccccgggttcgaagatcgcaggccacgccaacgtgctgatcttccccgacctggatgccggcaacatcgcctacaagatggcccagcgcctggccaaggccgacgccttcggccccatcacccagggtttggccatgcccatgaacgatttgtcccgcggctgcgtggcttacgacatcgtgggagccgttgccatcacctccgtccaggcccactgcgccggcgtctaa

SEQ ID NO: 913 - DNA, 996 bp, Clostridium papyrosolvens DSM 2782
atgaactttttagagcagattgtaagcagagcaaaaaaagatatcaaaacaatagtacttcctgaaagcaatgatattagaactttgaaggctgctgcaatgattcaggaacaaggtattgccaatgtcgtacttgtgggaaacaaggatgatataaagaaactgggtggtgacctggatatatcaaaggctaaaattgttgatcctgcaaactttgaaagatttgatgagtatgtaaataccctgtatgaactcagaaaggcaaagggaatgactcaggaacaggcaaagaaaatattatctgaaaatcctttgtacttcggaattatgatggtaaaaatgggcgaggctgacggaatggttgcaggagcaattaattcaactgcaaacacattaaggccggctcttcaaatattaaagaccgcacctggggcaaaactggtatcagcattcttcgtaatggttgtacctgactgcgaatacggcgaaaatggagtattcatctacggagacagcggacttgtggaaaatccaaatgcagaagagctttcagaaattgcaatagcttcttcaaaatcattcaagagccttgtacaggctgaaccggttgttgcaatgctctcatattcaacatacggcagcgcaaagagtgtacttacagaaaaggttattgaagctaccaaacttgcaaaggaaaaagctcctgaacttcagcttgacggagaattgcaggcagatgctgccatagttccttccgttggagcatcaaaagcaccgggaagcaatgttgcaggaaaggccaatgtattaatattccctgaccttaactgtggtaatatatcctacaagcttacacaaagactggcaaaggcagaagcctatggccctattattcaaggtatagcaaaacctgttaatgatctttcaagaggatgcagtgcggaagatatagtaggtgttgttgccataacttgtgtacaggcacagaattcataa

SEQ ID NO: 914 - DNA, 1077 bp, Clostridium thermocellum JW20
gtgataatatatagttataagtattacaaatacagtttttatgataacagttttgggattatgaaaggagaagaatttatgagttttttggaacaaataattgaaagggcgaaatcagacgtaaaaaccatagttttgccggaaagtacggatctgagggttattaaagctgcatccatgatagtgaaaaagggaattgcaaaggttgtactgataggcaatgaaaaggagattaagagtctggcgggggatattgatcttgaaggagtgatgatagaggattccttaaattccgaaaaattggaggattatgcaaatacactgtatgagcttagaaaatcgaagggtatgactatagaagccgcaagggaaacgatcaaagaccctctttattatggagttatgatggtaaaaaaaggtgaagcggatggtatggtggcgggtgctgtcaattccactgcaaatactttgagaccggctttgcagatattaaagacggccccggggacaaaactcgtatcatccttttttgttatggttgtacccaactgtgaatatggtcataacggaacctttgtatatgccgattgcggcttggtggaaaatccggatgcagaccagctttctgaaattgcaatatctgcatccaaatcttttgagatgctggttggagcaaaacctcaggtggcaatgctttcttattcttcttacggcagtgccaaaagtgagctgaccgaaaaggtaatcaaggcaacacagcttgcaaaggaaaaagctccccaccttgcaattgacggagaacttcaggtggatgccgccattgttccggaagtggcaaaatcgaaggcaaagggaagcagtgttgcaggaaaggccaatgttcttattttcccggatcttgatgccggaaatattgcatacaagcttacacagagattggcaaaagctgaagcttacggcccgataacacaaggtttggcaagaccggtaaatgatctgtcacgaggctgcagtgccgaggatatagtcggggttgcggcaattactgcggttcaggctcaatatgtcaaggcataa

SEQ ID NO: 915 - DNA, 1032 bp, Caldicellulosiruptor saccharolyticus DSM 8903
atgttaaataataaacgaaaggggcttttaaagatggcatttattgatacaataatagaaaaggcaaagtcaaatataaaaacaattgtgcttcctgaaagctatgaagagagaaatttaaaagctgcaagtgttgtacttaaagagaagattgcaaagattgttttaattggtaaagaagatgagattaaaaaagaagcagcaaagtttggtgcaaatgtagatgaggcaatctttattgaccctgacaactttgagaggtttgatgaatttgtaaatgatttttatgaactgagaaaaaataaaggtgtaacacttgaagatgcaaaaaaaattatgaaagacccaatgtactttggcgttatgctggtgtacaagggtttagcagatggtatggtatctggtgcaattcactcaactgcggatacactgcgcccagcacttcaaatcttaaaaacagcaccaggtgtaaagcttgtttcaagtttctttataatggttgttccaaactgtgaatatggcgaaaatggtgtatttttgtacgccgatgcaggtttgaatccaaatccaacagctgaagaacttgctgatattgccataacctctgcgaagagctttgaagctttggttggaaagactccaaagattgctatgctttcatattcaacaaaggggtctgcaaagtcagagatggttgacaaggttgttgaggcaacaaggattgcaaaagagaaagcaccagaccttttgatagatggtgaacttcaggcagatgcagcacttgtaccttctgttgcaaagttaaaagcaccaggcagccctgttgcagggcaggcaaatgtgctaattttccctgaccttaatgcaggaaatattgcgtataagctgacagagagacttgcaaaagctgaggcgtatggacctattacccagggaatagcaaaacctgtaaatgatttgtcaagaggctgcaaggcagaagacattgttggtgttgttgctatcactgctgttcaggcaatgatgaaataa

SEQ ID NO: 916 - DNA, 1002 bp, Methanosarcina thermophila
ttggtaacatttttagagaagatcagtgaaagagcaaagaaacttaacaaaacaatcgctttacccgaaactgaagatataagaaccctccaggcagctgccaagatccttgaaagaggtattgcagacattgtccttgtcggtaatgaggcagatattaaggcgctcgcaggagatctggatctctcaaaagcaaaaattgtagatcctaaaacctatgagaaaaaagatgaatacattaacgctttctacgagttgagaaagcacaaaggcatcacactcgaaaatgcagctgaaatcatgagcgattacgtttacttcgctgttatgatggccaaactcggggaagtagacggtgtagtatcaggcgctgcccactcttcttcagacaccctgaggcctgctgtccagatcgtgaaaacagccaagggcgcagctcttgcatccgctttcttcataatctctgtgcctgactgtgaatatgggtcagatggcacattccttttcgctgactctggcatggttgaaatgccgagcgtagaagacgttgcaaacattgcagttatttccgcaaagaccttcgaattgctggtccaggacgtgccaaaggttgcaatgctctcctactccaccaagggaagcgccaagagcaaactgaccgaagcaacaattgcttctacaaaacttgcacaggaacttgctcctgatatcgcaattgacggtgaactccaggttgacgccgcgattgtccccaaagttgcagcttcaaaagcccccggaagccctgttgcaggcaaagccaatgtcttcattttccctgacctgaactgtggaaacatcgcatacaagatcgcccagaggcttgctaaagctgaagcttatggtcctatcacccagggactggcaaagccaattaacgacctgtccagaggctgcagcgacgaagatattgtcggtgccgttgccattacctgtgtacaggccgcagcacaggacaaataa

SEQ ID NO: 917 - DNA, 1002 bp, Methanosarcina acetivorans C2A
ttggtaacatttttagagaagatcagtgaaagagcaaagaaactcaacaagacaatcgctttacctgaaactgaagatataaggaccctccaggcagctgccaagatccttgaaagaggtattgcaaacgttgtccttgtcggtgatgaagccgacattaaggcgctcgcaggagatcttgatctctcaaaagcaaaaattgtaaatccgaaaacctatgagaaaaaagacgaatacattaacactttctatgagctgagaaagcacaaaggtataacccccgaaactgcagctgaagttatgagcgattacgtttacttcgccgttatgatggcaaaactcggagaagtagacggagtagtatcaggagctgctcactcttcttcagacaccctgagacctgctgtccagatagttaagactgctccaggcgcagcacttgcatccgctttcttcatcattgccgtacctgactgtgaatacggatcagatgggaccttcctctttgccgactcgggtatggttgaaattccaagtgtagaggatgttgcaaacattgcagttatttctgcaaagaccttcgaactgctggttcaggacactccgtatgttgcaatgctttcctattccaccaaaggaagtgcacacagcaaactgaccgaggcaacagtcgctgccacaaagcttgcacaggaacttgctcctgacgttgcaatcgacggtgaactgcaggttgatgcagcagttgtccccaaagttgcagcttcaaaggctcccggaagccctgtcgcaggtaaagccaatgtctttatcttccccgatctgaacgctggaaacatcgcatacaagatcgcccagaggcttgccaaggctgaagcatatggtcctatcacccagggacttgcaaagccgattaacgacctgtccagaggatgcagtgacgaagatattgtcggtgctgttgcgattacctgtgtccaggccgcagcccaggacaaataa

SEQ ID NO: 918 - DNA, 1002 bp, Methanosarcina barkeri str. Fusaro
ttggtaacatttttagaaaaaatcagtgaaagagcaaagaaactcaacaaaacaattgctttacctgaaactaccgatataagaactcttcaggcagctgccaaggccctcgaaagaggggttgcaaatatcgttctcatcggcgatgaagcaaatattaaggagcttgcaggagatcttgacctctcaaaagcaaaaattgtaaatcctgagacttacgagaaaaaggatgaatacattcaggctttctacgagctgagaaagcataagggtattacactcgaaagtgcagccgaaattatgaaggattacgtttacttcgctgttatggcggctaaactcaatgaagtagacggtgtagtttcaggtgctgttcactcttcctctgatacacttagacctgctgtccagattgttaaaactgcccctgatgcagctctcgcatctgcttttttcattattgccgtgccggactgtgaatatgggtcagaagggacattcctctttgctgactcaggtatggttgaaatgcccagtcctgaagacgttgcaaacattgctatcatttctgcaaaaacctttgaactgctggttcaggatgatccatatgttgcaatgctttcttattccactaagggaagtgcacacagcaaactgactgaggcaacaattgctgccacaaagcttgcacaggaactcgctccagatattccaattgatggtgaactccaggtagatgcagcaattgttccaaaagttgcagcttcaaaggctccaggaagccctgttgcaggcaaagctaatgtctttatcttccctgaccttaacgctggaaacatagcatacaagattgcccagaggctcgccaaggccgaagcttatggccctattactcagggacttgccaagccaattaatgacttatccagaggctgcagcgacgaagacattgtcggtgctattgcaattacgtgcgttcaggccgcagcacaggacaaataa

SEQ ID NO: 919 - DNA, 978 bp, Roseobacter litoralis Och 149
atggacaacgctgtccgcctgaaccgcaagatcgttctgagcgaaggggaagacccgcgcgtgattgaagcggccatacgagcgcggcaacagcagatcgcgcggatcgttctggtcggggatagcgacaggattgtctccgctctcacgcaagcgggtgccgacgatctggatggtatcgaaatccaggaccctgcaaatagtgcgcatctggccgagatgacaaatacctattacacgctgagacaacacaaaggggtgacaccagagattgcggcgcaaactgtgcagaacccgcatgtgtttgccgctttgatggttcggcttgggcatgccgatgggacgctcggcggtgctgtgaccgccaccgctgaaatcgtgcgtacggcaattcaggtgatcggcaccgcgccggatgccaagatggtgtcgagtttctttctgatgttgctgaaccaggaccaccatccgaaacagggtgtgctggtcttttctgatgcgggtttggtgattgagccgaatgcttcggaaatggcccagattgctgcagcgtcagcagtgtcattttccaaacttatgggtgaaaccgcaaaagtcgcaatgctgtcgttctcaaccaagggaagtgcgggcggtgagaaagtgtccaaagtcgtcgaagcgaccgctttgctgcgcgacatggcgcctgatttgatcgtggacggggaattgcaattcgatgcagcctttgttcccgaggtcgccgccgccaaggcgccggggtctgcggtcgaaggggaggcgaatgtcttcatcttcccaaatctggatgctggtaacatcgcctataaggttgcccaacggattgggcgcgcgcgggcggtcggacctgtcttgcagggccttgcgcaaccagccaacgatttgtcgcggggctgcacggcggatgacatctttgacatgactgccgtgacagcggtgcaatccgggcgttga

SEQ ID NO: 920 - DNA, 999 bp, Roseobacter denitrificans OCh 114
atgaccccacttgagcagatgatggacaaggctgtccggctaaaccgcaaaattgttctgagcgaaggagaggatccgcgcgtgatcactgcggccatccaagcacgcagacgtcgaattgcacaggtggccttgatcggaaaccgcgaccgcatcgcctctctactgaatcaggcggggggcagtgatctggacgggatcgagatccatgaaccggcaacaagcccacatctgcccgagatgacggagacctacttcaaactccgccaacacaagggcgtcacacaggaaaccgcatctcaggcggttctgaacccgcatgtctttgccgctctgatggtcaaactagggcatgcgcacggaacgcttgggggtgccagcacggcaacagccgaaattgtgcgcacggccattcaggtcatcggcaccgcaccaaatgccaagatgatttcgagcttctttctgatgctgctgagcgaggatcatcatcccaaacaggggattgtcgtcttttccgatgccggtctggtgatcgagccaaacgcagaggaaatggcccagattgctgtcgcgtcggccaactcctacggacaactgacaggcgaaactcccaaggtcgcaatgttgtcattctcgaccaaaggcagtgccggcggcgaaaaggtatcgaaggtcgttgaggcgaccgcgctgctgcgatcaatggatcctgatctgatcgtggatggagaattacagttcgatgctgcctttgtgccggatgttgcggcgaccaaggccccggactccgaattgaagggcgatgcgaatgtcttcatcttcccgaatctggatgccgggaatatagcctacaaagttgcgcagcggatcggacgcgcgcgcgcgcttggaccgatcttgcagggtcttgctcaacctgcgaatgacctgtcccggggctgcactgccgaagatatcgtggatatgattgccgtcacggccgtgcaaggtggcgcgtag

SEQ ID NO: 921 - DNA, 1026 bp, Dinoroseobacter shibae DFL 12
atgaaaccacttcaaatgatcctggccaacgcggcgcgctcggaccgcaagatcgccctgagcgaaggggaggacccgcgcgtcgtcgcggccgccgtgcaggcccgcaagcagcgcgtggcgcgggtcgtgctggtcggggaccgcgccaccattgtcgcccgtctcgcggaggcgggcggggccgagctggacgggatcgacgtgcacgacccgcgcgaggatctgcaccgcgccgagatggccgccacctatcaccagctgcgcaagcacaagggcgtcaccgaagccgacgccgaggccgcgatcctcaatccccatgtctatgctgcgctgctggtcaggctgggccatgcggacggcaccctcggcggggccacggccaccaccgccgaaatcgtgcgcaccgcgatccaggtgatcggcaccgcgccgggcgcgaagatggtgtcgagcttcttcctgatgctgctgtgcaaggaccaccacgagaagaagggcgggctggtgttcgcggatgcggggctggtgatcgacccgaccgcggcggagatggccgagatcggccgggcctcggcggcctcgctggtccagctgaccggcgagacaccgcgggtggcgatgctgtccttctctacccgcggcagtgccagcggcgacaaggtctccaaggtcgtcgaagccaccgagatctttcgccagctggccccggaggtcaccgtcgatggcgagttgcagttcgacgccgccttcgtgcccgaagtggccacagccaaggcgccggattccgccatcggcggcagcgccaatgtcttcgtcttccccaacctcgacaccggcaacatcgcctacaagatcgcgcagcgtatcgggggggccgtggcgatcggaccgatcctgcaggggctcgcgctcccggcgaacgacctgtcccgcggctgctcggccgaagacgtgctgcacatgatcgccaccaccgccgcgcaatgccaggacgtcgcgccgcatcacgccgccgcccggtag

SEQ ID NO: 922 - DNA, 1035 bp, Rhodobacteraceae bacterium KLH11
ttgttcggggcactgaaaggatacgggatgaaacctctggagatgcttctgggaaatattgcagggtcgcaacagaagatcgtgctgagcgaaggtgccgatccacgcgtcgtacaggcaactattgcggcgcgccaacacggcatcgcccgtattgctctggtaggtcccgagcaggacattctggaacaatttgcccgcgccaatgcgacgctggatgacggggtcgagatccatgatcctgcaacctcacctctgatcggagagctggcgcaggcgtatcatgaccgacgcaagcacaagggcgtatcgctggagcaggcaactgccgaagccagaaaaccccatgtctatgctgcgttgctggtcaaaaccgggtatgccgacggcacggttggcggtgccgtagttaccaccgccgagattgtgcgcacagccattcaggtgatcggggcgaaaccggaatcaaatctgatctcatccttctttctgatgctgttctgtcagccgcatcatggcaagaagggggctcatatctttgcggactgcgcgctggtggtggatcctgacgcgggggaaatggcgcagattgcactggattcggcgaacagcttttccgccctgacaggcgaaacaccccgtgtcgcgatgctgtcattttcgacgcggggcagcgccacacatgaaagagtttcaaaagtggcggcggccacagaaatctccagagaggccgctccgacacttctgattgatggcgagcttcagtttgacgccgcatatgttcccgaagtggccgcccgcaaagccgaagacagcccgcttcagggtgacgcaaatgtttttgtctttcccaatctggaaagcgggaacatcgcgtacaagatcgcgcagaggatcggtggcgcttcggcgatcggccccattcttcaaggccttgcaaaacccgcaaacgacttgtcacgagggtgttcggctgacgatatcctgaacctgatcgcagttaccgcagcacaagcgggcggtctggaaggttag

SEQ ID NO: 923 - DNA, 1023 bp, Silicibacter lacuscaerulensis ITI-1157
gtgaagcccctgcgcgccattctcggagcggcaagctgttccgacaagatcatcgccctggccgagggcgatgatccgcgcgtcttggaaggcgctctcagggcccgtgccgagcgggtcgcacggatcattctggttggcgaccgggaacggatcggcacgcttttgtccgatttgggcggtgcgcaaacagacgggatcgaaatccacgaccctgccgactcggacctctccgagccgttcgccgaggccctttgggccctgcgccgtcacaagggcatgactaaagaagccgcacaggaacaggtccgcaaccgacttgtctttgccgcgatgctggtccgactggggattgccgacggcacggtggggggcgccgtcgagaccacatccgacacggtccgcacggcgctgcagatcatcggaaaggccccggaggcagcaatggtctcgagcttctttctgatgctgtattgccgagaacaccatgatttcaaaggcgctcacctgttcgccgattgcggcatggtcgtcgatccgagcgcgcaagagatggcggaaatcgcccgcgcctctgccgcgtcctacaaagcgctgaccaacaaaactccgcgcgttgcgatgctgtccttctcgacctcgggaagtgccaaccatccgaaagtgtccaaggtcgtcgaggcgacccggatcgcaaaggcggccgatccggatctgctgatcgacggcgagttgcagttcgacgcggcgttcgtcccggaagtggcggcccagaaagccgccaattccccgttgcagggccgggccaacgtattcgtctttcccagcctcaatgcgggcaacctgggctacaagatcgcccagcgcattggtggcgccgaagccattggccctgtgttgcagggattggccaaaccggccaacgacctgtctcggggctgttcggccgaagacgtgctgcacatgatcgccgtgacggcggtacaggcacaagtgtctggccccggcaccaaaaaaccctag

SEQ ID NO: 924 - DNA, 1035 bp, Sinorhizobium medicae WSM419
atgaaacctctcgaccggattatcgaaacggcaaggaaagccccgcgacacattgttctctccgaaggggaggacccgcggatcgtcgccggcgccgtacgtgcgaggcgggaatgtctggcggagatcacgctcgtcggaaaccgcgaggtggtcatgcacaggctcgcagctctggatgcaaacccgcgagaattccgggtggaggacccgtcctcctcgtcgctcaccgacggtttcgcggcttcctttctcgacctcagaaggagcaaaggcgtcgacgaggccgcggctcgggtggcggtgctcacgccactgaacttcgccgcgatgatggtgagggaagggctggccgacggaaccgtcggcggtgcggtcgcgaccaccgccgataccgtgcgcgccgccctgcaggtgatcggtagggcgcccggcgtcgggctcgtctccagcttctttctgatgatgctctgcgaaccgcatcacgcccgcaagggtgccttcgtcttcgccgattgcggactggtggtggatcccgatgcaggcggccttgccgacatcgcgcttatgtccgcgaaatcctatgagcagcttgccggcgagcgggctaaagtcgccatgctctctttctcgaccggcggcagcgccgctcatgagcgcgtttcgaaggtcgtcgaggccacccgcatggcgcgatgcgctgagcccgatctcgttatagacggggaattgcagttcgacagcgccttcgtcgaagccgtctccctgaccaaggcgccgcaatccgcgttgcgcggggaggccaatgttttcgtgttcccgaatctcgacgcggcaaatatcggttacaagatcgcccagcggatcggcggagcgacggcgatcgggccaattctgcagggactggcacggccggccaacgatctttcgcggggctgcagtgccgacgacgtcttccacatgattgcggttacagtcgtccaggggcgtgaggacaactccaccgtttccgaaaggcgtcaaaacgtcacataa

SEQ ID NO: 925 - DNA, 993 bp, Sinorhizobium meliloti 1021
atgaaacctctcgatcgcatcatcgacgccgcaaggaaagcgccgcggcacgtcgtccttcccgaaggcgaggacccccggatcgtcgccggcgccgtgcaggcgaggcgggaaggcctggcggcgattacgctggtcggaaaccgcgaggtgatcacgcagaggctcgcagccctggacgcgatcccgcaggaattccggatcgaggacccggcgtgctctccgcttaccgatgattttgcgactgcctatctcgaacgcagaaggagcaaaggtgtcgatgcggccgcggctcgggcggccgtcctgtcaccgctgaccttcgccgcgatgatggtgcgcgaaggaatagccgatgggactgtcggcggcgcggtcgcgacgaccgcagacacggttcgtgccgcattgcaggtgatcggcagggcgcccggcgtcgggctcgtctccagtttcttcctcatgatgctctgcgagccccatcacgcgcggaagggcgccttcgtctttgcggattgcggcctggtcgtggacccggacgcagccggtctcgccgacatcgcgcgcatgtcggccaagtcctatgaaatgcttgcaggagaacgggcgaaagtcgcgatgctctctttctcgacaggcggcagtgccgctcacgagcgcgtttcgaaggtcgtcgaggcgaccggcatggcgcggcgcgccgagcccgatcttatcatcgacggcgaattgcagttcgacagcgccttcgtcgaggccgtctgtctgaccaaggcgccgcattcggcgctgcgcggggaggccaatgtcttcgtgttcccgaacctggacgcggccaatatcggctacaagatcgcccagcggatcggcggcgcgacggcaatcggcccgatcctccagggactttcacggcccgccaacgatctttcgcgcggctgcactgcggccgacgtcttccatatgattgccgtgaccgtcgttcaggcagcatga

SEQ ID NO: 926 - DNA, 969 bp, Ochrobactrum intermedium LMG 3301
atgctgccattggaaaagatttttgaaaaagcgcgttcaaggccgcgtcacattgtgctggccgagggcgaagacccgcgcataatcgacgcggcgctgcgtgcggagcgcgaaggcattgcccgcatcacgcttctggggtccgaaaacgttgtcggcaatggatcatcaattgcagttatcgatcccaagacatcggatagaagcgcggattatgcgcacaagctctaccagctgcgccaggccaagggcatgacggaagaacaggccgaggcgatggtgaagacgccgctcggctttgctgccatgatggtgcgtgaaggcgatgctgatggaacggttgccggtgcggttgcgacgacagctgatgtggttcgccacgcgctgcagatcatcggcaagggcgaaggagcatcgcttgtttcaagctttttcctgatgcttttatgtcagacctatcatcagaagaaaggcgctttcgtctttgccgattgcggcctcgtggtggaaccggatgccgcacagcttgccgatatcgccatccagtcggcagactcttatcgtcagcttaccgaaaaagacgcagccgtcgccatgctgtccttctccaccggcggcagtgccgcgcatgagcgcgtgtcgaaggtggtgcaggcgacgcggacggtcagagaccgggagcccgatctgtgcatcgacggcgaacttcaattcgacacggcttttgtggaggcgatcagccacgcaaaatcgccggattcacccctgaagggcaacgccaacgtgttcgtgtttcccaatctcgaggccgccaatattggctacaagattgcccaacgcatcggtggcgcacaggccatcggtcccgtgcttcaggggttggccaaaccggccaacgacctttcccgcggttgcagcgctgacgatgtcctccacatgatcgctataaccgtcaatcaggcaaagtga

SEQ ID NO: 927 - DNA, 978 bp, Ochrobactrum anthropi ATCC 49188
atgctgccgttggaaaagatttttgagaaagctcgttcgaagccacgtcacatcgtgctagccgagggcgaagacccgcgcatcatcgatgcggcgctccgtgccgaacgcgaagccattgcccgcatcacgcttctgggctccgaaagcgtcatcagcaggcagattgacggctcaaagatcgcgatcatcaacccagagacatcggacaaaagcgcggattatgcgcaaaaactctatcggctgcgtcaggccaaaggcatgacggaaggacaggctgaggcgatggcgaagacgccactcggcttcgccgccatgatggtacgcgaaggcgatgcggatgggacggtggctggcgcagtcgcaacgacagccgatgtggtgcgccatgccctgcagatcatcggcaaggccgaaggcgcatcactcgtctcaagcttcttcctgatgctgctgtgccagtctcatcatcagaagaaaggcgctttcgtctttgccgattgcggcctcgtggtggaaccggattccgcacaacttgccgatatcgccatccagtcggcagattcataccgccagctcacggaaaaagatgcggccgttgccatgttgtccttctccaccggcggcagcgctgcgcatgagcgcgtatcaaaggtcgttcaggcaacccggacggtgcaggagcgtaagcctgatctgtgcatcgatggagaattgcagttcgacacggcattcgtcgaggctatcagccatgccaaatcgccggactcaccgctcaagggcaatgccaacgtctttgtgttccccaatctcgaagccgccaatatcggctacaagattgcccaacgtattggtggggcgcaggccataggcccagtgcttcagggcctcgccaaacccgctaatgacctctcacgcgggtgcagcgctgacgatgtcctccacatgatcgctataaccgtcaatcaggcaaagtga

SEQ ID NO: 928 - DNA, 1035 bp, Burkholderia phytofirmans PsJN
atgaaagccatcaaccgcatcattgaacaagcgcgccgttcgccgatgcgcatcgtgctgagcgaggccgaggatccgcgcgtgttgcaggcggcgcaacgcgcgacccgagaaggcattgcgcgcattctgctggtgggcgacgccacgcgtatccgcgaggctgccgccggcttcgacgtcgatctatccggtatggaattggtggaccctgctacttcggcgctcgcatcgtcatatgccgacgaactgttcgcattgcgcagcaagaaaggcatgacgctcgaacaggcgcggaaagaaatcctcaacccgctgtgcttcgcgaacctgatggtgcgtctcggccatgccgacggttccgtgtccggcgcggtcaataccaccgccgacgtggtgcgcactgcgatccagatcatcggcattgcgccgtcgttcaagctcgtctcgagtttctttctgatgatgctgtgcgagccgttccacacgctcaagggcggcctgatcttttccgactgcgcgctcgtagtggaacccgatgccgcccaactcgcggagatcgcgatggccgcggcggacagcgcaagaagcctgctgatggatgagccgcgcgtggccatgctgtcgttttcgacgagcggcagcgcgcatcatgcggcagtcgacaaagtggtcaacgcaacccacatcgtgcaggaacgccgcccgcatctcgcgatcgacggcgacgtgcaactcgacgcggctatcgtctccgaaatcgcgctgcgcaaggtcaagcattcgcaggtggaaggccacgccaacgtgctggtgtttccgagtctcgaggcgggcaatatcggctacaagctggccgagcggatcggcggcgcgaaggcgatcggccctttgctgcaaggcctgcgcaagcccgccaacgacctctcgcgcggttgcagcgcggacgacatctactacgtcaccgccgtcaccgcggtccaggcacaagccgcgctcacgcatcccgacgccctcacgccgtctcatacatga

SEQ ID NO: 929 - DNA, 1038 bp, Burkholderia xenovorans LB400
atgaaagccatcaaccgcatcattgaacaagcgcgccgttcgccgatgcgcatcgtgctgagcgaggccgaggatccgcgcgtgttgcaggcggcgcaacgcgcgagccacgaaggcattgcccggattctgctcgcgggcgacgccgcgcgcattcgcgaggcggcggcccgcttcgacgtcgatctgtccgggatggagctggtggaccccgccgcgtcggcgctcgcagcgtcttatgccgacgaactgttcgcactgcgcggcaacaaaggcatgacgccagaacaggcgcagcgcgaaatcctcaacccgctctgcttcgcgaacctgatggtgcgtctcggccacgcggacggttccgtgtccggtgcggtcaacaccaccgccgaggtcgtgcgcaccgcgctccagatcatcggtatcgcgccttcgttcaagctcgtgtcgagcttctttctgatgatgctgtgcgagccgttccacacgctcaaaggcggcctgatcttttccgactgcgcactggtggtggaaccggatgcaggccaactcgcggagattgcaatcgccgccgcggacagcgcgaaaagcctgctgatggacgaaccgcgcgtggcgatgctgtcgttttcgacgagcggcagcgcccaccacgcggccgtcgacaaagtggtcaacgcgacccacatggtgcaggaacgccgcccgcatctcgcgatcgacggcgacgtgcaactcgacgcggcgatcgtctccgaaatcgcgctgcgcaaggtcaaacactcgcaggtggaaggccacgccaacgtgctggtgtttccgagcctggaagccggcaacatcggctacaagctggccgagcggatcggcggcgcgaaggcgatcggccccttgctgcaaggcttgcgcaagccggccaacgacctgtcgcgcggctgcagcgccgacgacatctactacgtgatcgccgtcaccgcggttcaggcgcaggccgcgctcacgcatcccgacgctctcctcacaccgtcccattcatga

SEQ ID NO: 930 - DNA, 1032 bp, Burkholderia phymatum STM815
atgaaacccatctaccgcatcatcgagagcgcgcgccagtcacccatgcgtatcgtgctgtgcgagtctgaggacgcgcgtgtgctgcgcgccgcgcaacgcgcgacgaaggaaggcatcgcccgtatcgtgctggttggagattctgtaccaacccggcaattcgcagcgaaagaagggatcgatctcaccggcattgaccttgtcacgcccgccacttcccccctttcccgcgagttcgccgacgaactcttcgcgctacgcagcaagaaaggcatgacacgagaacaggcgcaacgcgaagtgctcaatccgctttgcttcgcgaacctgatggtgcgcctcgggcacgccgacggatcggttgcgggtgcagtcaataccacggccgatgtcgtgcgcaacgcgattcagatcatcggcattcgcccgtcgtttaagctcgtatcgagtttcttcctgatgatgctgtgcgagcccttccatacgatgaagggtggactgatcttttcggactgcgcgctcgtcgtcgaacccgatgccgtgcaactctccgaaatcgcgatggctgccgcagacagcacccgcgcgctgttgatgcaagaacccaaggtagcgatgctctcgttctcgaccagtcatagcgcgcatcatgccgcagtcgacaaggtcatcgaggcgacgcgtctcgtcaaggaagcgcgcccggatctcgccatcgacggcgacgtgcaactcgatgccgcgatcgtcgccgagattgcgatgcgcaaggtccaccactcgcaggtggaaggccatgcgaacacgctgatctttccgagcctcgaagcgggcaatatcggctacaagctcgcggagcgcattggcggtgccaaggcgatcggtccgctgctgcaaggcctgacaaagcccgctaacgatctgtcgcgcggatgcagcgaggacgatatctactacgtgattgcggtaacctgcgtccaggcgcatgcagcgctcggagtcctgcccgcaaatgaacacgcgtcatga

SEQ ID NO: 931 - DNA, 1038 bp, Ralstonia eutropha JMP134
atgaaacccatcctccgcatcatcgatcgcgcgcgcgccgcgccccgtcgcatcgtcctgtgcgagggcgaggatccgcgcatcctgcaggcagccgaacgcgctgcgcgcgagggcattgcgcaggtcatcctggtgggcaacgcggcgcgtatcaccgatgcagcggcaaaccagggcatcgatctcccgcgcatgaccattgtcgatccggccacatcggcgctgacgccctctttcgcgcaggcgctctacgcgatgcgccagaagaagggcatgacgctcgatcaggcgcggcaagcggtgctcgatccgctgtgcttcgccaacctgatggtgcgacaaggccatgccgacggttcagtggccggcgcggttcacaccaccgcaaacgtggtgcgcaacgcgatccagctgatcggtctggcgcccggattccggctggtttcgagctttttcctgatgatgctgtgcgagccgttccacgcgctcaagggcgggctgatcttctccgattgcgggcttgtggtcgaccccgacgccgaggagctatcggagatcgccatggccgcgtcagacagcgcacgctcgctgctcaatgaagatccgcgtgtggcgatgctgacgttttcgacctgcggcagcgcgaagcatgcggccgtcgacaaggtcgtcgcagccacggagcgcgtgcgcgcgcagcggccgggcctcgccatcgatggcgatgtgcagctcgacgccgccatcgtcgccgagattgccgagcgcaaaattcctcactcccaagtgggcggccatgccaacgtgctggtctttccgaatctcgaagccggcaatatcggctacaagctggccgaacggctcggcggcgccaaggccatcggcccgatgctgcaggggctcaggaggccggctaacgacctttcgcgcggttgcagcgcagaggatgtgttccatgtcatcgctgtcaccgtcgtgcaggcacaagccgcctcggcgcagcaaccatcatccggagagcaggcggcagcatga

SEQ ID NO: 932 - DNA, 1035 bp, Cupriavidus taiwanensis
atgaaacccatcctccgcatcatcgaccgcgcccgcgccgcgccccgccgcatcgtgctgtgcgaggccgatgacccgcgcatcctgcaggccgcgcagcgcgccgtccaggaaggcatcgcgcgtatcgtgctggttggcgacccacgccagatcaatgccgccgcggccatccacggcattgcgctggagggcatgacgctggtcgaccccgccacctcggcgctgacgccgtccttcgcccagcagctcttcgcgctgcgccagaaaaagggcatgacgctggacgaagcaaagcgcgccgtgctggacccgctgtcctttgccaacctgatggtgaggctgggccatgccgacggttcggtcgcgggcgccgcccacaccaccgccgacgtcgtgcgcaacgcgatccagctgatcggcttggcgccgggcttccggctggtgtcgagcttcttcctgatgatgctgtgcgagcccttccacacgctcaagggcgggctgatcttctctgattgcggactggtggtcgacccggatgccgaggccctggccgatatcgccatggccgccgccgacagcgcgcgcgccctgctgaacgacgagccgcgcgtggcgatgctgtcgttctcgaccagcggcagcgcccaccatgccgccgtggacaaggtcgtggccgccaccgagcgcgtacgcgcgcagcgccccggtttggccatcgacggcgacgtgcagctcgatgccgccatcgtcgccgagatcgccgcacgcaaggtcgcgcattcgcaggtgaacggccacgccaacgtgctggtgttccccagcctggaggccggcaatatcggctacaagctggccgagcgcgtcggcggcgccaaggccatcggcccgatgctgcagggactgaacaagccggccaatgacctctcgcgcggctgcagcgccgacgacgtgttccatgtgatcgccgtcaccgtggtccaggcgcaagccaccgcggcgcaggcacccaagggcgagcaggcggcggcatga

SEQ ID NO: 933 - DNA, 1092 bp, Burkholderia multivorans ATCC 17616
atgccgtgccccgtgcgggccgccgcttccggccgttttttcttctgcgagtttccgatgaaagctctcgaccgcattctcgaatccgcgcgccgccggccgatgcgcatcgcgctcagcgaagccgacgatccgcgcgtgctcgcggccgccgcacgcgcgacgcgcgacggcatcgcgcatatcgtgctcgtcggcccgcgcgcgacgatccttgcggccgccgcacgcgacggcgtgtcgctcgacgggatgacgctcgtcgatccggccgcctccgcgtcgcgcgacatgtatgccgacacgctccacgcgctgcgcaagaacaagggcatgacggccgacgtcgcgcgcgacgcggtgctcgaccccttgtgtcacgcgaacctgatggtgcggctcggcgacgcggacggctcggtcgcgggcgccgtgcacgcgacggccgacgtcgtgcgtgcggcgatccagctgatcggcgtcgatccggcgttccgtctcgtatcgagcttcttcctgatgatgctctgcgaaccgttccacacgatcaagggcggactgatcttctccgattgcgcgctcgtcgtcgatccggacgccgagcagctcgccgaaatcgcgatggcggccgccgatagcgcgcaggcgctgctcggcgagacgccgcgcgtcgcgatgctgtcgttctcgacgagcggcagcgcgcatcacgcggccgtcgacaaggtgacggccgcgaccgagcgcgtgcgcgcgcagcggccgacgctcgcgatcgacggcgacgtgcagctcgacgcggcggtcgtcgcggagatcgccgagcgcaagatcgtgcattcgcaggtcggcgggcacgcgaacgtgctcgtgttcccgagcctcgaagcaggcaacatcggctacaagctcgccgagcggatcggccgcgcgaaggcggtcggcccgctgctgcaggggctgcgccggcccgcgaacgacctgtcgcgcggctgcagcgccgacgacgtctatcacgtgatcgcagcgacgacggtgcaggcgcaggccgccgcgcaacgcgtcgcggcgagcgaggcggcacccgcatga

SEQ ID NO: 934 - DNA, 1035 bp, Burkholderia cenocepacia J2315
atgaaagccctcgaccgcattctcgaatccgcgcgccgccagccgatgcgcatcgcgctgtgcgaagccgacgacccgcgcgtgctgcatgccgccgcgcgcgcgacacgcgacggcatcgcccgcatcgtgctcgtcggcgaccgtgcggccatccacgcggcggccgcgcgcgacgcactcgacctcgacggcatgacgctcgtcgatccggccaccgccccgcaacgcgacgcgtatgccgacgcgctgcacgcgttgcgcaaagccaagggcatgacggccgacgccgcgcgcgacgcggtgctcgacccgctctgccatgcgaacctgatggtgcggctcggcgacgcggacggctcggtcgcgggcgccgtgcatgcgacggccgacgtggtgcgcgcggcgatccagctgatcggcgtcgatccggcgttccggatcgtgtcgagcttcttcctgatgatgctgtgcgagccgttccatacgatcaagggcgggctgatcttctccgactgcgcgctcgtcgtcgatccggacgccggccagctcgccgagatcgcgatggccgccgccgacagcgcgcacgcgctgctcggcgaagcaccacgcgtcgcgatgctgtcgttctcgacgagcggcagcgcgcaccatgcggcggtcgacaaggtgacggccgcgaccgcgcgcgtgcgcgaactgcgcccggcgctcgcgatcgacggcgacgtgcagctcgacgcggcgatcgtcgcggaaatcgccgagcgcaagatcgcgcattcgcaggtcggcggccacgcgaacgtgctcgtgttcccgagcctcgaagccggcaacatcggctacaagctcgccgagcggatcggccgcgcaaaggccgtcggcccgctgttgcagggcttgcgccggcctgcgaacgacctgtcgcgcggctgcggcgccgacgacgtgtatcacgtgatcgcggcgaccaccgtgcaggcgcaagcggccatgcaacgggccgcgaccggcgaggtcgcacccgcatga

SEQ ID NO: 935 - DNA, 1038 bp, Photobacterium profundum 3TCK
atgaaagcaattattcgtattgttgaacaggcaaaaaagaaaccggcgtgtattgttttatgcgaagctgaagacccgcgagtactacaagcagcataccgtgttacacaggaagggattgctagcattatattagtgggtaataaatctaatgtgttacgcatagcagcagagcaatttatctcacttgaaagtatggttgtgatcgatccaaaaacttcccctttacgcgaatcttttagccaatgcctttttaatttaaggtctgaaaaaggaatgactttagaaacagccaagcaagaagtgcttaaaccactatgtttttccaatttaatggtaagaaagggaatggctgatggctctgtttcaggggcagtacataccactggtgatgttgttaaaaatgccatccaaataataggaactaaacctgactgtaagttggtgtctagcttttttcttatgatgctttgtcaaccattccatcatctaaaaggtggtatgattttttcagattgtgggctggtggttgatcctaatgctaagcaattagctgatattgcgttatcagcatctgacagtgctcgtggtttattaatggaagagcctaaagtcgctatgctgtctttttcaaccaatggcagtgcaaagcatactgctgttgataaagtggtagcagcttctcaaatcgttcaggcaaaatctcctaatctggctattgatgatgatgttcagctagatgctgctattgtggctgagattgcggataagaaagtaccaggttcaaaagtgaaagggcagtccaatgtgttgatattcccaaatcttgaggcgggaaatattgggtataagttggctgaacgtgttggaggtgctgtcgccattggccccttgctacaagggttggctaaacctgctaatgatttgtctcgcgggtgtaataccgatgatatataccatgttattgctgttactgttgtacaagctcaacagtctgagatagtgaaaaaacgtgccccagaattgacaataacatga

SEQ ID NO: 936 - DNA, 1020 bp, Lutiella nitroferrum 2002
atgagagcactcacccgcatcattgagcaggcccgccacgcccccgcccggatcgccctttccgaaggtgaggaccctcgtgtcctcgatgccgcggtacgggccacgcgcgagggcatcgcccgtatcgtgctggtcggcgaccgcgccgccatcgcggcgctggctcaacaacgcggtctcgacctgagcggcatcgattttcacgaccccgccgacgccccgttgcaggcggagctggcacagactctgttcgagctgcgccagcacaagggcatgacgcgcgaacaggccgacagcgccgcgcgcgacccgctggtctgcgccaacctgctggtgaaaaccgggcgggccgacggcacggtctccggcgcggtacgcaccaccgccgacgtagttcgcaccgcgatccaggtcattggcgtgcagccttccttcaagctggtttccagctttttcctgatgatgctgtgcgagccgttccactcgctcaagggcgggctgattttttccgattgcggcctggtggtggacccgagcgccagcgaactggccgacatcgccttggccgcagccgacagcgcgcgccagctgctgatggaagagccacgcgtggccatgctgtcgttctccaccaacggcagcgccaagcatgcggcggtggacaaggtggcgcaggccgccgcccaggtcaaggcgcagcgccccgagctcgccatcgacggcgacgtacagctcgatgcggccatcgtggcggagatcgccaaccgcaagctgccggactcgcaggtcaagggcaaggccaacgtgctgatcttccccaatctggaagcgggcaacatcggctacaagttggccgaaagagtgggcggcgcggtggccatcgggccgctgctgcaaggcctggccaaaccggccaacgacctgtcgcgcggctgcagcgccgacgacgtgttccacgtcatcgcggtgacggtggtgcaggcgcacgccgcccgcgagacggccacagcgggctag

SEQ ID NO: 937 - DNA, 1074 bp, Vibrionales bacterium SWAT-3
atgaaggcaattgaacggattattgataaggctcacttagatcgtaagcgcgtggtgttgagcgaagcggaagatcctcgagtgctcgccgcagcacgattagcgatagacaaacagctcgcccatatcacgctagtgggggatgagaaggcgattattgaagccgcgcagttgcatcatattaatcttgccggtattcacattgtttcacctcaaacgtcggctctgaaagtcgtattagctgagcgcctatatgagttaagaaaagccaaaggcatgacgtatgaagatgcttttgagaaggttaaagacccacttatttttgccaacttgatggtgagggaagggttagtagacggcacggtaaatggtgcggtgtataccacttctgatgtggtgcgagctgcactgcagatcatcggccctgctcccgatagcgagttggtatcgagtttcttccttatgatgttgtgtgagcctttccataatctaaaaggtggtctgattttcagtgactgtggcttggtgattaaccccaatgaaacggagctggcatcaatcgcggtagccgcttctcaaagtgctgaagcattgctaatggaagagcctaaattggcgatgctctcattctccaccaacggtagtgcgaaacatgagtcggtggacaaggtgcgcagtgctgcgcagatcgtgaaacagcgttgccctggtattgcggttgaccaagatgttcagcttgatgccgcgattgtcaccgaaatcgcggccaaaaagttgcctgattccgaagtgaaaggtcaatccaatgtgttgatcttccccaaccttgaagcgggcaatataggttacaagctggcagaaaggttaggtggtgcggtcgccattggtcctttgctccaagggttgaatcaaccggccaatgacttatcaagagggtgctgcgcagaggatatctttaacgtcattgccgttaccgcggtacaagcgcagcaagggaaagtgtctggttctatggctgacactgaagctaatgttgaagaaagacaagagccgacatttgattttaggtattaa

SEQ ID NO: 938 - DNA, 1074 bp, Vibrio splendidus 12B01
atgaaggcgattgaacggattattgacaaggctcacttagatcgtaagcgagtggttttgagtgaagctgaggacccgcgagtactagcagccgcaagaatggcgatagacaaacagctcgcttacatcaccttagtcggggatgaaccagcgatcatcgctgctgcagaattgcatcaaattgatcttgtaggcattcatattgtttccccacaggcgtcatcactcaaagaagtgctcgctgagcggttgtatacattaagaaaagcgaaaggtatgacttacgatgatgcgctagagctggttctagacccactcgtttttgccagtttgatggtcagagaggggctggtggatggcacagttaatggtgcggtttataccacgtctgatgtggtgcgagctgcgcttcagattatcggccccgcgccagacagtgaattggtgtccagtttctttctgatgatgttgtgtgagcctttccataatcttaaaggcggcatgattttcagtgactgtggtttggtgattaaccccaatgaaaccgagctagcatcgattgcagtggccgcatcaaacagcgctcaaacgctactgatggaagaacctaaagtcgcaatgctgtcgttttcgaccaacggcagtgccaagcacgaatcggtcgataaggttcgtaacgcggctcaactcgtgaaacaacgttgtcccggaatcgccgtcgatcaggatgttcaactcgatgccgcgattgtgactgagattgccgcgaagaagttgccagattcagaggtgaaaggtcaatcgaacgtgttgatattccccaatttagaagccggtaatattggttataagcttgcggaaaggttaggtggggcagttgcgattggtccactgttacaagggttgaatcaacctgcgaatgacttatcaagagggtgtaacgcacaagacatctttaatgtgatcgcggtgaccgcggtacaagcgcagcaaggaaaaacagcaaattcaaagactgacttggcggctgattctgaaaaaagagatgaatcgacatttgattttagatactaa

SEQ ID NO: 939 - DNA, 1050 bp, Vibrio shilonii AK1
atgaaggcgatagaaaggattgtcaacaaagctcacttagatcgtaagagggtgctgttgagtgaagcagaagaccctcgtgtgcttaccgctgctcgcatggctgtcgataagcaattggcatacgttaccttagttggtgacgaacaaaccattgcagaggctgcggagcggtatcatgtgagtctcgctggtattcatattgtttcaccacagagttcaccgcttaaagaagtgttagcagagcggttatatctgctgcgtaaagcaaaaggtatgtcttacaacgacgcgctcgaacaagtgcaaaacccacttattttcgccaacctaatggtcagagaagggctaggcgacggtactgtgaatggtgctgtgtacactacttctgatgtggttcgtgcagcgcttcaaatcatcggtcctgctccagatagcgagctagtatcgagtttctttttaatgatgttatgtgagccttttcataacctcaaaggtggtttgatttttagtgattgcggattagtcattgatccgaatgaagcagagctggcgtctattgcgatttcagcttcagccagcgccaaatcgctattaatggaagaacctaaagttgccatgttgtcgttttccaccaacggtagcgctaaacatgagtccgttgacaaagttcgtaatgccgcacaacttgtaaagcagcgctgccctgacatcgctgttgaccaagatgtacagttggatgcggcaattgttactgaaattgctgcaaagaagctgcctgactcacaagtcaagggcaaatcaaatgtactgatattccccaatttggaagcgggaaacataggttacaagttggcggagcgattaggtggtgcagtagctataggaccgttgttgcaagggttaaatcagcctgcgaatgacctatctaggggatgcagcgccgaggatattcttcatgttattgcggttactgcagtgcaagcccaacaagatcgaaacatcaaacacactccacccgcttcaataaaagaagggataaccaactag

SEQ ID NO: 940 - DNA, 1050 bp, Vibrio coralliilyticus ATCC BAA-450
atgaaagcgataaaaaggatcatcaacaaagctcaacagaatcgtaagcggatcatactgagtgaggcgcaggacccgcgtgtactcgctgcggctcgaatggcagtggacaggaagattgcccacatcactttagttggtgacaaacaagtgattcgtgatgccgccaagttgcatcaggtcagtctggctggggtacatattgtctctcctgacagttcaccacttaaagaagtgctagctgagcgatactacctattgagaaaggcgaaagggttgtcttacgaccaagctctgcaacaagtacaagacccgctgatcttcgccaacctgatggttcttgaaggcttaagtgatggcacggttaacggagcgcagtacacaacttcagatgtggtgagagcagcgttacagatcattggccctgcgccagacagtgaattggtgtcgagttttttcttgatgatgctgtgtgagccgttccataaccttaaagggggattgatcttcagtgactgtggtttagtgatcgagcctaatgaaagcgagttggcctctatcgctgtggctgcgtctcaaagcgcacgtaaccttttgatggaaaaacctaaagtcgcgatgctgtccttttcaaccaacggcagtgccaagcacgaatccgtcgacaaagttcgccatgccgcgcaattggtgaaacagcgatgcccagatatcgctgtcgatcaggacgttcagcttgatgcggctatagtgacggaaattgccgctaagaagctgccagactctcaagtcaaagggcaatcaaatgtacttattttccctaatctggaggcaggcaatattgggtataagttggccgaaaggctcggtggagcagttgcgattggcccgcttttgcaaggtttgaatcaaccggcgaacgatctgtctcgcggctgtaccgccgacgacatcgtgaatgtcattgctgtgacagtagtgcaggcacaagaagagaataacacgcaaccgggcccggttgaccccgcgctcaccagcagcgtgaattag

SEQ ID NO: 941 - DNA, 957 bp, Paracoccus denitrificans
atgaaaccgctcgaccgcatccacgaggccgcgaaggccctggaccgccacatcatcttgcccgagggcgaggatccgcgcgtcgccaaggccgcccgccgcctgctggccggggggctggcgcgcgtcaccctgatgggtgggcccgagatcccgggcgccggccgcatcgacccggccggcgcccccgacctggccgagctggccgaccactggcaccgcatgcgcgccgcccgcggcatgaccgccgagcgcgcgctcaccgagatgcgcgacccgatccgccaggccgccatgcgggtgcggctgggccaggccgacggcaccgtgggcggcgcggtcgccaccaccgccgacaccgtgcgcgcggcgctgcagatcatcggcaaggcgcccggggccggcatcgtgtcgagcttcttcctgatgctgtcctgcgggcccggggcgcccgtcaggggcgggatgatcttcgccgattgcgggctggtgatccagcccgacgcgcgggaactggccgccatcgcgctctcggccgccgacagctgccggcgcatcctggccgaggagccgcgggtggcgctgctctccttctcgaccgccggctcggccgagcatccgagcctcggccgcatccgcgaggccctggcgctgatccgcgccgccgcaccgggtctcgaggtcgacggcgagatgcagttcgacgccgcgctcgacgacgcgatccgggccaggaaggccccggaaagcccgctgaccggacggcccaacgtcttcgtcttccccgacctcgccgccggcaatatcggctacaagatcgccgagcgcctcgcaggcctcaccgccataggacccatcctgcaaggcctcgcaaaacccgcaaacgacctctcgcgcgcctgctcggtccaggacatcgtaaacgcaacagcaataaccgctatgcagacgaaatag

SEQ ID NO: 942 - DNA, 999 bp, Rhodobacter sphaeroides 2.4.1
atgaagccgctcgagcgcatccttgccacggcccgcgcccacccgcgccatatcctgctgcccgagggtgaggatccgcgcgtggcccaagccgcgcggcgcctgaccgaggaggggctcgcgcgcgtgagcctgatgaacgggcccgagatcgcgggcgtgacccggatctgcccggccgaggcgtcggatctgcccgagctcgccgaccgctggcacctgatgcgggcggccaagggcatgaccggcgcgcaggcgctgatcgagatgcgcgacccgatccgacaggccgcgatgcgggtgcggatggggctggccgacgggacggtggcgggggctgtcgccaccaccgccgacacggtgcgggccgcgctgcagatcatcggccgggccgagggcgcgccgctcgtctcgagcttctttctcatgctcgcctgcgagggcggggcgccgatccggggcgggatgatcttcgccgactgcgggctggtggtcgatcccgacgcagaagggctcgccgccatcgcccgcgcctcggccgagagctcccggacgcttctgggcgaggagccgcgggtggcgcttctgtccttctcgaccgccgggtcggccgatcatccgagcctcggcaagatccgcgaggctttgcgcctgatccgcgcgaccgatccgacgctggaggtggatggcgagatccagttcgacgcggcgctggacgaggcgatccgcgcgcggaaggcgccgggcagccggctgacggggcggcccaacgtcttcatcttccccgatctcgcctcgggcaacatcggctacaagatcgcgcagcgtctgggcgggctcggcgccgtgggcccgatcctgcaggggctcgcgcggccggcgaacgacctgtcgcgcggctgcacggtcgaggacatcgtccatgccgcggccatcaccgcggtgcaggcggccccggaccccgccgccgcgcccgaggggctggccgcggcgcgctag

SEQ ID NO: 943 - DNA, 969 bp, Castellaniella defragrans
atgcgcgcacaggacatgctgctggatgccgcccggcgcgacccgaagcggatcgtcctgtgcgaaggggacgacccccgggtgaaggctgcggcccgccgggcggccgccgacggcatcgcccaggtccttctgctgggatcgtcggaggacgtcccgggcgtgcatggcatccggcccgccgattccggctggctggatgcgttcgccgaggaactgctgtccctgcgccgcgcacgcggcatgacgccggaacaggcccgggaggccgtgcgccagccgctggtcttcgccgccttgatggtgcggctcgggcacgccgacggctccgtcgccggcgccgtccacaccacggcggacgtcgtgcgcaccgccatccaggtcatcggcaagcggcctggcgtgcggaccgtatccagcttcttcatgatgatgcgcgacgagccctttccgaccggggagcatgccatggtcttttccgattgcggcctggtgatcgaacccgacagccgcgaactggccgaaatcgccctggcctcggcgcgcagcgcccggactctgctggggatcgagccgcgcgtggccatgctctcgttttccacccacggcagcgccgcccatcagcagatcgacaagatccgcgaagccatggcactggcccggcggcaggcgccggacctgctcatcgacggcgaaatgcagctcgataccgcgatcgtgccggaagtcgcccggcgcaaatggccgcagtcctccgtggcgggccaggccaacgtgctggtctttcccagcctggacgccgggaacatcggctacaagctcgtcgagcgcctgggccatgccaccgccctggggccgatcctgcagggtctggacaagccggccaacgatttgtcccggggctgttcggcggacgacatccaccaggtgatcgccgtcaccgccgtgcaggcggcctggacggactga

SEQ ID NO: 944 - DNA, 987 bp, Roseovarius nubinhibens ISM
ttgcttctggcggcgccgccagccaatcgcgcgaccatcgcgctgagcgagggcgaagacccccgcatcgtcgaaggggcgctggcggctcaggccgccggggccgccgacatcatccttgtgggtcagggcgacgcggtccgcgccgaactgacccgacagggcgcagaggaggggcccggcatcgccgtgcatgaccccgaaacctctgatcttacagatagttttgccaaatcctttcacgcgctgcgccagcataagggcgtcgacgaggccgcagccgcccgcgccgttcgtgcgccgctgacctatgccgcgatgctggtccgcgaaggccatgccaccggcaccgtgggcggcgccgtcgccaccacctcggatgtggtgcgcaccgcgctgcaggtgatcggcaaggcccccgacgccgccatggtgtcgagctttttcctcatgtacccgcccgagggcaccgagaccggccgcaccatgctctattccgactgcggtctggtgatcgaccccgccgccgacgagctggccgagatcgccgccatgtcggcccgctcttgccgcgccctgatgcgcgaagagcccaagatcgccatgctgtccttttccaccatgggcagcgccaaacatgaccgggtgaccaaggtcaccgatgcgctggccacgctgcgcgcgcgccaccccgatctcgaggccgatggcgagctgcagttcgacgcggccttcgtgccctcggtgggcacggccaaagcccccggcagcgccgtcgccggtcaggccaatgtcatgatcttccccaatctcgacgcgggcaacatcggctacaagctgacccagcggctcggcggatatgcggccatcggcccgatcctgcaggggctggcccatcccgccaacgacctgtcgcgcggctgcgtggccgaggacgtgacccagatgatcgccgtcaccgtgctgcaatccatggcggccggctga

SEQ ID NO: 945 - DNA, 1014 bp, Ruegeria pomeroyi DSS-3
gtgatgacgcaaacgccgattgatctgctgctgtctgatcccccggcccggcgcgcaaccgtcgcgctgagcgaaggcagcgatccccgcgttgtcgcgggggcgctggccgcccactcggcggggatcgcggatgtgatccttgtcgggcaggcggcagaaatccgcgccgcgttgaaggcgcaaggcgcgcctgccgacagtctgaccatccacgatccggacagttctccgctgaccgccgaatttgccgccgcctattacggtctgcgtcgccacaagggtgtgagcgaagcagcggcgctggctgccgttcgcactccgcttgtctatgcggcgatgctggtgcgcggcgatcatgcggtgggcacggtcggcggggcggttgccaccacgtccgacgttgtgcgcaccgccatccaggtgatcggcgccgcgcccggcgccgcgatggtgtcgagcttcttcctgatgtatccgcccgaggccgccaccgcccatgcccgcgcgatgctctattccgacagcgggctggtgatcgacccatcggtcgcggaactggccgccatcgccgcagcatctgccgcttcgtgccgggcgcttttgcgggctgagccgaagatcgccatgctgtccttttccaccaagggcagcgcgcggcatccccatgtctccaaggtcaccgacgcgctggcccggttgcgcgcggatcatcccgatctggacgcggatggcgaattgcagttcgacgccgcctttgtgccctcggtcggtgcctccaaggcgccggggtcggatgtggccggacaggccaatgtgatgatcttccccaatctggacgcgggcaacatcggctacaagatcactcagcgcctgggcggatacacggccatcggcccggttctgcaagggctggcgaaaccggcaaacgacctgtcgcgcggatgcgttgcaggcgatgtcacccagatgatcgccgtcaccgttctgcaagccatggcgcaaacgcaatga

SEQ ID NO: 946 - DNA, 990 bp, Roseobacter sp. AzwK-3b
ttgttgctgtcacaggcgcttgcgacccgttgcaagatcgctttgagcgaaggcagtgacccccgcatcgtcgcgggggcgctggccgcgcaaagacagggtcttgccgatgtcatccttgtcggggatgcggcggccgtgcggaaggaattggaggcccagggtgccaaggagggcgatggcgtctcggtcgaagatcctgcgacctctcccctgacgaacgggtttgtcgctgtgttcgaagacttgcgccgccacaagggcattgatgccgaggctgcgcgcaaggcggttttgtccccgcttgtctttgccgccatgttggtgcgcgaaggtcacgccgacggtacggtgggcggcgcggtcgcgacgacctcggatgtggtccgagcggcgctgcaggtcatcggcaaggcgccggatgcggctctcgtgtccagtttctttctgatgtacccgccaagcaatgcgacgccccatgcccgcgcgatggtctattccgacagcgggcttgtgatcgatccgaaccccatcgagcttgcctcgatcgcggcggcgtcggcgcgctcttgccggaccttgctgcgcgaggatccgaaagtggcgatgttgtcgttttccacaaagggcagtgccaggcacccgcgtgtgagcaaggtgaccgaggctctcgatcatctgcgtacaaagcatccggatctggacgccgacggggaattgcagttcgatgcagctttcgtcccatccgtggccgcgaccaaagcgccgggctcgaccatcgcgggacaggccaacgtgatgatcttccccgatctcgatgcaggcaatatcggctacaagatgacccagaggctggggggatattcagcgatcggcccggtgcttcaggggctggtcaaaccggccaacgatctgtcgcgaggctgcgtggccgaggacgtgacgcagatgatcgccgtgacggttcttcaggcgctggaccggtcatga

SEQ ID NO: 947 - DNA, 1020 bp, Roseobacter sp. SK209-2-6
atgacccaagctctgtctccttcagctctgctcggccagacgcctgcatcctcgcgcgctgtgatcgctctcagtgaagggagtgatccccgcattgtggctggcgccatcaaagcacgcagccttggattggccgatatcgtactggtcggtgcaaccgcggaagtcgaagctgagctcagcgcgcagggcacttcctccggccccggcctcaccattcaggaccctgccaaatcccccttcacttccgatttttccaaatccttccacgcattgcgcaaacataagggtatgacacctgaaaaggcagcggaaatggtgcaagacccccttgtctttgccgccatgctcgtgcgcgaaggccatgcaaccgggaccgtaggtggcgctgtcgccaccacttcggatgtggtgcggaccgcccttcaggtgattggcaaggccccggatgccgcgatggtttccagcttcttcctgatgtatcccccaaaaaatgcaaccgcgcacagtcgtgccatgctctattcagactgcggcttggtcattgatcctagcgcagaggatctggttgccattgccagcgcctctgccctgtcttgccaaaacctcctgcggcaggaaccaaagattgcgatgctctccttctcaaccaaaggcagtgcacgccatccggcggtcaccaaggtaagcgaggccaccgcagcgctgcaccaaacacgcccggagttgcaagtcgacggcgagcttcaattcgatgcggcctttgccccagaagttggtgagaagaaatctcctggctccagtgtggcaggccaagccaacgtgatgatcttccctaatctggatgccggcaatatcggctacaagatcagccagcgcctgggcggctatagcgccatcggacccattctgcagggactggcgcagccagccaatgacctctcacgcggctgtagtgcagaggatgtggtggagatgattgccgtaaccgtgttgcaggcacaaaacgccggatcatag

SEQ ID NO: 948 - DNA, 942 bp, Roseobacter litoralis Och 149
atgagcgaaggcaccgatccccgcgttgtcgagggggcggtgacggctgtcaaatccggcatcgcccgcatcaccctgatcggtcccgaggacgcggtgcaggccgcacttgtgcgcgcgggcttgcccaacgccccggccatcgcaatcgaagaccccgaaaactccgccctgacggatgaggtcgcaaccgccctgcacgacatccgcaagcacaaaggcatgacgccacaggttgcagcgcggcgcgcgcaggatcctctggtctttgccgccatgatggtgcgtctgggttatgccgacggcactgtgggcggggctgtacacacaacatccgataccgtccgtgccgccctgcaggtcatcggcaaggcaaaagacgcccctctggtctcgggctttttcctgatggccctgccggaaaaccacccctccgggcgcgatgcgatgatcttcagcgactgcggcctcgtgattgaccccacctgcgaggaactcgcggcaattgcggtggcatcggcggcctcatgccgccacttgctgggcaaagagccccgcgtcgcactgctgtccttttcaaccaagggcagcgcgcaccacgaaaaggtcagcaaagtcaccgatgcgctggacctgttgaaacagaaccacccgacgctcaaggccgatggcgagttgcaattcgacgcggcatttgttcctgcggtcgccgcctccaaagccaaagattccgaggtggcaggcactgccaacgtcatgattttccccaaccttgatgcaggcaacatcgggtacaaaatcgcgcaacgcatcggcggctgcgatgccatcgggcccgtccttcaggggctggccaaaccggccaatgatctgtcgcgcggttgcgtcgccagcgatgtcacgaatatgatcgccgtcaccgtccttcaggccagagcctga

SEQ ID NO: 949 - DNA, 1008 bp, Jannaschia sp. CCS1
atgggcggggggccagatgatccgctggccgccattgccgcccgtgccgcggcagatatcaagcacatcgtgctgagcgaaggcagtgatccgcgcgtgcaagacgccgcgcgggtcgccgcagaaactggtttggcgcgggtcacgattgtgggaccaagcgcccttgcgggacagatcgggggcgcagtcgccgtcgaagatcccgacacatcgccgcatcttccggctttcgcaaaggccttccacgcattgcgtgcccataagggcgtgaccgaggaacaggccgccgaaatcgtccgccaaccccttgtttttgcagccatgatggtgcgagagagtctggccgatggaacggtcggcggggcggttcacaccacgtctgacaccgtccgcgcggcgttgcaggtgatcggcaacgcaaagggggcggccctcgtctcgtcgttcttcctgatggcgctgcccaaggggcaccccacgggtgaacagggtatgatcttctcggattgcgggttggtcattgatccctccaccgaggagctggccgccatcgcacaacaggcggcggcgtccgcgcagacgctgctcggcaccccacccagggttgccatgctgtcgttttcctccaagggcagcgcgcggcacccgagcgtcgacaaggtcgtccaggcgaccgctctggtgcaggccgccgcccccgatctggatatcgatggagagcttcagttcgacgccgcaattgtgccgtccgtcggtgcgtccaaagcctccggatcagcggtcgcaggccacgccaatgtcctggtgttccccaatctcgacgcaggcaatatcggttacaagattgcgcaaagactgggcggcgcgacggcgattggacccgtgctgcaaggcttggccaaaccggcgaacgatttatcgcgcggctgcacggccgacgacatcgtgcagatcatcgcggtcacggcggtccaggcccaggcccaggcccaggcgagcagctga

SEQ ID NO: 950 - DNA, 1053 bp, Rhodobacterales bacterium HTCC2083
atgtctagcaaaacgaacccatccgctttgctagatgaagcaaacacgctcccgccgcttgcgtctttactgacgcgggcggcggcggcccctaaatcgattgccttcgctgaaggcagcgatccgcgtattgttgaggcagcggttgctgccttaaatgcgggcgtaattaaacaagcgcatcttgttgggtctcaagcagatgttgagaccacgctggctacgtttgaattgctggatacatcaagaatcgaaattcacgaccccgaaaattctagaattttcgacgccctcgccgaacgctttgtggagctacgcgcgcacaagggtttgactatagagcttgcgcagaaagcaacgcttgatccgttggtcttcgctgctttattggttgaaacgggtcgcgcagatggctccatcggtggtgcaattgcgacaacttctgatacggtacgcgccgcattgcaggtgattggcaaagccaaaagcgagcctttggtatcgtccttcttcttgatgattttgccggaaagtcacccccttgatcgtccggcgatggtcttttctgattgcggtatggtgattgaccctaacgcaactgaacttgcgggcatcgcatcacaagcagccgacagtttcgcggctttggtcggcgatgcgcccaagcttgggatgctgtctttctctacacatggctccgccaagcatgaccgtgtcacgaaagtccaagaggcgacgaaagccttaaaagtagcgcgccctgatttgacggtggacggtgagttgcagctagatgcggcgcttgtcccctctgttgccgcctccaaagcgccaagcggtgctgtgcaaggtgaagcgaacgtgctgatctttccgaacttggatgcgggcaatatcggctacaagttggcacagcgctttggtggtgcagtggcgattggtcctgttctgcaaggtcttgcgaaacctgcaaatgatctgtcgcgtggctgtgtggcgggcgatgttcttgccatgattgctgtaacggcgctgcaagctcagacctcatga

SEQ ID NO: 951 - DNA, 996 bp, Candidatus Solibacter usitatus Ellin6076
atggctgcaattcctgaatcggcaaagctcttcatgtccgggctcatcgaacgggcccgcaaactgaaaaagacgatcgtatttcccgaaggcgcggatccgagggtgctcgaggcggctgcgcgcctggccagggaaggcgtagtcaagccggtgctgatcggcccacggcctgccaacgcgcccgagggcgtagagttcaccgacccggcgcattcccctctcctcaaaaagtacgcggacctctactacgaacgccgccgcgccaagggcaccacgcaggtggaagccgccgcggtcgccaaaaagcccctctacttcgcatcgttgatggtgggtgcgggtgatgccgatggcagcgtcggcggcgccgtcaacagcactgccgagacggtacgcgccgcattgcacgcggtcggcgtgcacccgcgcgcgcgcctggtatcgagcgtcttcatcatggcgctacaggatctctcgcagggtcacaacggcttgatggccttcgccgattgcgccgtggtgatcgagcccaacgcgatgcagatggccgacatcgcgatcgcgaccgcggagagcacgcgcgtgctgatcgacgcggagcccgcggtggcgctgctcagcttttcgacgcgcggcagcggccgcggaccgatggtcagcaaagtggtggaggctatgcagattctcaaggcgcgcgctcccgagttgaacgccgatggcgaattgcaggccgatgccgcggtggacctgatggtgggcaagagcaaagcgccggggtcgaaggtcgcgggacgggcgaatacgctggtcttcccgagcctggaatcggccaacatcggctacaaactggtggagcggctcggcggcgcgatggccatcggacccttcctccagggtctggccaagccggccaacgatctttcgagagggtgttcggccgaggacattttcaatgtggcggtggtgactgcgctgcaatcggagatacactaa

SEQ ID NO: 952 - DNA, 1002 bp, Desulfuromonas acetoxidans DSM 684
atgcatctggtagatcagatcaaagcaaaagcacgcacgaatcagcagacggttgttttgcccgagggctatgatgaccggatggttcaggcggcggggaaaattgtggccgatggcttggccaacatcgttcttcttggcaatgaagcaaccttgcaggctaaagcggctgaacttggtgtgacccttgatggcgtgacgattctggaaccagcagctgcccctcagcttgaagattatgttgccgagctggttgagctgcgcaagaaaaagggattaacgcctgagcaggcacgggagttgctgaccgcggaggataatctttactttgcctcgatgatggtccgtaaaaatgacgccggtggtgctgtggccggagcgtttaataccacaggtgatgtgttgcgcgccgcttttcaggtgatcggcactgctccgggcatgaagacggtctcgtcggtgtttctcatggtgaccaaaaatcccgattttggcgaaaacggtattctattatttgccgattgtgcagttaatcccaatcccgatgccaaggcgttggctgaaattgccgtctctacggcaagtagctgtaagagtttccttggtgtggatgcgcgtgttgccatgctgtctttttcaaccaaaggcagtgccaaacatgaagatgccgacaaggtgcttgaagccatggccatggccaaggagcttaatccgcaattacagattgacggtgaacttcaggctgatgcggctttgctgcccaaagttggtgaaaagaaagctcccggttctgtagtggcgggtaaggccaataccctgatcttcccggatctggatgccggcaatatcggctacaaactggttgagcgggttgccggtgctgaagcggttggcccgatcattcaggggctggctaagccggtcaatgatctgtcgcgcggttgttccgtggatgacattatcagtgtttcagcgattacagcggtacaagcgcagggctag

SEQ ID NO: 953 - DNA, 1002 bp, Pelobacter carbinolicus DSM 2380
atgcatttagccgatcaaatcaaagccaaagcccgcgaaaaccgccaagttgtcgtattgcccgaaggctacgacgaccgtatgatccaggctgccggccccatcgttaaagacaacctcgcggacgttgtgctgcttggcgagcccgctgccttgcaggccaaagccacggaactcggtgtatccctcgaaggcgtcaccctgctcgaccctaaaagtgctccccagctcgacacctatgccgacgaactggtcgaaatccggaagaaaaaagggctgtccaaagatgacgcattgaaacttctgaccgccgatgacaacctgtttttcgccaccatgatggtacgtcaaggtgatgccggcggatgtgttgccggcgcctacaacaccactggcaacgtactgcgcgctgcgttccaggtcattggccctgcacccggcatgaaaaccgtatcgtcctgctttatcatggtaaccaagaccccggaattcggcgaaaacggtgctctgatttttgctgactgcggcgtcaaccccaatcctgacgcagctgcccttgcggaaatcgccgtttcatcggctcaaagctgcaaaagcttcctcggtgccgaggcccgcgtagcgatgctgtccttttccaccaaaggcagcgcaaagcatgaagacccggacaaggtcattgcggcccttgcaatcgctaaggaaaaagcccctgagctgcagatcgatggcgagttgcaggccgacgccgccctggtacccgcagtaggcaacagcaaagctcccggctcaaacgtcgccggcaaagccaacactctggttttccccgatctcgatgccggcaacattgcttacaaacttgttcagcgtctggccaaagccgaagctttcggacctatcattcagggactagccaaaccggtcaacgacctgtcccgcggctgctcggtggatgacatcatcagcgttaccgctatcactgcggttcaagcccaaggctaa

SEQ ID NO: 954 - DNA, 1002 bp, Geobacter sp. FRC-32
atgcacttaatggagcagatcaaggccaaagcaaaaaaaaacctgcaaactgtcgtgctacctgaaagttatgacgagaggatgctttttgccgctcagaaaatagtggaacaaggtttggccaaaataatcatccttggtaatcagacggaggtttccgccgctgcccagaacaaaggggtcaatcttgcgggagtggagatcctcgatccggcaacctcgccaaaactcgaagcctacatcgatgcactggtggaactgcggaaaagcaaggggttgaccagggaagaggcccgtaaccttctcacggcaaaggattacctgtactatgccggcatgatggtcaggctgggagacgccggaggtgaagttgccggtgccaccggaaccaccggcaatgtgcttaaggctgcatttcagacagttgggacggctccggggatcaaaaccgtctcttcattttttctcatggtcactaaaaataccgacttcggtgaaaacggcatcgtcctttttgccgactgcgccgtcaatcccaacccggatgcccaggccctggccgaaatagccgtcgccaccgcccgcaactgcaaatccttcctcgacgtccccgcccgcgttgccatgctctccttctccaccaagggaagcgcagcccatgccgatgtggacaaggtgctcaaggctctggaaatcgcccgggggatcgatccatcactgcagattgatggggaattgcaagcagatgcagccctgctgccaaaagtcggggaaaagaaggcgcccggaagcccggttgccggtaaggccaacgtcctggtcttccccgatctggatgccgggaatatcgcctataaactggtggaacgtgttgccggggcagaagctatcggaccggtcatccagggacttgcaaagccggtaaacgatctttcccgcggctgctccgtggatgacatagtgaatgtcgcagcaatcacagctgttcaggcacaaggataa

SEQ ID NO: 955 - DNA, 1002 bp, Geobacter uraniireducens Rf4
atgcatctgatggagcagattaaggcaaaggccaagaaaaacctgcaaactgtagttctgccggaaagctatgatgagaggatgctttttgccgctcaaaagatagtggaacaaggtttggccaaaatcatattgctcggcaacccggctgaggtttctgcaacggcgcaagccaaaggggtgaatcttgccggtgtggaaatccttgatccgacggcatcccccaagcttaacgcctatgtcgacgaacttgtggaactgcgcaagagcaaaggcctcagcaaagaagaggcgacaaaactgctgaccgacaaagataacctctattacgcgggaatgatggtacgaatgggcgacgccggcggcgaagtggccggagcaaccggcaccaccggcaacgtgctcaaggcggcatttcagacggtaggcaccgccccgggcatcaaaaccgtttcctcgtttttcctcatggttacccaaaaccctgattttggcgaaaacggcatcctgctcttcgccgattgcgcggtcaaccccaaccccgatgcccaggccctggcggaaatcgccgtagcaacagcccggaactgcacatcattcctcgatgttcccgcccgtgtcgccatgctctccttttccaccaagggaagcgctgcgcacgccgacatagacaaggtactcaaggcgcttgaaattgccaaggggatcgatcccgctctccagatcgacggcgaattgcaggcagatgcggcgctcctgccgaaagtcggcgaaaagaaagccccgggcagcacggtggcaggcaaggcaaacgtcctgatcttccccgatctcgatgcgggcaacatcgcatacaagcttgtggagcgggtagcaggcgccgaagccatcggaccggtcatccaggggctggcaaaaccggtaaacgatctgtcgcgcggctgttcggtggacgatatcgttaacgtagcagccatcacggcggtgcaggcgcagggttaa

SEQ ID NO: 956 - DNA, 1002 bp, Geobacter sulfurreducens PCA
atgggtctgatggaccaaatcagggctaaagcccggaacaacctgcaaacaattgtgctcccggagagctatgatgaccggatgtatgccgccgcccaacagatcgtggaacagggtttggcaaaagtcgtcatgcttggcaatgccgacaccatcgccaggaaagcggccgacctcggcgccaccatctccggggtcgaattgatcgatccggccacgtctcccaagctcaacgaatatgccgacgccttcgtggaactccgcaagagcaagggactctccaaggatgacgcactgaagctcctcactgcggcagacaacctctactatgccggcatgatggtccgccagggtgacgccggaggagaagtggccggcgccaccggcaccaccggcgacgtgctccgggcagcttttcagaccgtgggccctgccaaggggatcaaaacggtttcctcatttttcttcatggtcaccaagaccccgtccttcggcgaaaacggcatcatcttctttgccgactgcgccgtaaaccccaaccccgatgcccaggccctggccgacatcgccgtggccaccgcccgcaactgcaaggccttcctcgacgtggacgcccgggtggccatgctctccttctccaccaagggaagcgcatcccatgccgacgtggacaaggttctcaaggcaatggaactggccaaggccattgaccccgcgcttcagatcgacggtgaactccaggccgacgcggccctccttcccaaggtgggcgagcgcaaggccccgggcagcaccgtggccggcaaggccaacgttctcatcttcccggacctggacgccggcaatattgcctacaagctcgtggagcgagtggccggcgcagaggccatcggcccaatcatccagggcctggcaaagccggtgaatgacctctcccggggctgttcggtggaagacatcgtcaatgttgccgccattaccgcggtccaggcccaaggataa

SEQ ID NO: 957 - DNA, 1002 bp, Geobacter metallireducens GS-15
atgggcctgatggaccaaatcaaggctaaagcccggaacaagctgcagaccatcgtactcccggagagctacgacgaccggatgtacgccgctgcccaacagatcgtcgaacagggtttggcaagggtagtcatgctcggcaatgctgacgccatcgcgaagaaagccgccgacctcggcgccgacatctccaaggtcgaactgattgatccggcctcctccccaaagctcagcgactatgccgacgccctcgtggaactgcgcaagagcaagggactcacgaaggaagaggcactgaagcttctcaccgccgccgacaacctctactatgccggcatgatggtccgtcagggggacgcgggaggcgaagtagccggcgccaccggcaccaccggcgatgtcctccgggcagcttttcagaccgttggcccggccccgggaatcaagacggtatcctccttcttcttcatggtcaccaagaccccgagcttcggtgaaaacggcatcatcttcttcgccgactgcgccgtgaaccccaaccccgacgcccaggccctggccgacatcgccgtggccacagcccgcaactgcaaggcgttcctcgacgtggacgcccgggtggccatgctctccttctccaccaaggggagcgcaacccacgcagacgtggacaaagtcctcaaggccatggaactggccaagggcatagaccctgcactgcagatcgacggagaactccaggccgacgcggcgctccttcccaaggtgggcgagcgcaaggcccccggcagcgccgtggccggcaaggccaatgtcctcgtcttcccggacctggatgccggcaacatcgcctacaagctcgtggagcgcgtcgccggcgcagaggccatcggccccatcatccagggactcgccaagccggtgaacgatctttcccgcggctgttccgtggatgatatcgtcaacgttgccgccatcacggcggtccaggcacaaggctag

SEQ ID NO: 958 - DNA, 1005 bp, Pelobacter propionicus DSM 2379
atgcatcttgtcgaccagatcaaggcaaaggccaaaaagaatctgcaatccgtcgtactgccggagagctatgacgaacgcaccctgtacgcagccgagaaaataattaaagagggactggcaaaaccgattgtcctgggtgatccagccaagattcaggcagaggcaaaggcaaaaggaatcgatctttcaggagtggaactgctcgacccggccacgtctcccaaactggaccaatatgtggctgatctcgttgaactgcgtaagagcaagggactgaccgcagaagacgcgaagaagttgctgaccgcaccggactacctctactatgcaggcatgatggttcgcaatggcgacgcagggggcgaagtcgccggcgccaccggcacaaccgggaacgtgctcaaggcagctttccagaccgtcggccctgccaaggggatcaagaccgtctcctccttcttcctgatgattaccaagacccccagcttcggcgagaacggcatcgtcctgttcgccgactgcgccgttaaccccgaccctgattcacaggcactggccgaaatcgccatagccactgccggaaactgtaaggcttttctggacgtggacgcccgcgttgccctgctctccttctcaaccaagggaagcgccaaccaccccaacgtggacaaggttgccaaggcactggagatcgccaagcagctcaagccggatctgcagatcgacggcgaactgcaggccgacgcagcccttattcccaagatcggcgagaagaaggctccgggcagcagcgttgccggcaaagccaacgtcattgtcttccccgacctgggtgcaggcaacatcggttacaaactggtagaacgcatcgccggcgccgaggcggtcggtccagtcatccagggccttgccaagccggtcaacgacctctcccgcggctgctcggtggacgatatcgtcaacgtcaccgctatcaccgccgttcaggcagcccagagttaa

SEQ ID NO: 959 - DNA, 1002 bp, Geobacter lovleyi SZ
atgcatcttgttgaccagattaagcagaaggcacagaagaatctgcagactgtggtactgccggaaagttacgatgaacggatgctgtatgccgctgaaaaaattgttgccgaggggctggcaaagctggtgattctgggcgaccctgccaagatccaggccgaagccgctgccaaggggatcaatctggccggtgtggaactgctgaacccggccgattcccccaagcttgaccagtacatcgcagactttgttgaactgcgcaaatcaaagggaatgaccgctgaagaggcaaagaagctgctgactgccgatgacaacctgtactatgccggcatgatggtacgcaacggtgacgctggcggtgaagtggccggtgccaccggcaccaccggcaatgtgctgaaggcggccttccagaccgtggggcctgctgccgggatcaagacggtatcatccttcttcctgatgatcaccaagactccttccttcggtgaaaacggcatcatcctgtttgccgactgtgccgtgaaccccaacccggacgcccaggccctggccgagatcgccgttgccacggccggcaactgcaaggcctttctggatgttgaggctcgggtgggcatgctctccttctccaccaagggcagcgcggcccatgccgatgtggacaaggtcaccaaggcagccgaaattgccaagaccatcaagcctgatatccagatcgatggcgagctgcaggctgatgccgccctgctgcccaaggttggcgagaaaaaggcaccgggcagcccggtggcaggcaaggccaacgtgctgatcttccctgacctggatgccggtaacatcgcctacaagctggtggagcgggtggctggtgccgaagcggtcggtccgatcatccagggcctggccaagccggtcaatgacctttcccgcggctgttcggtcgacgatattgtgaatgtcgtagcaatcacggcggttcaggccggtgcgtaa

SEQ ID NO: 960 - DNA, 1002 bp, Geobacter sp. M18
atgccgttggtaaagcagattcacgagaaggcgaaatcaaaactcaagacggtggttttgcccgaaagctacgatgaaaggatgctgtttgccgcccagcagatcgtggaacagggtttggcaaagattatactgcttggcaaacccgaggcgctgcaggcaacggccgcggagaaggggatcagcctctcaggcgtcgaggtcgtcgaccccgccacttcccccaagctcgacggctacgtcggcaagctcgtggaactgaggaagtccaaggggctcacccccgagcaggcgcagcagcttctgaccgcctctgacaacctctacttcgccggcatgatggtgcgtgagggtgatgccgacggcgaagtcgccggtgccaccggcaccaccggcgacgtgctccgcgccgccttccagaccgtgggccccgcccccggcatcaagaccgtctcctccttcttcctgatggcgacccagactcccaactacggcgagaacggcgtcatccttttcgccgactgcgccgtcaacccgaaccccgacgcacaggccctggccgagatcgccatcgccaccgcgaggaactgcaagtccttcctggacgtgccggcgcgcgttgccatgctctccttctccaccaagggaagtgcaagccaccccgatgccgacaaggtgctgaaagccctggagatcgccaaggggatggatcccgagctttccatcgacggcgagttgcaggcagacgccgcgctgatccccgcggtcggtgccaagaaggccccggggagcggtgtcgccggcaaggccaacgtgctggtattccccaccctcgacgccggcaacatcgcctacaagctggtcgagcgcctggcaggcgccaaggccatcggcccggtgatccaggggctggccaagccggtcaacgacctctcccgcggctgctcagtgcaggacatcgtggacgtcaccgccatcaccgcggtgcaggcacaggggtag

SEQ ID NO: 961 - DNA, 1002 bp, Geobacter sp. M21
atgccgttggtaaagcagattcacgacaaggcaaggggcaacaagaagacggttgtcttgccggaaagctatgacgagaggatgttgtacgccgcccaggccatcgtggaacagggtttggcgcacatcatacttttgggaaagcctgaggcgatcaaggccgccgcatcggagaaagggatcaacctggccggtgtcgagatcatcgagcccgccgcttccgacaagctcgcagggtacgtggcgaaactggtggaactgaggaaatcgaaggggctcaccgccgatcaggcgcgcgagcttctctgcggcgcggacaacctctatttcgccgggatgatggtgcgcgagggtgacgccgacggcgaggtggcaggcgccaccggcaccaccggcgacgtattgcgcgcagccttccagaccgtgggccccgcccccggcatcaagacggtctcctccttcttcctgatggcgaccaagagccccgagttcggcgagaacggcgtcatcctcttcgccgactgcgccgtcaacccgaaccccgacgcgcaggccctggcggagatagccatcgccactgcgaggaactgcaagtccttcctcgacgtcccggcccgggttgccatgctttccttctccaccaaggggagcgcgagccaccccgacgccgacaaggtgctcaaagcgctggagctggccaaggggatggacccgaacctcagcatcgacggcgagcttcaggccgacgccgcgctcatcccggccgtaggcggcaagaaagcccccggcagcaacgtggccgggaaagccaacgtcctggtcttccccgacctcgacgccggcaacatagcctacaagctcgtcgagcgcatcgccggcgccaaggcgatcggcccggtaatccagggtctggcgaagcctgtcaacgacctctcccgcggctgctcggtccaggacatcgtggacgtcaccgccatcaccgcggtgcaggcgcaggggtag

SEQ ID NO: 962 - DNA, 1002 bp, Pelobacter carbinolicus DSM 2380
atggacgttatatctcagatcaagcaaaaggcccgtggttgcatgcaaaccatcgtgttgccggaaagttatgatgaccgcatgttgctggcggccgaccaggccacccgggaaggactggctcgcattgtgctgctgggagatcccgaatccgtggcgtccagggccgcgagtgtcggtgccgacctgaacggggtggaactggtggcgcctgccgccagttcctgtttgcgggactatgtcgagcaactggtggaactgcgccggcacaagggactgacggaggatgccgcctgcaagcaattgctggccctggataatctgtttttcgcggccatgatggtgcgcaaaggcgatgccgacggtgcggtggcaggggccttcaacagtaccggcgatgtgttgcgtgcggcattgcaggtggtcggtaccgccgaaggtatccgaaccgtatcgtcggtgatgctgatggtgacaacgaatcccgatctcggtgtaaacggtaccctgctgtttgccgactgtgtggtcaaccccaggcccgatgcacgggcgctggcggaaatcgccgtgaccaccgctcgcagttgtcggagcctgctcggtgtggaggcgcgggtggcaatgctgtcgttttccacccagggtagtgccgatcacgaggaggtggacaaggtgcgccaggccgtggaaatcgcccgcagcctggcgccggatgaactcattgacggtgaaatgcaactcgatgccgccatcgctccgagtgtcgccggcaagaaggccccggattccctcgtggccggtcacgccaataccctggtttttccggacctcaatgccggcaacatcggttacaagctgaccgaacgcatcgccggggcgcgggcggccggactgatggtgcagggactggccaggccggtcaacgacatgtcccgcggctgtaccgtggaggacattgtcagcaccgtggccatgactgccgtgcaggcttgcggataa

SEQ ID NO: 963 - DNA, 990 bp, Denitrovibrio acetiphilus DSM 12809
atgtctcttatggaaaagttctggaatatagcgaagtccagaaacaagacgatcgttctccctgagggggaagacgaaagaacagtcgacgctgcaaacgcaatagccgaaaacggactatgcaaaattatactcctcggtaatgatgtgcaaatcagaaaggcgtttgaatctaaagggtatgaggttcgatgtgagatcatcgatccggaaaaaagtgaatatctggaagattttacaaatacatactatgaaagcagaaaagcaaaagggcttacaaaggaagaagctctggagagcatgaaggatgttctttatttcggggctatgctggtgcagaaggggatcgctgacggtgctgttaccggtgcctgccatacaacaggagatgtgctccgggctgcaatccgcatcataggtacaaaacctgggatgaagacagtttccagctgtttcataatggttcttcctaaaccagaatttggagaagatggtgcagtggtttttgctgactgtgctgtaaatcctaatcctgatgctaaaacattgggagagattgctgttgcggcagcggcaagctgtaagtcatttcttgaggttgagccgaaggttgcgatgctctcattctctacgaaaggttctgcggagcatgatgatgttgaaaaggttcgtgaagcggtgaaagctgcaaaagagcttgcgccggaactttctgttgacggtgagcttcaggctgatgcagctcttctggaagccgtgggtgctaagaaggctcccgggagcgatgtggcggggaaagcaaatgtactagtctttccgacacttgatgcgggcaatatcgggtataagcttgttgagcgccttgcaggtgcagaagctataggacccgttattcaggggctcgctaaaccggttaatgacctctcacgaggatgtaaatatatggacatagtcaacgtagcggctataacggctgttcaggctgactag

SEQ ID NO: 964 - DNA, 1008 bp, Chloroherpeton thalassium ATCC 35110
atggaagttattcgcaaaattcgagaaagagctaagtccaaaaaggcaacaattgtattacctgaagccgatgacgatcgtacgcttatagccgcgtcagaacttgcagaaatggaactggtcaagccggtgctcatcggaaactctgatgacattattgagcgattttctgcattggggctcacttacaactcaaccaaaattaggatcgtcgatatacagaagtctggaaaactttcggatttcaccaatgagtactttaactttcggaagcacaaaggcatttcgtatgaagaagccaaatcagtgatgagctcaccattattttttggcgccatgatggtacatcatcaagaagctgacgggtgtgttgccggagcagtttcaacaacagcggatgtgctccgtgccggaattcaaattattggaatagaaaaagaaaaagcaagacttatttccagcttctttttaatggtttttccagatgatcaccgagctgctcccggacgagctctcacctatgcggactgcgccgttctgcctgacccagacgccgaagcacttgccgatattgccattttaacagcggagtcccatcaacaattgacgggcgaagagccaaaggtggcaatgctatccttttcaacaaaggggagcgcagcacatgaaaacgtcactaaagttcaaaaagcaactgaaattgcgaagcagaaacagcctgatttaaaaattgacggagaaatgcaatttgatgcagcatttatagaggcgattggaaagcgcaaagcccctcaaagcgatgtggcaggaaaggcaaatgtattcattttcccaaacctcgacgctggaaacatcggatacaaattaacagaacgtcttgccagcgcaaccgccatcgggccaattattcaaggacttgtaaaaccaatgaatgatctttcccgcggcgcaaaaccttccgacattgttgatgtttgctgcatctgtgcactgaaaaagcaaagttag

SEQ ID NO: 965 - DNA, 1011 bp, Victivallis vadensis ATCC BAA-548
atgtccatcctgaatacgctcgtcgaacgcgcccgcaaaggcgccaaggtcatcgtcctgccggaaggccaggacgcccgcgtggtcgccgccgccaacaaggcggtcgacgagaaggtcgtcaccaaggcgatcgtgctcggcagcgaagccgaaatcgccgaagcctgcgccaaggccggcgtcaccgaacgcaagttcgaatgcgtcgactacctgaacagcccgctctacaacgatttcgtcgcggagttcaccgaaatgcgcaaggccaagggcatgaccccggaaaaggccgccaagaccatgcagagccggatctatttcggcgcgatgatgtgccgccgcggcctcgcggacggcctggtggcgggcagcatcgcctccaccgcggacatgctccgcgccgcgttccactgcatcggcaccgcgccgggcatgaagatcgccagcagcactttcgtgatggacctgaagaccccggccccggccggagacgatgtgctgcttttcgccgactgtggcgtgaatccgaatccggatgcgaaccagctggtcgacatcgcgctcgcgacctccaatacctatcgcgcattgctcggcaagactccgaaagtcgcgttcctgtccttctcgaccaagggcagcgccgaccatgaaatcctgaacaaggtcaaggaagcggccgcgatgatgcagcagaagatcgccgacgaaaagctcgacatcctctgcgacggcgaactgcaggccgacgcggcgctggttccctccgtcgccgccgccaaagcgccgggcagcccggtcgcgggcgcggccaacgtgctgatcttcccggacctcaacgcgggcaacatcggttataagctcgtgcagcgcctcgcgcacgccgacgcctacggcccggtgctgcagggactcgcgaagccgctgaacgacctgtcgcgcggctgcaacagcgacgacattttcggccagatcgtgatcacggtctgccagacgatgaagtaa

SEQ ID NO: 966 - DNA, 1599 bp, Helicobacter pylori 98-10
ttgctacaattaaataaaaacgataattttagggagattggcgtgcagggtttatggatttacccagaggataccgaagttttaggggtcgcttgtaagagccttttaaaagtgctaaagtcgcactatcaaaaaatcgccttgttttcgcccgttgatggggggtgcgaggacttggaggagtgcgagagcttgaactctttagaatttcatagcgccataaacaaacaaaaggctttagagcttgtaagcaccgctcaagaagagttactatttgaaacgattctcaaacgctatgatgaattacaaaccacgcatgattttgtcattagtttagggtatgcgccgaagtttttcttaaacgctcttttagatttaaacaccattttagccaagcatttaaacgctcctgttgtggctgtcgcgcaaacgagtttggaatatttgaaagccatgcattctcatgttctcaaaaaagaagcccctttcgctgtggggttatttgcgggcgaaatgcttgaaaaacccaattttttgagcgcgtctttttgcaagcaacaatgcgaattagaagcggatctgatagaaagcgtgttgcaaacaaaaagcaagatcaccacccctttagcctttcaaatgggtttggaaaaaaaggctaaaaaacagattaaaaaagtggttttgcccgagagcgaagatgaaaggattttaaaagctgcgcatcgtttgaacgccatgggtgcggtaggattgattttactaggcgataaagaagccattaattcccaagcgaaaaacttgaacttgaatttagaaaatgtagaaatcattgatcccaacacttctcattatagagaagaattcgctagtaatttgtatgaattgcgaaaatcaaaggacttgagtgagcaagaagctaagcaattggtgttggataagacttattttgcgaccatgctcgtgcattcaggctatgcgcatgcgatggtttctggggtgaatcacaccacggctgacaccattagacccgctttacaaatcattaagactaagcccggcgtgagcctggtttcaagcgtgtttttaatgtgtttagacactcaagtgctagtctttggggattgtgcgattatccctaaccctagccctaaagaattggctgaaatcgctatcacttccgcgcaaagcgccaagcaattcaatatcgcgcctaaagtggccttactctcttatgcgacaggcaattccgcgcaaggcgaaatgatagacaaaatcaacgaagctagagaaatcgctcagcgtttggatccgcaattagaaattgatggccctttacaatttgacgcttccattgataaaagcgtggcgaagaaaaaaatgccaaatagccaagtggctgggcaagctagcgtttttattttcccggatttaaacgctgggaatatcgcttataaagcggtgcaacgaagcgctaaagccgtggcgataggacccattttacaaggtttgaacaagcccattaatgatttgagtaggggcgctttggtggaagatattattaacaccgttttgattagcgccattcaagcgcaagattag

SEQ ID NO: 967 - DNA, 1557 bp, Helicobacter pylori B38
atgcaaggtttatggatttacccagaggataccgaagttttaggggttgcttgtaagatccttttaaaagcattgaagccacgctatcaaaaaatcgccttgttttcgcccattaatggggggtgtgagggcttttgggagtgcgagagcttgaactctttagaatttcatagtgccatagacaaacaaaaggctttagagcttgcgagcactgctcaagaagagttactatttgaaacgattctcaaacgctatgatgaattacaaaccacgcatgattttgtcattagtttagggtatgtgccgaagtttttcttaaacgctcttttagatttaaacaccattttagccaagcatttaaacgctcctatggtggctgttgcacaaacgagtttggatcatttgaaagccatgcattctcatatcctcaaaaaagaagcccctttcgctgtagggttatttgcgggcgaaatgcttgaaaaaccggattttttgagcgcgtctctttgcaagcaacaatgcgaattagaagcggatctgatagaaagcgtgttgcaaacaaaaagcaagattattacccctttagcctttcaaatgagtttggaaaaaaaggctaaaaaacagattaaaaaggtggttttaccagagagcgaagatgaaaggattttgaaagccgcgcatcgtttgaacgctatgggtgcggtgggattgattttattaggcgataaagagattattaactcccaagcgaaaaatttgaacttgaatttagaaaatgcagaaatcatcgatcccaacacttctcattatagagaagaattcgctaaaagcttgtatgaattgcgaaaatcaaagggattgagtgagcaagaagctaagcaattagtgttggataagacttattttgcgaccatgcccgtgcattcaggctatgcgcatgccatggtttctggggtgaatcacaccacggctgagaccattagacccgctttacaagtcattaagactaagcccggcgtgagcttggtttcaagcgtgtttttaatgtgtttagacactcaagtgttagtttttggggattgcgcgattatccctaaccctagccctaaagaattagccgagatcgctaccacttccgcacaaagtgctaagcaattcaatatcgcgcctaaagtggcgatgctttcttatgcgacaggcaattccgctcaaggcgaaatgatagacaaaatcaacgaagccctaacaatcgcgcaacgtttagatccacaattagaaattgatggccctttacaatttgacgcttccattgataaaagcgtagcgaagaaaaaaatgcctaacagccaagtggccgggcaagctagcgtttttatcttcccggatttaaacgccggaaacatcgcttataaagcggtgcaacggagcgctaaagccgtggcgatagggcccattttacaaggtttgaataagcccattaacgatttgagtaggggcgctttagtggaagatattatcaacaccgttttgattagcgccattcaagcgcaagattga

SEQ ID NO: 968 - DNA, 1557 bp, Helicobacter pylori Shi470
atgcaaggtttgtggatttacccagagaatacagaagttttaggaatcgcttgcaagagccttttaaaagcgctaaagccgcgctatcaaaaaatcgcattgttttcgcccattgatggggggtgtgagggctttttggggtgtgatggcttgagtcctttagagtttcatagcgccatagacaaacaaaaggctttagagcttgcgagcgctgctcaagaagagttactttttgaaacgattctcaaacgctatgatgaattacaaaccacgcatgactttgtcattggtttagggtatgcgccgaagtttttcttaaacgctcttttagatttaaacaccactttagccaagcatttaaacgctcctattgtggctgtcgcgcaaacgagtttagagcgtttgaaagccatgcattctcacgctatcaaaaaagaagcccctttcgctgtagggttgtttgcgggcgaaatgcttgaaaaacccaattttttgagcgcgtctctttgcaagcaacgatgcgaattagaagcggatctgatagaaagcgtgttgcaaacaaaaagcgagatcaccacccctttagcctttcaaatgggtttggaaaaaaaggctaaaaaacagattaaaaaagtggttttaccagagagcgaagatgaaaggattttaaaagccgcgcatcgtttgaacgctatgggcgcggtaggattgattttattaggcgataaagaagccattaattcccaagcgaaaaatttgaacttgaatttagaaaatgcagaaatcattgatcccaacacttctcattataaagaagagttcgctaacaatttgtataaattgcgaaaatcaaagggcttgagtgagcaagaagctaagcaattggtgctcaataagacttattttgcgaccatgctcgtgcatttgggctatgcgcatgcgatggtttctggggtgaatcacaccacggccgacaccattagacccgctttacaaatcattaaaaccaagcccggcgtgagcctggtttcaagcgtgtttttaatgtgtttagacactcaagtgttagtctttggggattgtgcgattatccctaaccctagccctaaagaattggctgaaatcgctatcacttccgcacaaagcgccaagcaattcaatatcgcgcctaaagtggccttactctcttatgcgacaggcgattccgctcaaggcgaaatgatagacaaaatcaacgaagctgtaaccatcgctcaacatttagatccacaattagaaattgatggccccttacaatttgacgcttccattgataaaagcgtagcgaagaaaaaaatgcctaacagccaagtggccgggcaagctagcgtttttattttcccggatttaaacgctgggaatatcgcttataaagcggtgcaacgaagcgctaaagccgtggcgatagggcccatcttgcaaggtttgaataagcccattaacgatttgagtaggggcgctttggtggaagatattatcaacaccgttttgattagcgcccttcaagcgcaagattaa

SEQ ID NO: 969 - DNA, 1560 bp, Helicobacter pylori J99
atgcaaagtttatggatttatccagaggatactgaagttttaggggctgcttgtaagagccttttaaaagcgttgaagcctcgttatcaaaaaatcgccctgttttcgcccattagtggggggtgtgagggctttggggagtgtgagagcctaagctctttagaggttcatagtgccatagacaaacaaaaggctttagagcttgtgagcaccgctcaagaagagttactatttgaaacgattctcaaacgctatgatgaattacaatccacgcatgattttgtcattaatttagggtatgcgccgaagtttttcttaaacgctcttttagatttaaacaccattttagccaagcatttaaacgctcctgtggtggctgttgcgcaaacgagtttggatcacttgaaagccatgcactctcatatcctcaaaaaagaagcccctttcgctatagggttatttgtgggcgaaacgcttgaaaaaccacattttttaagcgcgtctctttgcaagcaacaatgcgaattagaagcgagcgcgattgaaaatttgttgcaaacaaaaagcgagattattacccctttagcctttcaaaggagcttggaaaaaaaggctaaaaagcagattaaaaaagtcgttttacctgagagcgaagatgaaaggattttaaaagccgcacatcgtttgaatttaatgggcgcggtgggattgattttattgggcgataaagaagccattaactcccaagcgaaaaatttgaacttgaatttggaaaatgtagaaatcattaatcccaacacctcgcattatagagaagaattcgctaaaagcttgtatgaattgcgaaaatcaaagggcttgagtgagcaagaagctgagcgattagcgttggataaaacttattttgcgaccatgctcgtgcatttaggctatgcgcatgccatggtttctggggtcaatcacaccacggctgagaccattagacccgctttacaaatcattaaaactaagcccggcgtgagcctggtttcaagcgtgtttttaatgtgtttggacactcaagtgttcgtttttggggattgcgccattattcctaaccctagccctaaagaattagccgagatcgctaccacttccgcgcaaaccgccaagcaattcaatatcgcgcctaaagtggccctgctttcttatgcgacaggaaattccgctcaaggcgaaatgatagacaaaatcaacgaagccctaacaatcgtgcaaaaattagatccgcaattagaaattgatggccctttacaatttgacgcttccatagataaaggcgtagcgaagaaaaaaatgcctaacagccaagtggccgggcaagctagcgtttttatcttcccggatttaaacgccgggaacatcgcttataaagcggtgcaacggagcgctaaagccgtggcgatagggcctatcttacaaggcttgaacaagcccattaacgatttgagtaggggcgctttagtggaagatattgttaacaccgttttgattagcgccattcaagcgcaagattattga

SEQ ID NO: 970 - DNA, 1524 bp, Helicobacter acinonychis str. Sheeba
atgcaaagtttatggatttacccagaaaatacagaagcgttaaagatcgcttgcgagagccttttaaaggcactaaagccacgctatcgaagtatggcattgtttgcacccattatggataaagaaatttttagtaaaatgcatagcgcgatggataaagacaaggctttagagcttgtgagcgcttctagagaaacgttgttgtttgaaaatatcctaaaaaaatatgatgaaatacaatctatgcatgattttgtcatttgtttagggtatgtgccagattttttcttaaacgctcttttagacttaaacaccactctagccaagcacctaaacgctcccattgtggctgttgcacaaacgagtttagaatatttgaaagccatgcactttcatgccatcaaaaaagaagcccctttcgctttagggctattaaccggcgaaatgcttgaaaaaccggattttttgagcgcgtctctttgtaagggtgtattagaagcggatttgattgaaaaattattacacacaaaaagcgcgctcatcacccctttagcctttcaaaggagtttggaaaaaaaggctaaaaagcaaattaaaaaagtggttttgccagagagcgaagatgaaaggattttaaaagctgcacatcatttgaacgccatgggtgtggtggaattggttttgttgggcgataaagaaacgatccactctcaagcgaaaaatctaaacttgaatttagaaaatattgagatcatcgatccaagcgcctcgcatcatagagaggcgttcgctcaaaaattgcatgaattaagaaaatcaaagggtttaagcgagcaagaagcccaaaaattgattttagataagaattattttgcgaccatgctcgtttatttgggctatgcgcatgcgatggtttctggggcgatccataccacggctgacacgattagacccgctttgcaaatcatcaaaaccaagcccggcgtgagtttggtttcaagcgtgtttttaatgtgtttggacacgcaagtgctagtctttggggattgcgcgatcaaccctaaccctagcgctcaagaattagccgagatcgccatcacttccgcacagagtgccaagcaatttaatattgcacccaaagtagcgatgctttcttatgcgacaggcaattccgctcaaggcgaaatgatagacaaaatcaacgaagccgtaaaaatcgctcacaagctagatccccaattagaaatggatggccctttgcaatttgacgcttctatggataaaagcgtagcgaagaaaaaaatgccaaacagccaagtggccgggcaagctagcgtttttattttcccagatttaaacgccggaaacattggctataaagcggtgcaacgaagcgctaaagccgtggcgatagggcctattttgcaaggattgaataagccggttaatgatttgagtaggggcgctttagtggaggatattatcaacacgattttgattagcgccattcaagcgcaagattag

SEQ ID NO: 971 - DNA, 1536 bp, Campylobacter jejuni subsp. jejuni CG8486
gtgttccacatttataaattcaaggagaaaatgatggcaaatctttatttgatgagatctagaagtgatgagttaaatactattattagtacaaatttgcttaaaaattatagcaaaatttacaaaaatatcgcaatttattgccctgtaatatacatacatcgcgtccctgttttacaaggttggttggaagaatttaatatcaatcaaactgtaaaaagcgcctatggttttacctttagagaagcaatggaggaatttagcaaagatcctcataatttttttaatgttattttagaagaatacgaagagttaaaacgcaaatacgattttgtgcttgtaaatagtttttgcgaatttggaatacttgatggatttgatcttagtataaaattagctaaaaatcttaatacccctatcgctgctattattaacgatgaagataaacttatagctcaaaaatatttcgatcatgccctagatggtcgtaattatgttttgattaatgaaaattttaattttgaagaagtacaaaagcttgaagagtatgattttataactccgcatcgttttaaatatgaattgattaaacaaagcgtaaaaaataaaaaaactgttgttttaccagaaagtaatgatgagagaattttaaaagccgctgaaattttattaaaaagtaaagttgttgatcttattttattgggcgatgaagaaaaaatcaaacaagatgctactagattaagtcttgatttaagtgctatgcaaattatgaatccacttaattcagaatataatcaagaatttacttctattctttatgaaacaagaaaatctaaaggcatgagtttagaagaggctaagatgctagttcaggataaaacttattttggaactttgcttatacatactggaaaagctgatgctatggttagtggagcatcaactactacggctgaaacgattcgccctgcattacagcttattaaaactaaagaaggcattagttccgtttcaggaattttctttatgggacttgaagatcaagttttagcttttgctgattgtgctgtaaatccaagcccaagtgctgagcaacttgcaactagtgcctatgtaagtgctatgactgctaaatcttttggacttgaaccaagaatagctttgctttcttattctagtggtgatagcggtaagggagaaagcgtagatcttgtaaaagaagcattaaagattgctaaagaaaaatatcctgagttaaatatagatggtcctatgcagtttgactgcgcttatgatccaaaaactgcagcaaagaaaatgccaaattctaagatagcaggtcatgcaaatgtgtatatttttcctgatcttaacgcagcaaatatttgttacaaagcagttcaaagaactgctaatgctttagcaatcggtcctattttgcaaggtcttaaaaaacctgttaatgatttaagtcgtggatgtttggtagatgatattgtagatactgtaattttaagtgcaatacaagctcaatag

SEQ ID NO: 972 - DNA, 1503 bp, Campylobacter coli RM2228
atggcaaatctttatttgatgagatctaggagtgatgagttaaatacattagccaccacgaaattattgaaaaactatagcaagatatataaaaatatagctatttactgtcctgtgatttatgtacatcgtatccctgttttgcaaggatggcttgaggaatttgatattaagcaaactttgaaaaatgcttatagttttacttttagagaagctatggaagaatttagcaaagatccgcatagttttttcaatactatcttagaagagtatgaggaattaaatcgtaaatatgattttgttcttgttaatagtttttgcgaatttggaatacttgatggttttgatttgagtataaaattggctaaaaatcttaacactcctatagcggctattattaataatgaggataaattaatagctcaaaaatattttgatgaagctttagatggtagagattatgctttgattaatgaaaattttaattttgaagaaatgcataagttgcaagcttatgattttatgactccgcatcgttttaaatatgaactcattaaaaaaagtgttaaaaataaaaaaaccgttgttttaccagaaagcaatgatgaaagaattttaaaagcagttgaaattttacttaaaagtagtgtagtggatcttattttattgggtgatgagcaagatatcaaacaaaaagccgatgaattggcacttgatttaaccgcagtaaaaatactcaatccgcttcattcagaatataacgaagaatttgccactttgttatatgaagcaagaaaatctaaaggaatgagccttgaagaggctaaagaattggttaaagataggacttattttggaaccttgttgatacatagtgggaaagctgatgctatggtaagtggagcatctactacgacagctgaaactattcgtcctgcgcttcagattatcaaaactcaagagggtgttgactctgtttcgggaattttctttatggggcttgatgataaggttttagcttttgcagactgtgctgtaaatccaaatccaaatgccgagcaactcgccgctagtgcttatgtaagtgctatgactgcaaagtcttttggtatcgagccaaggatagctttgctttcttattctagtggagatagcggtaagggtgagagtgtagatcttgttaaagaagctttaagaattgctaaagaaaaatatccagaattaaatatcgatggccctatgcaatttgattgtgcttatgatcctaaaactgctgctaaaaaaatgccaaattctaagatagcaggtaatgtaaatgtatatatctttcctgatcttgacgctgcaaatatttgctataaggctgtgcaaagaacggcaaatgctttggcaatcggtcctattttgcaaggacttaaaaaacctgtaaatgatttaagtcgtggatgtttggttgatgatatagtagatacggttattttaagtgctatacaagcacaataa

SEQ ID NO: 973 - DNA, 1503 bp, Campylobacter upsaliensis RM3195
atggcaaatctttatcttatgcggtcaaaaagcgatgatttaaataccctcatcactaaaaaacttttagcaaactacacaaaacattataaaaatgtagcgatttactgccctgtgatttatgtgcatagaatagccgccgtgcaggagtggcttgaagaatttaacatcaaacaaagctcaaaagaaagttacggctttaccttacgcgatgcgatgaatacctttagccacgattctcactattttttcaacaaaattttagaagaatatgaaaatttaaaagctaaatatgactttgttttagtaacaagtttttcggaatttggcattttagatggctttgaattaagcgttaaacttgctaaaaatcttaacacccccatagccgccattatcgaccaaaaagaccaaaatatagcaaaaaagatctttgatgaaagtcttaagggggaaaaatacgccttaattgacgcaaattttgattttaatgagcttataaatttaaaagaatatgaatttatcacacccaatcgttttaaatttgagctaattaaaaaaagtgtgaaaaataaaaaaatcgttgttttgccagaaagcgatgatgagagaattttaagagcaagtgaaatcctacttagaagcaatgttgtccatctcatcttgcttggaaatgagactaaaatcaaagaagatgccctaaagcttggactagatcttaatggcattgaggtgctagatcctgcaaattcgcccttatgtgaagaatttagcgctatgctttatgaggcaagaaaggctaagggtatgagcctagaagaagccgctaaactcgttaaagatagaacttattttggcactttacttgtgcatagtcaaaaagccgatgctatggtaagtggtgcttcaacgactacggctgaaactatacgcccagcccttcaaatcatcaaaacaaaagaagggatcaattccgtctctggcattttctttatggggcttgaagataaggttttagcctttgcggactgtgcggttaatcctaatccaacagccgagcaactcgctcaaagtgcttatgtaagtgctttgagtgctagggcttttgggcttgaaccgcgtattgctatgctatcttattctagtggagatagtggcaagggtgaaagtgtagatttggtcaatgaggctttaaaaatcgctaaagaaaaatatccagaccttcaaattgatggacctatgcagtttgactgtgcttatgatagtaaaaccgctgcaaaaaaaatgccaaattccaccatagcaggcaaggcaaatgtttatattttccctaatcttgacgcggcaaatatctgctataaagccgtgcaaagaacggcaaatgcccttgccataggaccaattttacaaggacttaaaaagcctgttaatgatttaagtagaggctgtttggtcgaagatatagtcgataccgtaatattaagtgcgattcaagcacaataa

SEQ ID NO: 974 - DNA, 1470 bp, Campylobacter lari RM2100
atgaaatccatgtttttaataaattgtgttgatgagaaatttttaacacagtctttagaaaaagttcaaggtaaaatagctttttattttcctgttttttgtgaaaaaaataaagaaaaaattgctttaatatgctcaaaaaccaatttcaaactagatttttttagtagttttgaaaaaaataattatcaaagcaaatttacccaaaattcaaatgatttttttaaaaaaataattcaagattatgaaaaattaaaaaaagaaaatgattttgttatagtggttggagtagatgattttggcttgatgggggatttgagtttaaatatagccttagctaaagagctaaatgctccactgtatgcaaaaagtcaagatgaaaatcatactatgttaaattttttactaagtcaaaagcttagcgactttgttttgttaaaagaaagtgaagattttactcaagatttattacaagaatatacctataaaactcaggcaagattttcttatgagctttttgaaaaagcaaaagcagataaaaaaatagtggttttacctgaaagttttgatgaaagagtgttaaaagctagtgagtttttaatgcaaaatgagattgttgatttgattttactaggtgatagcaatgaaatttgcgctaaagccaatagtttaaatatcaatatcgatggtgtacgcattataaatcctaaaaattctcaatacaatgaagaatttgaagagcttttatacgaagctagaaaaagtaaaggtatgagtaaagaagaagctaaaaagttagtgcaagataaaacatattttgcgaccttgcttgtacatactcaaaaagcgcatgctatggtaagtggtgcgagtacaactactgctgaaactattcgtcctgccttacaaattatcaaaacaaaacctgatgtgagtttggtttctggtatgttttttatgtctttagaggataaggttttagtttttgctgattgtgctgttatgccaaatccgagccctgagcaacttgctgaaattgcttatgtgagtgcaaatagtgctaaagcttttgggcttgaacctaaagtggctttgctttcatattctagtggagatagcggaagcggggctagcgtggatgcaattaaagaagctagtaaaatagctaaagaaaaatatcctcaacttgagctagaaggtcctatacagtttgatgcagcatatgatatgctaacagcaaaaagtaaaatgccaaattctaaagtagcaggaagagcaaatgtgtatgtgtttcctgatttaaatgcggcaaatatctgctataaagcagtgcaaagaacagcaaattctttagctattggcccgattttacaaggccttaaaaagccaattaatgatttaagtagaggttgtttggtagaagatattgttaatactgtgattttaagtgctattcaagcacaagaataa

SEQ ID NO: 975 - DNA, 1437 bp, Campylobacter hominis ATCC BAA-381
atgaacggaattttcgttttagcacaaaatgaagttgcgaaaaatttggcgtttctacctaaagttttaacttcaaatttcgtcaaaattacaaaattgcaaataaaagaaggcgagcaaaacagtgctgttttgaaaaaatatataaaagattttaacgaattatccgccaaaaacgattttgtcgttgtaatcggcgctgattttattgataaaataggttttaacgcaaaaatagcaaatgtccttaatttaccgattatttccgtttgtgatagtgaaaattcagcaaaaacggtaggtgaaattttaaaagaaaacaaatcaaacgattttgccaaggtttataatgaaatttgcgatttcggtaattttaaatttaaaattcaacaaattgagcaaaatcctgaaatttttataaatgaactgaattcaaacagtgtaaatatcgtaacaccactaaaatttgaaacaaagctttatgaaatggcggcaaaaaatgtaaagcgcgtagttttacctgaaagcgacgatgatagaattttaaaagctgccgatatcgtgcttaaatcaaatgccgtagaaatcacacttcttggcaaaaaagacgaaatttcaaaaagagcgaaagaacttgatttgaatctttcaaacgctcaaataattgaccctgaaaataatgaattcttaaatgaattcgcaaatacgctttatgaacttagaaaagccaaaggaatggatttaaaaaaagctcaaaagttggtgcgcgatagaacttactttggaacaatgcttgtttattgcggaaaatgcgacgctatggtaagtggggccagcactacaacagcagaaacgattcgtccggcacttcaaacaataaaaatgaaaccgggcgtttctaccgtaagcggcgcttttttaatctgtttggatacaaatgttttactttttgcagattgcgcgattactccaaatcctactgtagatcaacttgcggcaattacgatttcaagtgcaaatactgcaaaagcttttggaattgatccgaaagttgctatgctcagttattcaacaggcacaagtggaagtggcgaagatgtcgattttgtcgtaaatgcgactgcaaaagtgcgagaactcgctccaaatttaaatgtggagggtccacttcaatttgatgctgcaatcgataaaacggtcgctaaaaagaaaatgccggactcaaaagttgcaggaaaagcaaatgtatttattttcccgaatttaaactgtggaaatatttgttataaagccgtgcaaaggacatctggcgcattggcgataggacctattttgcaaggtttgaaaaaacctgtaaatgatttaagcagaggctgtttagtgaaagatgtcataaatacgattttaataagcgcaattcaggcaggagataactaa

SEQ ID NO: 976 - DNA, 1599 bp, Campylobacter gracilis RM3268
atgaacggaattttgctcctatgcgacgagcctgccgcctaccaatccgagctaaaaaaactagataaaattttatccatgagctttcacaacgttttgcaactttgcatcgctggcgacaatgccctttttagcaggagcgagcttgaaaaagcgcttgcagatgggcaggatgagcgtgtgcgaaaggcggcgatagagcgctttacgcagattttagagcagtgtaattttgtactggttcacggcgtagcgggagccgatctgcgcgagctaaatttacaaatcgcaaaggatctaaatatccccgtttgcggattttatcctaacgaaattgctgcgcgcatcggcacgcgcttgatcgccgcagcaaaagcgataagctttgccagcgtatatgaggataaaatttcattttccgcgctaagatctgcacaagagggtgcaaattctaaaaaatcggagctttgcggcaaaaattccgcttgcgaaaagggtgcaaaatttcacgacgaaaattccgcttgccaaagcggtgcgatagagcttgataaagtcattgccgacaaaagctacttcacggacgccgcaaactccacgcgctgtgaaattctaaccccattgaaatttgaaagcaagctctacgccaaggctcgcgcgaacgttaaaaccgtcgtactgcccgaaagcgacgatgagagaattctgcgcgcggccgcgattataaagcaaagcggtgctgcaaatttgatccttttagggcggcaagacgaagtgcaaaaaagcgcaaacaagctaggtctcgatctaagcggcgttaaaattttagatccgcagacggatgcgagcttagaaaaatttgcgcgcgatctttatgagcttcgcaaggcaaagggtatgagcgaggcgcaggcgcgcgatttagtgcgcgatcgcacctacttcggcacgatgctcgtgtatgaagggctatccgatgcgatggtaagcggtgccggcacgactactgcggagacgatccgccccgcgcttcagatcattaagacaaaaccgggcatcgcgaccgttagcggcgcgtttataatgtgcctggatacgcaggctctgctttttgccgactgcgccgtagcgccgagcccgagcgcagagtatctggcaggtatcgcgatttcaagcgccgcgaccgcaaaggcgttcgggcttgagccgcgcgtggcgatgctaagctactccagcggcgacagcggcagcggagagagcgtagaatttatcaaaacggcgacgcaaaaagcgcgcgaaaaggcgcctgatctcacaatcgacggaccgctgcaattcgacgccgcagtcgatgcggcggttgctaagaaaaaaatgccgggctccgcggtcgcagggcgcgcgaacgtatttatcttccccgatcttaattgcggaaatatctgttataaggccgttcagcgcaccgcaggcgccgtggcgatcgggccgattctgcagggcttaaaaaagccggtaaacgatctaagccgcggctgcaaggtcgccgacatcgtaaacacgatacttatcagcgcgattcaagcaggagagaattaa

SEQ ID NO: 977 - DNA, 1395 bp, Campylobacter fetus subsp. fetus 82-40
gtgttaaaagctatctatattcttgaatcggactaccaaaacgataaatttaggcaaaatttactgaaagaacttagtgaaattagtaacaaaaatactatattttttcccattagcgatataaatgagaaaaattgtaacacttttctaacaaaaagtgaagctaaagaaattttaaaaaatggtaaaaaaaatcaattaataaaatcaattatctctaaatttgatagtatagatgcgaattttatagttatagtaggaagttcgatagaaagtcttgacgccgatatagctaaaaatcttaacgctcctttttatctcagcccagaaagtgagtttaaaaaagatattttaggatttacttacattaatgatataaacgagataaaaaccgcaaacagtagctgtataacgccgcttaaatttgaaaaaatgctttttgatagagctaaatcaaatttgaaaacagtagttttaccagaaagcaatgatgatagagtattaaaagctactcaaattttgcttgaaaatgaagctgtgaatataatacttttaggagaaaaaataaatatagaagaaagagcgaaatttctaaatctaaatttagaaaaagcagttattataaacacaaaagataacgcctacaaagatgattttacaaataccttatatgaacttagaaaatcaaaagggatggagctagaaaaagcaaaatcattgatggaggatagaacgtattttggaacgatgctagtttataaaggcgtagcagatgctatggtaagcggagctagcacgactactgcacagaccattcgccctgctcttcaatttatcaaaatgaaaccgggaattagcaatgtaagtggaagttttatcgtctgtttagatactaaaactcaaatttacgcagattgcgctatcacgccaaatcccacaacagaccaactagcaaatatagctataagcactgcaaaaacagctaaaaattttggacttgatcctaaagtagcaatgctaagttactccactggcgacagtggatgtggtgaagatgtaaattttataatagaagcaacaaaaaaagcaaaagaacttgatcctaacttaaaaatagaaggtccaattcagtttgacgctgcggtagataaagcagtcgccgctaaaaaattaccaaactcagcagtagctggaaacgcaaatacatttatatttccaaatttaaactgcggaaatatctgctataaagcagtacaaagaaccgcaaatgctatagctataggtccaattttgcaaggactaaataaaccagtaaatgatctaagtcgtggatgtttggttgaagatatagtaaatacggtcttaataagcgcaatacaatctcaaggagaataa

SEQ ID NO: 978 - DNA, 1368 bp, Campylobacter concisus 13826
atgaaaagttgttacattttttcagacaaaaatctagcatatttgcaggaaattatagctacaaaattcaaaaaagttgagatctttaagataactccagacgaaaacgacaaaaaaaatctaataaatttaaatgaaaaggagttttttttaaaatttatagataaatttgaagagttaaaggccaagagcgacttcgtcatagtcgttggctgtgagggctttagcgtctttggcaagagtgagctaaatttaaagctagctagaaatttaaacgctccaatctttgatgaaaacgcaaacgaactaagagcgctaaatttaaactccaagcttctgataactggtaatttttatgaaattttaagctacaacgccgagatcatcacaccatttaaatttcaaagcttgcttctaaaaagagccaaaacagcaaacaaaacagtcgttttgccagagagtgacgacgagagaatattaaaagcggctcacatcgtgctagaaaaaggtgtagcaaatatcattttgttagggcgtgagagcgaaatttcaaaaaaggcggccactttggggctaaatttaagcaaagcaaaggtgatagagcctgtgcaaaacgagctaacaagtgaatttgcaaagaaaatttatgagctaagaaaacataaaggcgttgataaagccaaggcaaatgcgcttgcgaaagataaaatttactttgccactatgctaatacatgaaggcatagctgatgctttagtaagtggcgctacgatgagcacggctgatacgatccgcccagcccttcagatcataaaaacaaagccaaatgtaagcgtggtaagcggggcattttttatggcgcttgaagaagagattttactctttgcagactgcgccgtcacgccaaatccaagcgcggacgagctagctagcatcacgctaagtagcgctcaaacagcaagtgcctttggacttagtccaaagatcgctatgctaagctactcaacagctgatagtggcagcggggctgatgtggagtttgtaaaagaggctgccaaaaaagcgcatgagcttgatgtgaatttaaagatcgcagcgccaattcagtttgacgcggcagttgatctaagtgtggctagcaaaaagatgccaaattccgatgtggctgggcaggcaaatgtctttatatttccaaatttagactgcggaaacatctgctacaaggcagttcagcgaagtgcaaacgccctagcagtaggcccaatacttcaagggctaaaaaaaccagtaaatgacctaagccgcggctgcctcgtcgaagacgtcgtaaatactatcttaataagcgcgatacaagcaggagagtga

SEQ ID NO: 979 - DNA, 1371 bp, Campylobacter curvus 525.92
atgaacagctgttacatatttagcgatgaaaatttagcatatttaaaggggattatatcaacaaaatttaaaaaagtcgctgttttgcagataaaaatcagcaacgaggaacaagaaaaattcataaacggcaaagagaaagatttttttatcgcgctcatcgataaatttgaaaaacaaaaagagcaaaacgacttcgtcatagtcgtaggctgtgaaaatttcagcgtttttggcgcttgcgagctaaatttaaagatagccaaaaatttaaactgtcctgtcttcgagcctcgaaatttcaaagccttaaaagcgctaaatccaaactcaaagctcataatcagcggcgatatagatgaaatcttaagctgcacccaagagataatcacaccgtataaatttgaaaatatcttactaaatcgcgcaagaaacgcccactcgtctgtcgttttaccagagagcgacgacgaacgtgtcttacgcgcggctgaaattttactcgctcaaggtgcggtcgatatagttttactgggagaggaagccgccatcaggcaaaagcaaagcgaactggggctaaatttaagcaaagctcgcatcatcgatcctcaaaacaatgactatacgcaggcctttgcggctaaaatttacgagctgcgtaaggcaaaaggcgtgagtgaaaaagacgccgagcggatggcgcgagataaggtgtatttcgcaacgatgttggtaaatgagggcatggtaggcgcgatggtgagcggagctagcatgagcacggccgataccatacgccctgcccttcagatcatcaaaacaaagccgcagacaaagatcgtctcggggctatttttcatggcgctagaggaggaaattttactctacgcagactgcgctatcacgccaaatccaagtgccgaggagctagcgggcatagccgtcatcacggctcaaacggcggcttcgtttggactgcagcctcgtgtagcgatgcttagctactcgactgctgacagcggaagcgggcctgacgtggagtttgtaaagctagcagctaaaaaagcgcttgagatcgagcctgacttgagcctggccgctcctatccaatacgacgccgcggtcgatgtcaaagtaggcgctaagaaaatgccaaattctagcgtagcgggacgggcaaacgtgttcatatttccaaatttaaactgcgcaaatatctgctataaggccgttcaacgcagtgcaaacgccctagccgtaggaccggtactacaaggcctcaaaaagccggtaaatgatctaagcaggggctgcctcgtcgaagacatcgtaaatacagtgctgataagcgcgatacaagcgggagaatga

SEQ ID NO: 980 - DNA, 1386 bp, Campylobacter showae RM3277
atggctaattccatccttgcgcttggcgcgaattttcaagaaatttacgaaattatatcaacaaaatttaaaaatgtagccgtttttgaccccgtcaatgatttttacgggctcgaaaatgccaaaaaagcctttgaaaatggcagcgagcgcgagttttttaaaagcgcgataaatgaatttgaccgcctggctgggagcgctgatttcgtactcgttaagcctgcaaaaagcatcgcaaatatcggcgaaatagagctaaatttacaaatcgctagaaatttaaacattcccattttttgccgtgaaaatttgagcttttttacacgaaactcaaagctgatcgtaagcggaaatttagatgaaattttaaacgcaaagcaagatatcatcacgcctttacgctttgaaaattcgctatttaaactcgccgcaaaagataaaaaaaccgtcgttttgccagaaagcgaagacgagcggatactaagagcgagcgaaattttactaaaaagcggtgcggtaaatttaatccttttgagcgacgaaaacgagatcaaatttgaagcggaaaaactgggcataaatttaaacggtgcgcgatttataaatttagaaaaaaacgagtatgcagatcgcctaaccgccgcgctttttgaagctcgaaaaagcaagggcgtaagcctagagcaagcccgcgagctcgtgcgagataggacgtattttgccacgatgctggtgcaagaagggctggcagatgccatggtgagcggtgcaaacacgactacggcgcacactatccgacccgcacttcagatcatcaaaacgcgcccggatagcccgctagtttcaagctcgtttataatgtgctttgacgaggagatcctgatctacgccgactgcgctataaatccaaacccggatgcccggcaactagcgcaaatcgcgctagcatcggccaatacggcacgcgcttttggactagaaccgctagtagcgatgctaagctactctagcggagatagcggcagcggcgctgatatcgatctggttaggagtgccggcgagatagcgcgagggctggatcctgccctaaaaatcgaagcacccgtgcagtacgacgcagccatagatatagccgtagcgcgcaaaaagctaccaaacagcgacgtagcaggtcgcgcgaacgtttttgtatttccaaatttaaacgcgggcaacatcggctataaaatcgcgcaaagaagcgcaaactgcgtcgccgtcggaccgatcttgcaaggtctaaaaaaaccggtaaacgacctaagccgcggatgcggcgtgggagacgtcgtaaatacggtcctaatcagcgcgatacaagccgcaaatgaaggagaaaaatag

SEQ ID NO: 981 - DNA, 1671 bp, Bifidobacterium pseudocatenulatum DSM 20438
gtgagtctaaccagcgtcaccattatcagccctgaagcagcaaacggccgcaacgtcgtggcccttggcgtcaccaaggcattcgcagctgccaagaagacggccgtgttccgtccggcggtttgtcgcaaggaaaccttcaccgacgttcttcttgaagcaagcaactcggggctgagccgtgaacaatccgtcggtgtttgcccgaagcgtgcacgcaccgacaaggaaggctcccgggccgatatcgtggccgcctacacggaagccatcgaaaccgcccagcccgaagccgtggttgttgtcggaacggacaaatccgccatcaacgacccgtccatctttgcgttcaatgctgacgtagccgctgatctcaagtccgtcgtgcttcttgccgtatgcaccatcaaccgcactccagaacaggtcctgggcactgtcgaggcgtcgaagaccatcatcgagaatgcaggcagcaaggtcgccggcgtgttcatcaccggatgcaaagacgaacaggtggaacccctcaaggaggagttcgcagcttacgaggtgccggtgtggacgttacccgccgttgattttgacgaggaagacgccgtgaccaaagccacggaggcattcgaggcgaatgtcaacgccgaagagcttatcgccgctgtcgaggctccattcgaggcgccgaccacgccatacgcattccagtacagtctgctgggcaaggccaaggcggacaagaaaaccatcgtgcttccggaaggatccgaagaccgcatcatcaaggcggccgactatctgcttgagcgtgatatcgtcgatctgatcatcgtcggagacagggaaggcattctcgcccgcggcgaggagcttggtctcaaatcccttgaaaaggcgcagttccaggccaaggacgacgaggaagtgctcgctccgatggtcgccaagctgtgcgaactgcgcgccaagaagggcatgaccgaggaacaggctcgcaagcagctcgccgacgacagctacttcggcaccatgcttgtggtgctcggcaaggctgacggtctggtttccggatccatcaactccacggccaacaccgtacgtccggccctgcaggtcattaagaccaagccgggaacttccctcgtgtccggtgcgtttctcatgtgcttcaaggaccatgtcgcagtgttctccgattgcgccatcaacctgaacccgtccgctgagcagcttgcggaaatcgccatccagtccgccgaaacggcaaaggcgttcggcctcgatccgaaggtcggcatgctgtcgtattccacgctgggatccggcaagggaccggacgtcgatctcgtggaggaagcaaccgcactcgtgaaggagaaggctccggacctcgcggtcgtcggttccatccagttcgacgcggcttggtcgccgaccgttgcagccaccaaggccaagggcaacgatgtggctggccatgtcaatgtgttcgtgttcccggatctgtgcgcgggcaacatcgggtacaaggccgtccagcgttcctccggcgcggtggccgtcggtccggtgctgcagggcctgaaccgaccggtcaacgacctgagccgaggcgcaaccgtgcaggacatcatcaacacggttgccctgaccgccatcgaagcccagtaa

SEQ ID NO: 982 - DNA, 1701 bp, Bifidobacterium dentium ATCC 27678
atgcatatgaatgaaggaataggagacaccgtgagtcttaccagcgtcaccatcatcagccctgaagccgcgaacggtcgcaatgtcgtggccctaggagtcgtcacagcactggcgtccatcaagaagaccgcagtgttccgcccggccgtatgccgtaaggatacgttcaccgacatcctgcttgaagccagcaacaccggtctgacccgtgaacagtccgtcggcgtctgcccacgccgcgcccgtgaagacaaggcgggttctcgcgccgacatcgtcgccgcatataccgaggccattgaggccgcacagcccgaagccgtcgtcatcgtgggcaccgacaaatcccccgtcaatgatcccgctctttttgcattcaacgccgatatcgccgccgaccttaaggcccccgttcttttggccgtctgtaccatcaaacgtactccggaacaggtgaggttcaccgtcgaagcttccaccgccaccatcgaggcggccggcaccaaggtcgtcggcgtgttcatcaccggatgcaaggacgatcagccggaagccctgcatgctgaattcgcggattatccggttcccgtatggacgcttcccgcagtcgatttcagcgaggaaggtgccgtcgcaaaggcctccgaagcgttctccttcaacgtcgacaccgccgaccttctggcggcaatcgacgcaccgttcgaggtgccgactacgccatatgccttccagtacagcctactaggcaaggccaaggccgataggaaaaccatcgtactgccggaaggcgaagaggaccgtatcatcaaggcggccgattacctactggagcgtgacgtcgtcgacctgatcatcgtgggcgacgagaacgcgattttggcccgaggcgaggaactgggcctgaaatccctgagcaaggcgaagttccaagccatggatgatgaggaagtgctcacgccgatggtcgccaagctgtgcgaactgcgcgccaagaagggcatgaccgaggatcaggcgcgtaagcaactgaccgatgccagctatttcggcaccatgctcgtggtgctcggcctggccgacggtctggtgtccggatccgtcaactccaccgccaacacggttcgcccggcattgcaggtcatcaagaccaaaccgggcacctcgttggtttccggtgcgttcctcatgtgcttcaaggatcatgtggccgtattctccgactgtgccatcaacctgaatccgaacgccgaacagctggcggaaatcgccatccagtccgccgaaaccgccaaagcattcggtttggaaccgaaagtcggcatgctctcatactctacgctcggctccggcaagggcccggatgtcgatttggtcgaggcagccaccgcaatcgtcaaggacaaggctcctgaactggccgtggtcggttccatccagttcgatgccgcctggtcgccgaccgtagccgcaaccaaggctaagggcgatccggttgccggacacgttaacgtgttcgtgttcccggacctgtgcgccggcaacatcggctacaaggccgtgcagcgctcttccggcgcggtggcggtcggcccggtgctgcaggggctgaatcgtccggtcaacgacctgagccgtggcgccaccgtgcaggacatcatcaacaccgttgccctgacggccatcgaagcccagtaa

SEQ ID NO: 983 - DNA, 1692 bp, Bifidobacterium adolescentis L2-32
gtgaagtacataggagacaccgtgagttttaccagcgtcaccatcatcagtcccgaagcggctaacggccgtaatgttgtcgcccttggagtcaccaaggcacttgccgcagccggcaagaccggagtgttccgtccggcggtctgcagaaaagacaccttcacggacgtgctgatcgaagcttccaatgccggtttgagccgggaacagtccgtcggcgtgtgccccaagcgcgctcgtaacgataaggaaggttcgcgggcggatatcgttgcggcctacacccaagccgtagaaacagcccgaccggatgccatggtgattgtcggcaccgacaggtcagcagtcaatgatcccgcgatgttctctttcaacgctgacttcgcggcagacctccaatcgccggtcctgctggccgtatgcactatcgaacgcacaccggaacaagtcaaaagcacggttgaggcatccaccaaggtcatcgaagacgccgggagcaaagtcgtcggcgtgttcattactgggtgtgacgacacgcagccggatccgctcaaagcatgcttcgtcgactacccggtgccggtgtggacgctacctgccgtcgatttcaacgacgatgacgccatcagcaaggcagacgaagcgttcgcgacgaacgtcgacgccgcggaactgaccgcggcactcgaatcgccattcgacgccccgaccacaccctatgctttccaatacggtctgctgggcaaggcgaaggcggacaagaagaccatcgtgctgccggagggcaacgaggatcgcatcatcaaagccgccgattatctgctggaacgcgacatcgtcgatctgatcatcgtcggagacgaaaacgccattctcgcccgtggtcaggaattgggattgaaatcgcttggcaaggcgaaattccaagccaaggatgatgaaacggtgttggaacccatggtggcgaagctgtgcgagctgcgcgccaagaaaggcatgaccgaagagcaggcgcgcaaacagctggccgatgacagctatttcggcaccatgcttgtggtgatgggcatggcggacggcctcgtgtccggttccgtcaactccacggccaataccgtgcgtccggccctgcaggtcatcaagaccaagccaggaacatcgttggtatccggagcgttcctgatgtgtttcaaggaccatgtcgccgtgttcgccgactgtgccatcaaccttaaccccaatgccgagcagctcgccgaaatcgcgatccaatccgccgaaacggccaaggcgttcggccttgaaccgaaggtgggcatgctgtcctattccacgctgggctccggaaaaggacccgacgtcgacctcgtcgaggaagccaccaccatcgtcaaagacaaggctcccgaccttgcggtggtcggatcgatccagttcgacgcggcatggtctccgaccgtggccgcgaccaaagccaagggcgatccggtggcgggccatgtcaatgtgttcgtattcccggatctgtgcgcgggcaacatcgcatacaaggcggtacagcgttcctcgggagcggccgccgtcgggccggtgctgcagggtctcaaccgcccggtgaacgatctgagccgtggcgccacggtccaggacatcatcaacaccatcgccctgaccgccatcgaagcccagtaa

SEQ ID NO: 984 - DNA, 1707 bp, Bifidobacterium angulatum DSM 20098
atgccgaaaccaattcagtgcataggagacaacgtgagtcttactaccgtaaccatcatcagtcccgaagcagccaatggccgcaatgtcgcggcgcttggcgttgtcagggctttggcatccacacagaagaccggcgtattccgcccggccgtgtgcaagaaagagaccttcacccaaaccctgcttgatgccgccaacgtcggcgaaaccatcgaacaggccaggggagtgtgcccgaaacgtgcgcgacatgacaagaacggttctcgtgccgatatcgtcgcagcatatgaaaccaccgtcgcagccatcgacaccgaagccatggtgatagtcggcacagatcacagctgtgtcaacgaccctgagacctttgccttcaacgccgatgtcgccgctgatttgcaaagcccagtattccttgcggtatgcaccatcaatcgcacgcccgagcaggtgcgggaaaccattaaggcatgcactgcgacagtggaggagcacggcagcgcagtgctcggcgtcttcgttaccggagcggacgaggagcagatcccggatctgaaggcgttcttcgccgatgccgatgtgccgacgtgggtattgcccaaggtcgatttcgaagaggatgatgctgctgaaaaggctgctgaagccttcgccagaaacgttcctgcaagcgaggttcatgccgcgcttgaggcgccttttaaggccccggttactccgtatgccttccaatatggcttgttgggcaaggccaaagccgtcaggaaaaccatcgtgctgcccgaaggcgccgaagatcgcattatcgcggccgccgattacctgcttgagcgtgacatcgtggatctcattatcgtcggtgataaagaggcgattctggcacggggcgaggaacttggactcaactcgttgggcaaggcgaagttccaggccatggatgatgagacggtgcttgcgcccatggtcgccaaactatgcgagctgcgagccaagaagggcatgaccgaggaacaggcgcgcaaacagcttaccgatgccagttatttcggcaccatgctggtggtgctcggcaaagccgacggtctggtctccggttccgtcaattccacggccaataccgtgcgccccgcattgcaggtcattaagaccaagccgggtgcatcgttggtttctggctcgttcctcatgtgtttcaaggatcatattgccgtgttcgccgattgcgccatcaacctcaatccgaatgccgagcaactggccgatatcgccattcagtccgctgaaaccgctgcggcatttggtctcgagccgaaggtcggtatgctgtcgtattcgaccttgggctctggcagaggtccggatgtcgatctggtcgaggaagctaccgatttggtccgtcagaaggctccggatctgcaggtggttggttccgtgcagttcgatgccgcttggtcaccgaccgtcgcagcgaccaaggcgaaaggcaacgatgtggccggtcacgtgaatgtattcgtgttcccggatttgtgcgccggcaatatcgcatacaaggcggtgcagcgttcctccggcgcggttgccattgggccggtgcttcagggcctgaacaagccagtgaacgatttgtcccgtggcgctacggtacaggacattatcaacactgtggctttgacggcagtggaggcgcagcgatag

SEQ ID NO: 985 - DNA, 1743 bp, Bifidobacterium breve DSM 20213
gtgaacgataacaacgaccactacaatgagatatggttccacatatgttgcacatcaaaggagacagacacagtgaccgtgacccgtgtatatatcgccagccccgaaggcgctaatggccgcaacgtcgttgcgtacggcgtgctcaatgcattgacttccaagtacaagaccatggtgttccgtccggccgtgtccaaccacgacgacttcacccccattctgctcgccgcgtccaatgctggccttggcgtggctctgtctaccggacttgacgtgcacaaggtgcgcaccgacaagggcaccgcccgtggtgacatcgtcggtgccttcaacgacgccatggatgtgtcccgtgcggatgccgcactgatcgtcggcaccgacaagtcgcatgtcaatgatccgaccagctacgaattcaatgcgaatgtggccgccgacctgaaggccggcgtgttcctggccgtgtgcaccatcgaccgctggccgcacgagctggacgagaccgtgcatctgtccatcgagggcatggaagccgccggcaacaaggtgctcggcattttcgtgaccggctgtgaaccgcgccacgccttctccgtcaaggaaaccctcgccaagtacggtctgcccgtctggacgcttccccagattccgttcaccgacgaatccaccaaggatctggcgctggcgaccttccgcaagaacgcccccaccgatgaagtgctcgcagcgctcgatgtggagaacaccgcacccatcaccccgtatgccttccagttcgacctgctcggcaaggccaagagcaacaagaagactattgtgctgcctgaaggcgaggaagaccgcattatcaaggcggctgactacctgctcgagcgtgagattgtgaatctcatcatcgtgggtgataagaatgccattctggcccgcggcgaggagctcggcctcaagttcctggaccgcgcccgtttccaggccatggatgacgagaacgtcttgaagcccatggttgccaagctgtgcgagctgcgcgccaagaagggcatgaccgaagagcaggctcgcaagcagctggccgacgccagctacttcggcacaatgctcgtggtgctcggctacgccgacggcctggtctccggttccatcaattccacggccaacaccgtgcgtccggccctgcaggtcatcaagaccaagccaggtcagaagctcgtttccggcgccttcctcatgtgcttcaaggatcacgtggccgtgtttgccgactgtgccatcaacctgaacccggatgcggagcagctctccgaaatcgcgctgcagtccgccgaaaccgcacgtgccttcggcatcgacccaaaggtcggcatgctctcctactccacgctcggctccggcaagggcccggatgtggatattgtcgaggaagccaccaagctgctcaaggagaaggcaccggacctgccggtggttggttccatccagttcgatgccgcctggtcgcccgacgtggccgccaccaaggccaaaggcaacgatgtggccggacatgtcaacgtgttcgtgttcccggatttgtgcgccggcaacatcggctataaggccgtgcagcgctcctcgggcgcgctggccatcggcccggtgctgcaaggcctcaacaagccggtgaatgacctgtcccgtggtgccctggtgcaggacatcatcaacaccatcgccctcaccgccatcgaagcgcagtga

SEQ ID NO: 986 - DNA, 1713 bp, Bifidobacterium longum subsp. infantis ATCC 55813
gtggtccctatcgtgttgatcatcaaaggagacaaaaacatcgtgaccgtcacccgtgtatatatcgccagccctgaaggcgccaatggccgcaacgtcgtcgcttacggcatgctcaacgcattgacttccaagtacaagaccatggtgttccgccctgctgtgtccaaccatgacgaattcaccccgatcctgctcgccgcctccaatgccggactcggcgtggccctgtccaccggcctcgatgtgcacaaggtgcgcgaggataaggacaccgcccgtggcgatatcgtcggcgcgttcaacgatgccatggacgtttcccgcgcggacgccgccctgatcgtgggcaccgacaagtcccacgtcaacgatccgaccaactatgaattcgacgcgaatgtcgccgctgatctgaaggccggcgtgttcctagccgtgtgcaccatcgaccgttggccgcacgagctcgacgagaccgtcaagctgtccatcgagggcatggaggccgctggcaacaaggtgctcggcatcttcgtgaccggatgcgagccgcgccacgctttctccgttaaggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgctgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaataccgtgcgcccggccctgcaggtcatcaagaccaagcccggccagaagctggtctccggcgcattcctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccggatctgccggtggtcggttccatccagttcgacgccgcctggtcccccaccgtggccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggtctcaacaagccggtaaacgacctgtcccgtggtgctctggtgcaggacatcatcaacaccatcgccctcaccgccatcgaagcgcagtga

SEQ ID NO: 987 - DNA, 1713 bp, Bifidobacterium longum subsp. infantis ATCC 15697
atgaatgatggtccctatcatgctgatatcaaaggagacatcgtgaccgtcacccgtgtatacatcgccagccccgaaggcgccaatggacgcaacgtcgtcgcctatggcgtgctcaatgcgttgacctccaaatacaagaccatggtgttccggccggccgtgtcgaaccatgacgaattcacccccatcctgctcgccgcctccaatgcggggctcggcgtgtccctgtccaccggcctcgacgtgcataaggtgcgcgccgacaaggacaccgcccgcggagacatcgtcggcgagttcaactacgccatggaggtctcccgcgcgaacgccgccctgatcgtcggcaccgacaaatcccacgtcaacgacccgaccacctacgagttcaacgcggacgtcgccgccgatctgaaggccggggtgttcctggccgtgtgcaccatggaccgatggccgcacgagctcgacgaaaccgtgcaactgtccatcgagggcatgcgcgccgcgggcaatacggtgctcggcatcttcgtgaccggctgcgagccgcgccacgccttctccgtcaaagagaccctcgccaaatacggcctgccggtctggaccctgccgcaggtgcccttcaccgacgaatccaccaaggatctggcccttgagaccttccgcaagcacgctcccatcgacgaggtgctcgccgcgctcgatgtggacgtcaccgcgccggtcacgccatacgccttccaattcgacctgctcggcaaggccaagagcaacaagaagaccatcgtgctgcccgaaggcgaggaggaccgcatcatcaaggcggccgattacctgctcgaacgtgagaccgtgaacctcatcatcgtgggcgacaaggacgccatcctggcccgcggcagggaactggggctgaacagtctggggcgcgcccgattccaggccatggacgacgagaacgtgctcaagccgatggtggccaaactgtgcgagttgcgcgccaagaagggcatgaccgaggagcaggcccgcaagcaactgaccgacgccggctacttcggcaccatgctggtggtgctcggctatgccgacggactggtttcgggttccgtgcattccaccgccaacaccgtgcgccccgccctgcaggtcatcaagaccaagccgggccagaaactggtctcgggcgcgttcctcatgtgcttcaaggaccatgtggccgtgttcgccgactgcgccatcaatctcaacccggacgccgagcagctttccgagatcgcgctgcagtccgccgagaccgcccgcgccttcggcatcgacccgaaggtcggcatgctctcctactccaccctcggctcgggcaagggcccggacgtggatctggtggaggaggccaccaagctgctcaaggagaaggcgcccgatctgccggtggtcggtcccatccagttcgacgccgcctggtcgcccaccgtggccgccaccaaggccaagggcaacgacgtagccggacatgtcaacgtgttcgtcttcccagacctgtgcgccggcaacatcggctacaaggccgtgcaacgctcctccggcgccctggccatcggcccggtgctgcaggggctcaacaagccggtgaacgacctgtcgcgcggcgcactggtgcaggacatcatcaacaccatcgccctcaccgccatcgaagcgcagtga

SEQ ID NO: 988 - DNA, 1671 bp, Bifidobacterium bifidum NCIMB 41171
gtgacaacaacgaacatctacatcgcaagtcctgaaggcgcaaacggacgcaacgtcgtggcatacggcgtgctcaaggcgctgaccaccaaattcaagaccaccgtgttccgccccgcggtctccaatcacgaccacttcacccccatcctgctgaacgcctccaacgccggcctcggcgtcgcgctgtccaccggactggacattcaccaggtgcgcaaggacaaggaaggctcccgcggcgacatcgtcgcggcgttcaacgacgcgatgaacgtgtcccgcgcggacgcggcgctcatcgtcggcaccgacaagtcacacgtcaacgacccaaccgcctacgagttcaacgcgaacatcgccgccgacctgcaggccggcgtcttcctcgccgtgtgcaccatcgaccgttggcctgacgagctcaaggacaccgtccgtctctccatcgaaggcatggaggccgccggcaacaaggtgctgggcatcttcgtgacgggctgcgagccgcgccactccgtctcggtcaaggacacgctcgcggacttcgggctgccggtgtggacgatcccccagatcccgttcaccgaggcgtcgcaggccgatgcggcgctcgccgccttccaggcgaacgtgccaaccgaagaggtcctgcgggccatcaacgtcgagatcgacttcccgatcacctcgtacgccttccagtacagcctgctcggccgcgccaaagcgaacaagaaaacgatcgtgctgcccgaaggcgaagaggaccgcatcatcaaggcggccgactacctgctggagcgcgagatcgcgaacctcatcatcgtgggcgacaagggcgcgatcctcgcccggggcgcggaactcggtctgacccatctgggcaaggcacgcttccaggccatggacgacgagaacatcctcaagcccatggtcgccaagctgtgcgagctgcgcgccaagaagggcatgaccgaagagcaggcccgcaagcagctgaccgacgcgagctatttcggcacgatgctcgtcgtgctcggttacgccgatggtctggtgtccggcgcggtcaactccaccgcaaacaccgtgcgtccggcgctgcaggtcatcaagaccaagcccgggcagaggctcgtctccggcgccttcctgatgtgcttcaaggaccacgtgaccgtgttctccgactgcgccatcaacctcaacccggacgccgaacagctcgcggagatcgcgctgcagtccgccgtgaccgccaaggcgttcggcatcgagcccaaggtcggcatgctctcctactccaccctcggctccggcaaggggccggacgtggacatcgtcgaagaggccacgcgaatcgtcaaggagaaggctccggacctgcccgtcgtcggctccatccagttcgacgccgcatggtcgcccgacgtggcagccaccaaggccaagggcaacgacgtggccggacacgtcaacgtgttcgtgttccccgacctgtgctccggcaacatcggctacaaggccgtgcagcgttcctccggggcgctcgccatcggccccgtgctgcagggcctcaacaagcccgtcaacgacctctcacgcggtgcgacggtgcaggacatcatcaacaccatcgcactgaccgccatcgaggcccagtga

SEQ ID NO: 989 - DNA, 1665 bp, Gardnerella vaginalis ATCC 14019
gtgtcgttagttaacgtaactattatcagcgcagattgcgcacaaagtcgcaatgtcgtagcactaggagttacaaaagctctttcaagtcattatccaacaactgtttttagaccatccgcaaagcatgatgacgcgtttacaagcgaattaatagcatcaagcaatacaaaaccgactctagaacaagtgatcgcagcatgcccatgcgcagttcgtaaaaacaaagacacactaagaggagacattgtagctcacttcaacgagctgattagcgtgacgaacgctcaaggatgcgttattgtagcaagcgattctacttctgtatttgatccagatttattccgatttgatgcaagtgtggcagccgacttagcttctccagtgttcctaagcatttgcgcagaaggtagagatagcaagcaaatcttgcaaacaatcgaagcacaatgtgcaagcgttagcaaagaatacacaaaagtattaggcgtatttgtaactgattgcaaagaagacttagcaaaagaagtaaaagaaaactacgctcaaaacaataatggcactccactttggactttgccttctataagcgaatcagaatcagaatcagataaattcaacgattatgtagcagatgaagagattattagcgctttgaaacagccatttaatgcacctactaccccgtacgccttccaatacagcttgcttggaaaagctaaagcaaataagaaaacaattgtgcttccagaaggagaagaagaccgcattctaaaagcagctgactatttgctagaacgagacattgtaaacattattattgttggagaacgcgaatctattcttgcaagaggacaagagcttggattaaagtctcttagcaaagcaagcttccaatctatgagcgacgaagaggttcttagcaaaatgattagcaagctttgcgaattgcgcgcaaagaaaggcatgaccgaagagcaagctagagaacagcttaaagacgcaagctactttggcacaatgctagtagtacttggattagcagacggacttgtttctggctctgttaactcaacagcaaatactgtgcgccctgctcttcaagttattaaaactaagcctggatctaagcttgtttctggcgcattcattatgtgctttaaggatcatgtagcagtatttgctgattgtgctattaatctgaacccagacgctgaacaattggctaacattgctcttcaatctgcacaaaccgctaaagctttcggattagatcctaaagttggaatgctatcttactccactcttggatctggaaaaggcccagacgttgatttagttgaggaagctacaaggcttgtaaaagaaaaagacccagatttgaaagttgttggatctattcaatttgacgctgcatggtctgaaactgttgctgcgtccaaagctaaaggaaatgatgtagcaggtcacgtaaatgtgtttgtgttcccagatttatgcgctggaaacattggatataaagctgttcagcgttctagcggcgctttagctgttggaccaatcctacaaggattaaacaagcctgttaacgacttgtctagaggagcgttggttcaagatattattaacactgttgctcttacagcattggaagcacaattctaa

SEQ ID NO: 990 - DNA, 1683 bp, Bifidobacterium animalis subsp. lactis HN019
gtgagcctcaaaaacgtgagcatcatcagtcccgaacctggagacggccggaacgtggtggcattgggtgtggtggatatgctcgcccacaccgcgaagaccagcatattccgaccggcggtgcaggcagacgaaaatctcaccgatgcactcctctcggtggtgagcgtgctgcagacgcgcgaacaggccgtcggcgtcacactgcatgacgcacgtcttgacaaagacaatgcccgccagcagatcgtctccaaattcatcgacacgaatgccgagatcaatccgcagatccgagtgatcgtcggatcagaccgcaccaatgtgggcgatcccgaacggttcaccttcaatgcggacgtctccgccgacctgcagtctccggtgctgctctcagtgagctcgatgggacgcacgccggacgagattcgtgagacgatagacgcatgccgcgaggtggtcgccaacgcaggcacccaagtgatcggcgtgttcatcaccgactgcacgaattcggcgctgcccacactcaccgacgaattcgtgagctacgacctgccgacgtggccgcttcccctcgtggaactcggttccgctgacacgaatgtcaaggccgcgctcgatgccttcgacgagcatgtcgacaaggaatcactcctcaacgtgcttgacacacctttcgtaccgccgaccacaccattcgcgttccagtacgatctgctcgcacgtgcgaagaaagacaagaagacgattgtgctaccggaaggagaggacgaccgcatcatcaccgccgcgaactacctgctgcagtcgaatgtggtcgatctggtcatcatcggcgaccgcaacgagattcttgcccggggtgaaaaactcggcctcaaggcgcttgatcaggcgaagttcgtctccatcgacgacaagcatctgctcgacaccatggtgcccaaactgtgcgaattgcgcgccaagaagggcatgacccccgatgtggctctgaagacactcagggacacgaactacttcggcaccatgctcatcgtgctcggcatggccgatggtctggtctcaggtgccatcagctccaccgccaacaccgtgcgccccgcgctccagctcatcaagacgaaacccggtgtctcctccgtatcgggtgccttcctcatgtgtctcaaggaccatgtgtcggtatttgccgattgtgccatcaacctcgatcccgatccgcagcagctggccgacatcgccatccagtcggccgagaccgccaaggcattctccatcgatcccaaaatcggtttgctctcctactccaccttgggttccggtaagggaccggatgtcgatctggtagtcgaggccacttcgatcgcccagaacaaacgaccggacctacccatcgtcggtcccatccagttcgatgccgcttggtcgaagacggttgccagggtcaaggccttcggcaacccgattgccggcaatgtcaccgtgttcgtgttcccggacctcgatgcggggaacatctgctacaaggcagtgcagcgcacctccggcgccgtggcgatcggaccggtgcttcaggggctcaaccggcctgtcaacgacctgagccgaggcgccttggtgcaggacatcatcaataccatcgccttgaccgccatcgaagcgcaaagtaacgaatag

SEQ ID NO: 991 - DNA, 1674 bp, Bifidobacterium gallicum DSM 20093
gtgagccatctcaatgtcagcatcatcagtcccgaaccgggcaatggacgcaatgtggtggcgctcggcgtcgtgcaggcattgtcgcaagagctgggccgtgtgggcgtgttccgtccggcaatcaccaaaactgaaacgtatacaggtgctttgcttgacgctgcaaacattggacagacgcgcggacaggccacaggtgtgacaccgcgcgacgcgcgcatggacccggagctgagccgtgccacgattgtggcgcgatttacggaaactgaagcgcagcttgaaccagcagccatggtcattgtgggttccgacaagtccaacgtcggtgatccggctcgcttcgcattcaacgcggaagtgtctgcagatttgcgcgcccgcatcctgttgaccgtgtgcacgattggacgcactcccgatgaagtgcagcagacgattgaaacctgcacgcaagtatgcacgaatgcgggcacggccgtggttggtgtgttcgtgacgggatgccgtgacgaccaggcggacaggatcgccgagcatttccgtgattacgcggttcccgtatggcccgtcgcgttcgtcgatatggatgagccggacgcgctgcgcaaagcgcaagacgcgttcagtgccagtgtggacatgtcgtcgctgatggacgcggtgcatacgccgttcacaccgccgatgacgccgtttgcgttccaatacagcctgttgggccgtgccaaggatcataagaagacgattgtgttgcctgagtccagcgatgaccgcatcctcaagtcggccgattacctgcttaagcgtgacgtggtcgacattatcctgctcggtgagcgtgacgccattcttgaacgtggccgccaaatggatttggacagtttggacaaagcccgctttcagtcaatgaacgatgagagcatgctggccacgatggttgacaaattgtgccagttgcgcgccaagaaaggcatgacacctgagcaggcacgcgccacactgcgcgacatgagttatttcggcacgatgatgattgtgctgggccatgctgacggcatggtgtcgggcgcgatcaattccaccgcgaacacggtgcgtcccgcattgcagctgatcaagacgaaacccgatgcggcatgtgtgtcgggcgcgttcctcatgtgtttcaaagaccatgtggccgtattcgccgactgtgcgatcaacacgaacccggacgccgccacactggccgacatcgcgatccaatcgtgtgacacggcacgcgcgttcgggctggaaccacgtctggggatgctttcctattccacattgggctcaggcaaagggccggatgtcgaccttgtggaacaagccacacagctcgtcgtgcaacgcgaaccgcagcagccggtggtcggtcccgtccagttcgacgcggccgtctcccccactgtggcgtccatcaaagccaaaggcaatgatgtggccggccatgtcaacgtgttcgtgttccccgacctgactgcaggcaacatcggctacaaggctgtgcagcgcacgtctggcgctgtggccatcggaccgatcctgcaaggcttgaacaagcccgtcaatgatttgtcacgcggcgccgaagtccaagacatcatcaacacaatcgcattgacagccatcgaagcgcaataa

SEQ ID NO: 992 - DNA, 1479 bp, Actinomyces odontolyticus ATCC 17982
gtgtcccgctttattgtcgtcgcccccggttcgtcggaggcagccgccctcgctactgacgagctggcccgcgttctcggcgtcgccaccgtcgacgccctggccggcacgacggctaccgacgccgccctccgtcccgcctctgctctgcccgccgcggtcgaagccgtccgcgccgtcggcgacgacgcgctcatcgcccccgcccgtgaggcctcgaaccgcgccttcgaccacgtggcctggaacctgaacctcgccgcctccacccgcgccggcgtcatcctcgccttcgacgccgagggcgccagcgccgagctcctcgccgaagagatcgccgccgcccgcctgcgcgccgaggctgctgccgcctccgtcgtcgccgtcgtcctgaccggtggcgcccccgcggtcgaggccgacgtccccgtcctgaccctgccgctgggcgacgaggccgcagccaccctgcgcaccaccgccgcccccaccgcagtcaccccgcttgccttccaggcggacctcatcgagcgcgcccgcgccgaacgcaagcgcatcgtcctgcccgagcccgacgacgaccgcgttctgcaggccgccgcccaggtcctcgccgccggcatcgccgacatcacgttcgtgggcgacgccgactacgtcgccaagcgcgccggcgagctcggcctcgacctgagcgccgcccaggtcatctccgtgaacgatcccgcctacctcgagcgttacgccgaggagttcgcgcgcctgcgcgccaagaagggcgtcacccttgagcaggcccgcgagaaggtcaccgacgtgtcctacttcggcaccatgatggtccacatgggcgacgccgacggcatggtctcgggcgctgcccacacgaccgcgcacacgatcgtcccctccttccagatcatcaagaccgcccccggcgtctccgtcgtctcctccatcttcctcatggcgatgaaggatcgcgtatgggcgttcggcgactgcgccgtcaaccccaaccccaccgccgagcagctggccgacatcgccgtgacctccgcgcgcaccgccgcccaattcggcgtcaccccgcgcgtcgccatgctctcctactcgaccggcacctccgggtccggcccggacgtcgacgtcgtcgtcgaggccacccgcctcgcccgcgagaaggcccccgagctggccatcgaaggccccatccagttcgatgctgccgtcgatgcggccgtcgccgccaccaagctgcccggctccgaggtcgccggcaaggccaccgtcttcgtcttcccctcgctggaagccggaaacatcggctacaaggcggtccagcgctcctccggcgccgtcgctgtcggccccgtcctgcagggcctcaacaagcccgtcaacgacctgtcgcgcggcgccctcgtcgaagacatcgtcaacaccgtcgccctgaccgccgtccaggcccagggctga

SEQ ID NO: 993 - DNA, 1596 bp, Actinomyces coleocanis DSM 15436
atgttaggaaaggaaactcctccaatgacggagctgctctttttaactgcttctgaaaacatctccggtggcgtagaaaccgtacgtcaggcactggaaaccctgcgcgccaactacggcaaagtcggagtcttccgcccattcatcaacgcccacccagagcaagacccaatcctgactgaattcggtggcgactggggcaccacccgctcccacatcgtcgcaaacgaaaccgcagccatgaaccaggtaatctccaagttcactgctttcaaccacgacttcgacgcagtcctcatcgttggcctcatcgacggtgacctcatcaacccaggtgaactcacccgcgccggccgcactgccatcaacctcggcgcaaccgtagccctgctcgtagactccgcagtccgtaccccagaacgactggcagactactgcaagttagctgttaatgaactaaacagcgtacacgccccagtttcagcactaattgtccttaacccaactgaaggtgcccgcgtagccatctctaagcacctgggtgacatgcgcgtaatcaccgaactaaacgactacgctctgattgaagcaaccgctgaaaaaactcacgtcgtaactcctttaatgttcgaaaacgctttaaaggatcgtgctcgcgcgcagaaacgccgcatcgtcctaccagaatccgaagatgatcgcgtactcaaagcggcagctattatcctcgaagcagacgtagctgacattatcctgctcggtgaaactggtgaagtattcgcccgcgcagaagcactcggcctggacctgtccaaggcaaccgtagtttccgtaaacgacccagcctaccgcgaacgctacgtcgcagaattcgtgcgcctgcgcgaaaagaagggcgtaaccgttgaacaggctgaagctaagatgagcgatgtctcttacttcggcactatgatggttcacctcggtgacgcagacggcatggtatccggcgcctcccacaccaccgcagaaaccatcgtcccatccttccagatcatcaagaccaagccaggaacctccattgtttcttctgttttcttaatgctaatggaagaccgcgtactagtttttggtgactgcgcagttaatcctaacccaactccagaacagctagcagatattgcgatttcttctgcagaaaccgcagtggcttttggagttgatccacggattgcactgatttcctactccaccggcgcgtctggttccggcccagatgtagaagccgttattgaagctacccgcattgctcgtgaaaaacgcccagacctggcattggagggtcctatccagttcgacgcctctgtggatgctgctgttgcgaaagcaaaactacctgactctgaagttgccggtcgcgcaaccgtattcgtattcccagacctcaacactggcaacaccacctacaaggcagtacagcgttccgctggtgccgtcgcagttggtccagtactgcagggtctgaacaagccagtaaacgacctgtcccgtggcgcgttagtagaagatattgtaaacaccatcgctatcaccgccgttcaagcacagaactga

SEQ ID NO: 994 - DNA, 1386 bp, Corynebacterium glutamicum ATCC 13032
atgtctgacacaccgacctcagctctgatcaccacggtcaaccgcagcttcgatggattcgatttggaagaagtagcagcagaccttggagttcggctcacctacctgcccgacgaagaactagaagtatccaaagttctcgcggcggacctcctcgctgaggggccagctctcatcatcggtgtaggaaacacgtttttcgacgcccaggtcgccgctgccctcggcgtcccagtgctactgctggtagacaagcaaggcaagcacgttgctcttgctcgcacccaggtaaacaatgccggcgcagttgttgcagcagcatttaccgctgaacaagagccaatgccggataagctgcgcaaggctgtgcgcaaccacagcaacctcgaaccagtcatgagcgccgaactctttgaaaactggctgctcaagcgcgcacgcgcagagcactcccacattgtgctgccagaaggtgacgacgaccgcatcttgatggctgcccaccagctgcttgatcaagacatctgtgacatcacgatcctgggcgatccagtaaagatcaaggagcgcgctaccgaacttggcctgcaccttaacactgcatacctggtcaatccgctgacagatcctcgcctggaggaattcgccgaacaattcgcggagctgcgcaagtcaaagagcgtcactatcgatgaagcccgcgaaatcatgaaggatatttcctacttcggcaccatgatggtccacaacggcgacgccgacggaatggtatccggtgcagcaaacaccaccgcacacaccattaagccaagcttccagatcatcaaaactgttccagaagcatccgtcgtttcttccatcttcctcatggtgctgcgcgggcgactgtgggcattcggcgactgtgctgttaacccgaacccaactgctgaacagcttggtgaaatcgccgttgtgtcagcaaaaactgcagcacaatttggcattgatcctcgcgtagccatcttgtcctactccactggcaactccggcggaggctcagatgtggatcgcgccatcgacgctcttgcagaagcacgccgacttaacccagaactatgcgtcgatggaccacttcagttcgacgccgccgtcgacccgggtgtggcgcgcaagaagatgccagactctgacgtcgctggccaggcaaatgtgtttatcttccctgacctggaagccggaaacatcggctacaaaactgcacaacgcaccggtcacgccctggcagttggtccgattctgcagggcctaaacaaaccagtcaacgacctttcccgtggcgcaacagtccctgacatcgtcaacacagtagccatcacagcaattcaggcaggaggacgcagctaa

SEQ ID NO: 995 - DNA, 1515 bp, Corynebacterium efficiens YS-314
gtgaggtatcgggcttcaaacgacgctaagctatgcgaagaatcacaacacttgccacgagtgccgagcggcacacatctggtggagaggatcacccccatctcttccgggttgagagaagaaaggcgatgcatgtctgacaccccaacgtcggctctgatcaccaccgtcaaccgcagcttcgatggttttgaccttgaagcactcgcgcgggacctggaggtaaacctggttcccatacgcggtgatgatttcgacatgtccaaagtcctggccgcggatctgctcgcggatggacctgccctcatcgtcggtgccggcaatgcgcatttcgatgctcaggtggccgccgcgctcggtgtgccgatgctgatgctcgtcgacaagcgtggctcccacgtcaccctggcacgcacccaggccaagaacgtcggtgccgtggtcgtcgcggccttcaccgccgaggaggaggccaagccggacaagctgaagaaggctgtccgcaaccacggcaacctcgagccggtcatgagcgccgccctcttcgagaactggctgctcaagcgtgcccgcaaggaacaggcccacatcgtgctcccggagggtgaggatgaccgcatcctcatggccgcccaccagctcctggagaaggacatctgcgaactcaccatcctcggtgacccggagcagatccattcccgtgccaccgagctcggcctgcacctggagaaggccgatgtgatcaacccgctcaccgaccccaagctggatgagttcgccgaacagttcgcggaactgcgcaagagcaagggcatcacccttgagcaggcccgggagaccatgaaggacatctcctacttcggcaccatgatggtgcacaacggcgatgccgacggcatggtctccggtgccgccaataccaccgcgcataccatcaagccgagtttccagatcatcaagaccgttcccgaggcctccgtggtgtcctccatcttcctcatggtgctgcgtgggcgcctgtgggccttcggtgactgtgcggtcaaccccaaccccaccgccgagcagctcggtgagatcgccgtggtgtccgcgaagaccgcctcgcagttcggcatcgacccccgcgtggccatcctgtcctactccaccggtaactccggtaccggccccgatgtggaccgtgcgatcgatgcgctggcggaggcccgccgcatcgatccggacctcaaggtcgatggaccgctccagttcgatgccgccgttgacccaggtgtggcgaagaagaagatgcccgattccgatgtcgccggacacgccaacgtgttcatcttcccggacctggaggccgggaacatcggctacaagaccgcccagcgcaccgggcatgccctggcggtcgggccgatcctccagggtctgaacaagcccgtcaatgacctgtcccgcggcgccaccgtccccgatatcgtgaacaccgtcgccatcaccgccattcaagccggaggcaagtaa

SEQ ID NO: 996 - DNA, 1452 bp, Corynebacterium diphtheriae NCTC 13129
gtgttgtggcacaggtctcactgtgggcatgtaggtgcagcgcattatttttttgcaactgaaaggatccacgtgactgaccacatgcagccatcgttcctgcttacccgtgctggacgtaacttcaacggctttgatgttgatggtttcgccgatcatcttggcctcccagtccgtcagctagttgattcgactccggatcttgcggctatcctcgctgcccatcctgctgctaccccgagcttgttcattggttccggaaacgtgaactttgatgctaaggctgcgtctgctttgggtgtgccactacttttgcttatcgacgcccctggtatgcacattgatcttgccaagcaggagtgcgaggaacttggggcagttgtggcaagtgtctttactgccgatgaggccgtttccgctgagggcattgcgcgcattaaggcttctgctgttgaggcccctgttgtgatgagtgcgccggtgtttgagtcgtggctgttggagcaggctaagtcgaagaatgcgcacatcgtgttgccagaaggtgacgatgatcgtattttgcaggctgctcatcagctgcttgctcaagagatttgtgagttgaccattttgggtgatcctgaggccattactgcacgtgcgcaggagttgggcttggatctttcggctgctcatttgcagaaccctgagactgatccgaatgcggagaagttcgcggaagatttcgctgagctgcgtaaatctaagggtatgaccttggagcaggctcgggagacgatgaaggatatctcctactacgccaccatgatgattcatgaggggcttgccgacggcatggtgtcgggtgcagcgcacaccactgcgcacaccattaagccaagcttccagatcattaagaccaagccaggcacgtcggttgtgtcttctatcttcttgatggtcatgcgtggccgcctgtgggctttcggcgactgtgctgtgaaccctaacccaactgccgatcagctgggtgagatcgctgctgtgtcggcaaagacggctgagcagttcggtatcgatccacgcgttgctatcttgtcctactccacgggtacttctggctctggcccagatgtggaccgcgctgttgctgcaacgaagaaggctcaggagcttgctccggagtacaagattgatggcccattgcagttcgatgctgcgtgcgatcctactgttgctgctaagaaggccccagaatctgaggttgcaggccaagcaaacgtctttattttccctgatcttgaggctggcaacatcggctacaagactgcgcagcgtaccggccatgctcttgctgttggcccgatcctgcagggcttgaacaagcctgtgaacgacctttctcgcggcgcaaccgttgccgacattgtgaacaccgtagccattactgcaattcaaggaggcaaataa

SEQ ID NO: 997 - DNA, 1401 bp, Corynebacterium matruchotii ATCC 14266
gtgacccaaacaacgcattcggtgttattgaccgcgatccgccgtcgccttgaccaggcagaagtggcggaattcgccgccgcgttaggccttgacatcacgccgctcgtgccagcagggcacgatgaaccgaccattgcggacgtgctgaaacatgcgccggctggtcccgttctttacaccggtaccggcaaccttaactttgatgcgcgggccgctgcggcgttgggtgtgccactggtgctacaaaccccgtcggaatcgttgtcgaccgcattggcgcgcgttgaggcccgcgacctgggggcatcgatcgcggcaatcatcatgggcgaccagccgctcaccgcggcggtgacggcggcgcaagaaaccccggccgaaatcgtgatgaccgcagacgtgttcgaaaactggttgttgggtatggcgaaaaagcatcgcgcccacattgtgctccccgagggtgacgacgatcggatcctcaccgcggccggcatcctcttagcggaagacgcatgtgacctcacgattcttggtgtgcctgaggaagtggccgcccgggccgcggaactgggggttacgctggatggcgccactctggtgaacccgtgggcggatgatgatccccaccgagaagaattcgcacaacaattctatgagctgcgcaaaactaagggggtgagcctggagcaggcgcgggaaaccatgacggacatctcctattacgccaccatgatgatccacaatgggctggcggacggcatggtgtctggcgcatcgcacaccacggcgcacaccattaaaccctccttccagatcattaagaccaagccgggcgtgtccgtggtgtcctccgtcttcctcatggtcatgcgcggccggctctgggccttcggcgattgcgcggtcaaccccaatcccaccgcggagcagctcgcggaaattgcggtggtgtccgcggaaaccgcatcccaattcggcattgacccccgggtggctattctcagctattcgacgggcacctccggcagtgggccagacgtggaccgggctatggctgccacccgcatggcgcaggccaaggccccggaattgctggtggatgggccgttgcaattcgatgcggccgtcgacccggtggtggcggcgaagaaactccccgaatcgcgggtggctgggcaggccaatgtgtttatcttccccgacctagaggctggtaatattgggtataagaccgcgcagcggaccggacacgccctggcggtgggccccattcttcaaggtttgaacaagccggtcaacgacctgtcgcggggtgcaaccgtggcggacattgtgaatacggtggcgatcaccgccatccaggctgccagcagcaaggaagcaggggaggaataa

SEQ ID NO: 998 - DNA, 1401 bp, Corynebacterium glucuronolyticum ATCC 51867
atgaattctcctcgctctgcgctgctcaccactgtcggccggacgtcggcagacttcgacgccagtgccattgctgccgacctcggcctccgccacctcgacctcgtctcgatcgttcccgcgacgggcgacgacgagccgacccccatccgccgcctcatcgtagaggatccgctggcggctggcccggcactcatcgagggcacgggcaacgtctcctacgactccgaagccgccgcggcactgggcattccggtgatcttcatcgtcgacaagcgtggactgaccgagaagctcgcagtgcgtgaggcggggggctacctcgccaccgtcggtggcgtgttcaccgagggtgagctgacggccgacgccatcgccgaggcccttacgggcgtcgatacgaaacccgtcatgagccccgactacctccagacgtggctgcagaagaaggcccaggagaagaccacccgcatcgtgcttcccgagggtgacgacgaccgcatcctccaagccgcccacgaggtgctcgccgagggcatctgtgagctcatgatcctgggagacaaggagaccgttacttcgcgcgctagcgcgctcggactcgacatttcccgcgcggagatcatcgaccacctcaccgacccgcgcgccgaggagttcgccgcccagttcgccgagctccgcaagaagaagggtgtcaccctcgagcaggcacgcgagacgatgaaggatgtctcctacttcggcacaatgctcgtccacaccggccaggccgacggcatggtctccggtgcgtcccacacgacggcgcacacgatccgcccgagtttccagatcatcaagacgaagccgggcacctccgtcgtgtcctccattttcctcatggccatgcgtggccgcctgtgggccttcggtgactgcgccgtcaacccgaaccccacggccgagcagatcggcgagatcgccgccgtctccgcgcagacggccgccgccttcgacatcgaccccaaggtcgccattttgagctactccacgggcacgtccggcgccggccccgatgtggaccgtgccgtcgccgccaccgccaaggccaaggagctcgcccctgagacgattatcgacggccccctgcagttcgatgccgccgtcgacccgggtgttgcggccaagaaggcccccgaatcccccgtcgccggtaaggccaccgtcatgatcttccccgaccttgaggccggcaacatcggatacaagacggcgcagcgcaccggtggtgcgctcgccatcggaccgatcctccaggggctcaacaagcccgtcaacgacctctcccgtggcgcgaccgtcccggacatcatcaacacgatcgccatcaccgcgatccaggcaggagaaacaaagtaa

SEQ ID NO: 999 - DNA, 1362 bp, Corynebacterium genitalium ATCC 33030
atggctaacaggtccgttttgatcaccacggtaggccgcaccctcgacggcatcgacgtagatgcgctggctcaggaatccaacctgaccgccgtgcgtctcagcgagcacgaggctgatgtttccgccgtcgtgtccgcagacctgctgtccgcaggcgactccctgatcgtcggtaccggcgactacaactacgacgctgacgccgcatccgcgctgggcgttcccgtgctcgtcgtcgctgccgccgaggaagtcgcagaactggcgaagaaacgcatcgatgagctcggtgccaccgtcgccgccgtggtggccgatgttgacgctgctgccatcaacaccgcactgaccaccgagaccgagcaggtcatgtccgcagccgtgtttgagaactggctgctcaatcgtgccaaagagaagcgctcccacatcgtcctgccggagggcgaggatgaccgcattctcgaggccgctgaccaactcctcgcgcaggacgttgccgacatcaccatcctgggtgacagcgacgatatcgcccgccgcgctgacagcaagggcctgaacctatccaaggcgaacatcattgaccacctcaactccgagctgctggaagagttcgccgcagacttcgccgagctgcgcaagaagaagggcatctccatcgaggaggcccgcgagaccatgaaggacatctcctacttcgccaccatgatggtccacaaggggctggcagacggcatggtatccggtgccgcgcacaccaccgcgcacactattaagccgtccttccagatcatcaagaccgctccaggcgcgaccgtggtgtcctcgatcttcctcatggtcatgcgcggccgcctctgggccttcggcgactgcgccgtgaacccgaacccgaccgcggagcagatcggcgagatcgctgccgtctccgcgcagaccgccgcccagttcggcatcgacccgaaggtcgccgtgctgtcctactccaccggcacctccggctccggcccggacgttgaccgcgctgttgaggccaccgcgaaggcgaaggagctcgctccggacgtggccatcgacggcccgctgcagttcgacgccgcatgcgacccgggcgtgggcaagaagaaggcgccggattccccggtcgccggtgaagccaacgtgttcatcttcccggacctcgaggcaggcaacgccggctacaagatagctcagcgcaccgccggcgcgctcgctgtcggcccgattctgcagggcctgaacaagccggtcaacgacctgtcccgtggcgcgaccgtcccggacattgtcaacaccgtcgcaatcaccgctatccaggcacaaggagcacactaa

SEQ ID NO: 1000 - DNA, 1359 bp, Corynebacterium lipophiloflavum DSM 44291
atggcggaccaatcgctgctcatcacactcgctaaccgcaattacgacggcattgacgtggaaggtttcgcttccaagcggggcttgcgcgtagttcggctcgactcgtacggcacggatctccaggaaatgtacgacgccaatctactcgctgagggcccagcgctggttgtcggtacgggggacgtgagctttgacggagagctcgccgccactctgggcattcctgtcgtactggtcaccggggaacaggcaaacgttgagctctctgagcgccgtctcgaggagctcggcgcggttgtcgccggtgcattcaccgccgccgagcttgccgacgccgacctcgtcgcagtcgatacgcggcaagtgatgtccccggtggtcttcgagtcctggctgatttcccgtgccaaggaaaagcgcgcccacatcgtcctgccggagggcgaggacgaccgcatcctccaggccgccgcgcagctgctcgaggacgaggtggccgagctgaccatcctcggcgacaaggccgacatcgaccgccgggcccaggacctcggcatcgacctgtccgccgcccagattctcaaccaccttgagtccgacctgctcgaggagttcgccgcggatttcgccgagctgcgcaaggcgaagggcgtttcgcttgacgacgcccgggagacgatgaaggacatctcctacttcggcaccatgatggtgcacaagggcatcgccgacggcatggtctccggcgcggcccacaccaccgcgcacacgatcaagccctcgttccagatcatcaagaccatgccgggcacatcggttgtctcctcgatcttcctcatggttatgcgcgatcgcctgtgggcgttcggcgactgcgccgtcaacccgaacccgactgcggagcagctcggtgaaatcgcggcagtgtccgcaaaaacggctgcgcagttcggaatcgacccgaaggttgcgatcttgtcctactccaccggcacctcaggttccggcccggacgtcgaccgcgcggtcgaggccgtggcggcggcgaagaaggcggatcccgagctcatcgtggacgggccgctgcagttcgacgcggcgtgtgacccgggcgtcggcaagaaaaaggcccccgagtccccggtggcgggtgaggcaaccgtgttcattttccccgatctcgaggcaggcaacgcgggttacaagatcgcgcagcgcaccggcgacgcgctcgcgatcggcccagtcctgcaggggctgaacaagcccgtcaacgatctctcccgcggtgcaaccgtccccgacattgtcaacaccgtcgccatcaccgctatccaggcaggagctctgaagtaa

SEQ ID NO: 1001 - DNA, 1368 bp, Corynebacterium accolens ATCC 49725
atgtctgcatcccagtccacagtgttaagctccatcggccgcggtttcgacggcctcgatattcccgccttggcggatagtcttggcgctgagctgctccgcttagaagatttcgaccccaccgtggcggatgttttggcccacgcgcccaccgccactgccgatgccctcctggtccaaggcaccggtgagatctccttcgatgcggaggtcgccgccgcgctgggcttaccgctggtcattatctccggcgccccagagcgcgccgcggagttggcgcagcgcaaggcagagtccctcggcgccaccgttgccggcgtcttcaccgatctggaggccgtgccaggtgcgttgcaggccgccgaggagaccgcgcccgtcatgtctgcggacctcttccagaagcagctcattgaccaggcccgttccaccggctcccacatcgtcctgcccgagggcgatgatgatcgcatccttgaagctgccgatgccctgctgcgcgatgaggtcgcccggctgactatcttgggcaaggaatccgatatccaggcccgcgccaaggagctggggctggatatttcgggcgccgatatcattgaccacctggaatcgccgcttgcggaggaattcgccgcggacttcgcggagctgcgcaagaagaagggcgtgaccctggagcaggcccgcgagaccatgcaggacatctcctactttggcaccatgatggtgcacaaggggcttgccgatggcatggtctccggcgccgcccacaccaccgcccacaccattaagccgtccttccagatcatcaagaccaagccgaatgcctcggtggtttcctccatcttcttgatggtcatgcgcggtcgcctgtgggccttcggcgactgcgccgtgaacccgaaccccaccgcggaacagctgggcgaaatcgccgttgtttccgcgcaaaccgcgtcccagttcggcatcgacccgcgcgttgccatgctgtcctactccaccggcgcttccggcaccggcccggacgtcgagcgcgccatcgcggccgtcgaggccgccaagaagctggattcctcggtgaaggtggacggcccgctgcagttcgacgccgcctgcgatccgggtgttgccgcaaagaagatgtcggattccgatgtcgccggtaaggccaatgtcttcgtcttccccgatctggatgccggcaatatcggctataagaccgcgcagcgcaccggcggcgccttggccgtgggccccatcctgcagggactgaacaagccggtcaatgatctatcccgcggcgctaccgttccggacatcatcaataccgttgccattaccgctatccaggctggagagaaataa

SEQ ID NO: 1002 - DNA, 1362 bp, Corynebacterium tuberculostearicum SK141
atgtctgcatcccattccgcagttattagcgctatcggccgtggcttcgatggcctcgacgtgcccgccttggctaaagacctaggcgcggagctcatccgcctcgaagacttcgatgccaccgtcgccgccgtactggctgaggctcccgccgctgagaacatcgtggcgcagggcaccggcgatatcgccttcgatgctgaggtagctgccgcccttggcctgccgctggccatcatttccggcgccccgcagcgcaccggcgagcttgcccagcacaatgcggaatccctgggagctaccgtcgctggcatcttcaccgacctggaagcggttccgggcgcacttgctgcgcttggcgacgtctccccggtcatgtccgcagacctcttccagaagcagctcattgaccaggcccgcgccgccggttcgcacatcgttctgccagagggcgacgatgaccgcatcctcgaggccgcccacgtggtgctgcgcgataaggttgccaagctgaccatcctgggcaacgaggctgatatcaaggcccgcgccgaagagctcaagctcgacctggctggtgccgagatcatcaaccacctcgagtccccgttggcagaggaattcgccgccgactttgccgagctgcgcaagaagaagggcgtcaccctcgagcaggctcgcgaaacgatgaaggacatctcctacttcgccaccatgatggtgcacaagggcttggccgatggcatggtctccggcgctgctcacaccaccgcccacaccatcaagccttcctttcagatcatcaagaccaagccgaacgcttccgtggtctcctccatcttcctgatggtcatgcgcggccgcctgtgggccttcggtgactgcgccgtcaacccgaaccctactgccgagcagctgggcgagatcgccatcgtttccgcacagaccgcctcccagttcggcatcgacccacgcgtggccatgctgtcctactcctccggcacttccggttccggaccggacgttgaccgtgcagtggccgccgtcgaagccgccaagaagctggattcttccgtcaaggtggatggtccgctgcagttcgacgccgcctgcgacccaggcgttgcggctaagaagatgccgaattctgacgttgccggtcaggccaacgtcttcgtcttcccggacttggaggccggcaatatcggctacaagacggcacagcgcaccggcggcgcgctcgccgtgggcccgatcctgcagggcctgaacaagccggtaaacgacctgtcgcgtggcgcgaccgttccggacatcatcaacaccgttgcaatcaccgctattcaggctggagagaaataa

SEQ ID NO: 1003 - DNA, 1359 bp, Corynebacterium striatum ATCC 6940
atgtctgcacagaactccgcactcgtgagtgtcatcggccgtggcttcgacggtcttgatgtcccctcgctggcgcaagacctaggcgcaaccttcgcgcagctcaacgatctgggaaccacccttgatcagattctggtcactgttccagaaggcgacgtcgtgttgcagggcacgggtgtaatggactttgacgccaaggccgcagcggcgctcggtatcccgttcgttctgattaccaacgctccagcacgtacttcggaccttgcccttgcccatgcacgctccgtgggtgctgaggttttgggcgcgtttaccgacgtcgcttctgtcccaggtgcgctctcatcagtcggggagattgccccggttatgagcgccgaacttttccagaagcagctgcttgaccaggctcgcgcagtcggtgcacacatcgtgctcccagagggcgacgatgaccgcatcattgaagcggccggcgcactcatcgagggcaaggtcgctaagctgaccatcctcggtgatgaggtggacgtcgccaagcgggcggagcgcctcggcgtggatctcgccggcgtagacgtcattgatcacctgaactccccgctggcggaggaattcgccgctgacttcgcggagctacgtaagaagaagggcgtcaccctggagcaggcgcgcgagactatgcaggacgtttcctacttcgccacgatgatggtgcacaagggcctggcagatggcatggtttccggcgctgcgcataccacggcgcacaccatcaagccttccttccagatcatcaagaccgtgccgggcgcttccgtggtttcctccatcttcctgatggtcatgcgcggacgcctgtgggcattcggtgactgtgcggtcaacccgaacccaactgcagagcagctgggtgaaatcgccgtggtttccgcaaagaccgcagcgcagttcggcatcgccccacgcgtggccatgttgtcttactccaccggtacttcgggctccggcccggacgttgaccgcgcggtggctgctgttgaggccgctcgtgcgctggattcctccgtcaaggtggatggtccgctgcagttcgacgccgcgtgcgacccaggcgtggctgccaagaaggcgccggagtctcaagttgctggtcaggcaaacgtcttcatcttcccggatctcgaggcaggcaacatcggttacaagaccgcccagcgtaccggcggcgcgctggctgtcggcccgattctgcagggcctgaacaagccggtcaacgacctttcccgcggcgctaccgttccggacatcatcaacactgtcgccatcacggcaatccaggctggagttaagtaa

SEQ ID NO: 1004 - DNA, 1365 bp, Corynebacterium aurimucosum ATCC 700975
atgaccgccaagtcctcacggaattccgcctttatcagcgtcatcgggcgcggctttgacggtttggacgttgctgctgtggctcaggaactgggggccaccttcgcccaggtagatgacttgggaaccacgctcagcgaagtcctggagaatgcccctacgggcaacctggtcctccagggcaccggcgttatggactttgatgccaaggccgccgccgccctaggtctgcccttcgtgttgatttccgctgcacccgcacgcgccgcggagttggcgctgaaccacgcgcgttcggtgggtgccacggtggtgggcgcgttgaccgacgtctcctcggttcctggtgcgatttcctccctggaggagatcgaaccttatatgagcgctgagcttttccagaagcagcttttggatcaggcccgcgagattggcgcgcacatcgttttgccggagggtgaggatgaccgcatcttggaagccgcgggtgagctcatcaagggtaaggtggcgaagctgacgattctgggtgatgggaacgttgagaagcgtgcccaggaactcgggatcgacctgtccagcgtggacatcatcaaccacctggaatccccgctggcagaagaatttgcggcggacttcgcggagctgcgcaagcagaagggcgtgacgctggagcaggcgcgcgagacgatgaaggacgtgtcctacttcgccacgatgatggtgcacaagggcttggccgatggcatggtctccggcgcggcgcacaccacggcgcacaccattaagccttccttccagatcattaagaccaagccggaggcctcggtggtctcctccatcttcctcatggtgatgccgggccgcctgtgggccttcggtgactgcgcggtcaacccgaacccgaccccggagcagctcggcgagatcgccatcgtctctgcgcagaccgcagcgcagttcggcttggacccgcgcgtggcgttgctgtcctattccacgggtacttcgggcgctggcccggatgtggagaaggtggggcaggccgtcgaagtggctcgcggcatcgattcctccgtggcggtggatggtccgctgcagtttgacgctgcctgcgaccccggcgtggccgccaagaaggcgccggaatccgacgttgcgggtaaggccacggtcttcgtcttcccagacctggaggccggcaatatcggttataagacggcacagcgcaccggtggcgcactggcggtgggcccgattctgcaggggctgaataagccggtcaatgacctttcgcgcggcgcgaccgttccagacatcatcaacacggtggctattaccgcaattcaggcaggggtgaagtag

SEQ ID NO: 1005 - DNA, 1512 bp, Corynebacterium jeikeium K411
gtgtctatcgcgtcgtctactgcgtcccgaggaactggcacgaacgccgtcatctcaccgatagcgagcgcagccgcgcgccgctctgacatcttggaggcgctgggggaggcagaggcagtcgacattttcgacaccatccgcccttccgcacccgactttgccgctgccctcgacgcggcctacggcgctcaagccagtgccagtgccagtgcaggagctggcgccgtgctgctcggcaccggcgagatcaacttcgactcgcgcctcgccgccgccgcgggtgcctcccactacctgctcgcgggcagcccggcggatgccacggcgctgcaattggcctccgggcagctcgtccgctccggccgtaagcctgccggtatctcttttattgacgccaacgcctccgcaggtgccgccgcagcgaacgccgtcgaagcggaggggcaggcgattcgccacatcgcgctggaaggcattgcggaagcagctgccggcaccaatggggagagcgctgctaaggagccggtgattggtccggagcttttcgagcgcaacctgcttataaaggcccgcgagaaggatgcacacatcgtgctgccggaaggtgacgacgaccgcatcctcaccgctgctgaccagctgctgcgcgccaaggtatgtcggctgaccattctgggtaacccggacgagattgccggccgtgccaaggagctggggttggacctgtccggcgccacgctgaccgacccgagcgaaggcaaccagttggaggagtttgccaccgagttcgccgagctgcgcaagcacaaggggatcacgctggagcaggcgcgggagacgatgcaagacatcagctactacgccacgatgatggtccacaagggcatcgccgacggcatggtttctggcgcggcccacacgaccgcacacaccattaagccctcgttccagatcattaagaccgcaccgggagcgtcggtggtcagctccatcttcctgatggtcatggatggtgtgctgtgggcatttggcgactgtgccgtgaacccgaaccctacttccgaccagctggcagagatcgccgccgtgtccgccaaaaccgccgcgcagttcggcattgagccaaaggtagcgatgctgagctactccaccggaacctccggtgcgggcgaggacgtggaggcagtcgccgccgccgtgaagaaggctcaggaggacaacccggacctgccgctggatggtccgctgcagttcgatgccgcagtggtggaatccgtcggccagaagaagctgccgggctctgacgtggccgggcaggcaaccgtgttcgtgttcccggacctgaactgcggaaacattacctacaaggcggttcagcgcaccgccgacgcattggctgtggggccgatcctgcaggggctgaacaagccggtgaatgacctctcgcgtggcgcgaccgtgccagacatcgtgaacaccgtggcgatcactgcgatccaggccaaatag

SEQ ID NO: 1006 - DNA, 1344 bp, Corynebacterium urealyticum DSM 7109
gtggcggcagcagcgccgaccttttttgaacacatccgtccgtcccacccggacttccctcaggctctggaattcggcagcaccaccagcgccgacgttctcgtcggcacggggtccgtttccttcgacgcccgcctcgccggcgcgctgggcgcctctcacatcctcgtcgcaggttccgacgccgaccgcatctccgtgcagcagtccctcggccagctcgtccgcatcggtcgtgtcccggcgggcatcgcgatgttggaaggccccgccagcacctcctccgcactggagtgcgagggcgaggccatcagctacgtcgatcttggcagcgtccacaagtccgagactcgcgagccgatcgtcggcccggagctcttcgagcgcaacctcatcatccaggcccgtgagaagaacgcgcacatcgtcctgccggagggcgacgacgaccgcatcctgcaggcagcccaccagctgctggagcataacgtctgccgcctgaccatcctgggcgacccgagcgcgatcgctcagcgcgcccgcgagctgcagctggacctttccggcgctaccctcacgaacccgaatagcggtacccagctggaggagttcgcccaggacttcgcggagctgcgcaagtccaagggtgtgaccctcgacgaggcgcgggagaccatgaaggacatctcctactacgccacgatgatggttcacaagggcctggccgatggtctggtctcgggcgcggcgcacaccaccgcgcacaccatccgcccgagcttccagatcatcaagaccgccccgggcgcctctgtggtcagctccatcttcctcatggtcatggacggctacctgtgggccttcggtgactgtgcggtcaacccgaacccgacggccgagcagctcgccgagatcgccgcggtgtccgcgaagacagccgcccagttcggcatcgacccgaaggtcgcgatgctctcttactccaccggaacctccggtgcgggcgaggacgtcgaagctgtcgccgccgccgtcgagaaggcgaaggcagacaacccggaactgcagctggacggaccactgcagtttgacgccgctgccgtcgcctccgtgggtcagaagaagatgccggaatcggacgtggcaggcaaggccaatgttttcatcttccccgatctgaacagcggaaacatcacctacaaggcggtgcagcgcacggcgaacgcattggcggtcggcccgattctgcagggcctgaacaagccggtcaacgacctgtcccgtggcgcgaccgtcccggacatcgtcaacaccgtggcgatcaccgcgatccaggccggctaa

SEQ ID NO: 1007 - DNA, 1557 bp, Corynebacterium kroppenstedtii DSM 44385
atgccgtgtgccctatatatcgacgtcggaggagcttttggaacgtcggcaggcgacgccctaccagcaccccttcagggaaatgtcacccgaattatctccggagagccgggatcacccgctgacccctcagcgctcgttgcagaggcagtggagaaggtctcccaagggaaggcatccgaacagaaggcctccccatccgacgaattgcagggcgcgctcgttgccaccggagacatcaccgtcgattcgcgcatcgcggccagcatcggcgtcccggtcgtcctccttttccttgccgacgtcacccccgacgcacttcgcgtctcacttagcatctccacagtcgagggcgaaggggccacggtcgcggccatcgttacccgcgacgggaaccccatcgacggcgtcccgtccagcatccccgtcatcgcagcatccgacgaagccgcgctcgactccgcggtgtcgtcggcaataggggagagcggccacctcgaaccggtcatcggcccagaagtgttccagcacaacctcatcgaccaagcccgcgcctccggagcgcgcatcgttctccccgaaggcgacgacgaccgcatcctccgcgcggccgactggctcctcgagcaccacgtctgcgacctcaccatcctcggcaaccccaacgacatcgctgcgcgggccacagaactcggcctcaacctcagcgacgccaccatcgccgacccccaaggcaccgacgacgaatccgtcgagcaggccgaaaaattcgccgctaccttcgctgagctgcggaaaaagaaaggcatcaccctcgacgacgcccgggagaccatgaaagacatctcctactacgccaccatgatgatctacgacggccaagccgacggcatggtgtccggcgccgcgcacaccaccgcgcacaccatcaggccagcgctacagatcatcaaaaccgcgccgggctcgtccgtcgtttcttccatcttcctcatggtcatgcgcgggaaactctgggccttcggggattgctctgtgaaccccaaccccacctccgagcagttggcagaaatcgccgtcacttccgccgacactgccgccagcttcgggatcgacccccgcgttgccctcttgtcctactcgacgggatcctccggagcgggcgatgacgtcgataaagtcactcgcgcggtcgagctggcgcaggctaaagccgccgacacgtcgcggaacggtagccccatcgctatcgacgggccaatccagttcgacgcagccgtcgagccctccgtcggcaagaagaaaatgcccgagtccgacgtcgctgggcaggctacggtcttcgtcttccccactctcgacgcggggaacatcgcgtacaaggcggtccagcgcaccgcgaacgcgctggctgtgggcccggtgctccagggcctgaacaagccggtcaacgatctctcccgcggggccaccgtgccggacatcatcaacactgtggccgtcacagcagtgcaagtggccgcacagaccagcacccgcgattccgcacagtcctga

SEQ ID NO: 1008 - DNA, 1527 bp, Corynebacterium amycolatum SK46
gtgagcgataagaacgcccaagcgtccaccaacaactccgcagtcctgattacttcagtggaccgcgcagacgatctgcaagatgtcattacggcattgtctgaggcactgggtggggcacgttgcctccacactgtcggtggggcgcacggcgccaccgtggatcaggttgttgtggatccggaatccgcgcttgacaccatcgtcagtgctgttgaggctgaccgcgctgctaacgagggggcggctgttctgaccggctccggcaacctcgattttgacttccgcattgccactgtcgccggtgccggtgtcatcgttgtcgctggtggcgagggctgccacacagaggccgcgaaggctcgcgttcgtttggcgctcagcagtgcagctcagcgtcacagcgaggtactcgctgttgtcctcacaggggaggaggcagccgaggttgctaggactctcgagctcgacgttcccgttgttgccgttgacgatgccgaggagctgcgcaaggtcgtaagccgcgaggtcaccgcagtgatgactccacagcgtttccagtggtggctgttgcagcgcgctaaggctgataagcgccacattgtgctgccggagggggacgatgaccgcattcttgaggtcgctgattacctcctgcgcgaggacatctgtgagctcactatcctcggcgccccggatgcgatgaaggcacgcgccgccgaactgggttttgacatcgacgccgcccatctctggaacccgcagacctccgaatatgttgagcggttcgcggaacagttcgcagagatgcgcaaggccaagggggtcacgctggagcaggcccgtgagacgatgcaggacatctcctacttcgcgacgatgatgattcacaacgggcttgtcgacggcatggtgtccggtgcagcccacacaactgcgcacaccattcgtccgtccttgcaaatcattaagaccaagccgtcggcttccacggtgtcgtcactgttcctcatggttatggacaactcgctgtggggttttgcggactgtgcggtgctgccgaagccggctccggaacagctgggtgaaatcgcggtagtatccgccgagactgcagcttccttcggtatcgacgcccgcgtcgccatgctgagctactccactggagcatccggcacaggtgaggatgttgaccgtgtgaaggcgggtctggccaaggccaaggagctggctccggacctcgctgtcgatggtccgctgcagtttgacgccgctattgacccgtctgtggctgcgaagaagatgccggattcctccgttgcgggtaaggcaactgttttcgtgttcccggatctggacgccggtaacatcggttacaagattgcccagcgctgtggtggtgcattggcaatcggcccgattctgcagggcttgaacaagccggtcaacgacctttcccgtggcgccacggtgccggacatcatcaacacggttgcaattaccgctattcaggctggaggaaactaa

SEQ ID NO: 1009 - DNA, 1503 bp, Neisseria flavescens NRL30031/H210
atggcaaaaatcctgatcgcaccggtatccgccggcctgagcgccgatgcagcggcaaaagcatttgcagcagcattgaatgcgcaagttttccaagccgttgactccactacagaagccctgttggctcaaggcaagagcgacgactggtttgacgcgcttgtcggtaaagttgcagcattgaatgcagacaatctcgttatcgaaggcatcactcctgatgcggacaaattgttcttggcaggcaaaaacgtcgaattggcgctgtctgtagatgccggtgttgtgttggcactgaaatccgacaacactgatgccgctgccgtcacccaacaattgaatcttgccaaacagctctataccaactctccaggcttattggaaggtttcatcattgacggcgcagccgctgctttgggcgcacaagttgccgagcaaaccggcctgactttcttcggctccagcgacaaactgaaagacgtatccgctttggccaaacgcgaagccaaacgcctgtctccagcccaattccgttacaacctgatcgattttgcccgcaaagccgatatgcgcatcgttctgcctgaaggcgcagaaccgcgcaccgtcgccgctgccgccatctgccacgaaaaaggcatcgcccgttgcgtactattggctacccgcgaagaagttgaagccgtagctaaagagcgtggcatctccctgcctgattctttggaaatcatcgatcctgcttctttggttgagcaatacgtcgagccaatgtgcgaattacgcaaatccaaaggcctgactcctgaagatgcacgcaaacagctgcaagataccgttgtactcggtaccatgatgatggctcaaaacgacgtagacggtttggtttccggcgcagtccacactactgccaacaccatccgccctgccctgcaactgattaaaaccgctccgggtgcaagcctcgtatccagcgtattcttcatgttgctgcctaaccaagtattggcatttgccgactgcgcggttaatccaaacccaacgcctgaacaactggccgacattgctatccaatctgccgacagcgccaaagctttcggtatcgatccaaaagtagccatgatttcctactctaccatcaactcaggcagcggccctgatgtcgatgcagtgatcgaagcaaccaaactggctaatgaaaaacgccctgatttggccattgaaggtccgttgcaatacgatgcggctaccgttccatctatcggtcaaaccaaagccccgggcagcgctgttgccggtcaagcaaccgttttggttttcccagacctcaataccggcaactgtacttacaaagccgtacaacgcagtgccaacgtcctgagcgtaggcccgttgttgcaaggtttgcgcaaaccggttaacgacttgtcccgcggcgcattgattgaagacatcgtattcaccatcgccctgactgccgttcaagccaaacaaatgcaaggctga

SEQ ID NO: 1010 - DNA, 1503 bp, Neisseria sicca ATCC 29256
atggctaaattattagtcgctccggtatccgccggtttggacgtggcagcagcaagcaaagcctttgcccaagctttgggcgcgcaagttttccaaccgctcgacgcatccgccgaaactctgttggcacaaggcaaaagcgacgactggtttgacgctgtggtcggcaaagccgtcgcactcaataccgacaaactcgttatcgaaggtatcgcccccgatgcggacaaactcttcctgtccggcaaaaacgtcgagctggcattgtctttggatgcaggcgtagtcttggcattgcaatctgatagtgctgacgcagccgaagtggcacaccgaatcaaccttgccaaacagctttacaccaactctccgggccttttggaaggcttcatcattgaaggcgcggcagcatccgtaggcgaagaagttgcccgcctgaccggactgacattctacggctcaagcagcgcgctcaaagacgtatctgcgttggcaaaacgcgaagcctcccgcctttctcccgcccaattccgttacaacctgattgattttgcccgcaaagccgatatgcgcatcgtcctgcctgaaggtgcagaaccgcgtaccgtcgccgcagccgccatctgccacgaaaaaggcattgcccgctgcgtcttgcttgccaaacgcgaagaagttgaagccgttgccaaagaacgcggcatcaacctgcctgactctttggaaatcgtcgatcccgctacattggtcgaacaatacgtcgagccgatgtgcgaattgcgcaaatccaaaggtctgacccctgaagatgcccgcaaacaactgcaagacaccgttgtcctcggcaccatgatgatggcgcaaaacgacgtggacggcttggtatccggcgccgttcatactaccgccaacaccatccgccccgccttgcagctgattaaaaccgcaccgggcgcgagccttgtatccagcgtattctttatgctgctgccaaaccaagtcctcgtcttcggcgactgcgcggtcaacccgaacccgacgcccgaacagcttgccgatatcgccatccaatctgccgataccgctaaagccttcggtattccgcctaaagttgccatgatttcctactccaccatcaactcaggcagtggccctgatgtcgatgccgtgattgaagccaccaaactggcaaaagaaaaacgcccggatttggaaatcgacggcccgctgcaatacgatgcggctaccgtgcctgaaatcggcaaaaccaaagcccctgaaagcaccgtcgccggtcaggcaaccgtcctgattttcccaaacctcaacaccggcaactgcacctacaaagccgtacaacgcagcgccaacgtcctgagcgtcggcccgcttttgcaaggtttgcgcaaaccggtcaacgacctctcccgcggcgcattggtagaagacatcgtcttcaccatcgccctgacagcggttcaggcaaaacaaatggcaaactga

SEQ ID NO: 1011 - DNA, 1635 bp, Neisseria meningitidis 053442
ttgtttgctatattcaacctgcgcgcctcaagccaaacacggcacgcacggcacgcaggcagccgtttctgcctatatgccgccccttccaaccacatatgccgcacaccgcagcatacgaaaggatatatcatggcaaaagtactcatcgtacccgtatctgccggactggacgcctccgccgccgcacaagcctttgcaaaagcactggacgcacaaattttccaagccgttgacgcaaccgccgaaaccctgctcgcgcaaggcaaaagcgacgactggttcgacgcactggtcggcaaagttgccgcactcgatgccgccaacctcgtcatcgaaggcatcgcgcccgatgccgacaaaatctacctcgcaggcaaaaacgtcgaactggcattgtcccttgacgcggcagccgtcttcgccgtccgttccgacaacgccgatgccgacgaactggcaaatcggctgaaccttgccaaacagttcttcgccgccgcgccgggcgtattggaaggttttgtcgtggacggcgcggcagcctccgttgccgaagcggcagccgaaaaaaccggcctgaccttcttcggttcgagcgacgcgctgaaagacgtatccgtattggcaggccgcgaagcaaaacgcctgtcgccggcgcaattccgctacaacctgatcgacttcgcccgccaagccgacaaacgcatcgtcctgcctgagggcgcagaaccccgcaccgtccaagccgccgccatctgccacgaaaaaggcattgcccgctgcgtcctgcttgccaaacgcgaagaagtcgaagccgttgccaaagaacgcggcatcagcctgcccgactctttggaaatcatcgatcccgcctcattggtcgaacaatacgtcgagccgatgtgcgaactgcgcaaatccaaaggcctgacacccgaagacgcgcgcaagcaactgcaagacaccgtggtactcggtacgatgatgatggcgcaaaatgatgtggacggtttggtatccggtgcggttcacaccaccgccaacaccatccgccccgctttgcaactgattaaaaccgcaccgggcgcaagcctcgtgtccagcgtattctttatgctgctgcccaaccaagtcctcgtcttcggcgactgcgcggttaatccgaacccgaccgcgcaacagcttgccgacatcgccatccagtctgccgattccgcaaaagccttcggcatcgacccgaaagtggcgatgatttcctactccaccgtcaactccggcagcggccccgatgtcgataccgtcatcgaagcaaccaaacttgcccgggaaaaacgccccgacctcgccatcgacggcccgctgcaatatgatgcggcaaccgtgccgggcgtgggcaaatccaaagccccgggcagccaggtcgcaggacaggcaaccgttttggtcttccccgacctgaacaccggcaactgcacctataaagccgtccaacgcagcgccaacgtcttgagtgtcggcccgctgctgcaaggcctgcgcaaaccggtcaacgacctgtcgcgcggcgcgctggtggaagacatcgtgttcaccatcgccctgactgccgttcaggcaaaacaaatggaaggctga

SEQ ID NO: 1012 - DNA, 1479 bp, Kingella oralis ATCC 51147
atggcaaacattctcgttctccccacttgcgcgcacgttgatgccgcagccgccgcccaaagcatcgccgccgccctgcccgatgcggtggtgttcaacccgttagccgatgccaaacgcgccgccgatttaatcgccgcgggcaaagccgacgactggtttgacgctttggtgggcgaagttgccgcgctgggcaaaaaaaatgtggtgattcaaggcattcaagccgatgcggaaaacattttcctcgccgcgcaaaacgtggcgctggcgacttcgtttaacgcgcaaatcgtgtttgccgcatccaacgaagcgggcgcggaacagcgcgtggcgttggcaaaacaagcgtttgcaggcaacaccgtattctttgcgggcgtggtgggcaatgccgctgccgcgcaagccaacgaattggcggatttgggcgcatcaggcagcctgaaaacggctgaattggcgcaaattgcggcggcgactaccgaccgcgtgtcgcccgcgcaattccgttacaacatgatggattcggcacgcaaagccaacaagcgcattgtgttgcccgaaggcgcagagccgcgcaccgtgcgcgccgctgcgatttgccacgaaaaaggcatcgcccgctgcgtgctgctggcaacccgcgccgaagtggaagccgttgccaaggaacatggcatcgcgctgcccgagagcttggaaatcattgaccccgcttcgttggtggaacaatacgttgcgccgatgtgcgaattgcgcaaatccaaaggtttgaccgaagagcaagcgcgcagccagctgcaagataccgttgtgctcggcacgatgatgatggcgcaaaacgatgtggacggcttggtatctggcgcggtgcacacgactgccaacaccatccgccctgcgttgcaactgattaaaaccgcgcctggcgaaagcattgtgtccagcgtgttctttatgctgctgcctgggcaagtggtggtatacggcgactgcgcggtgaaccccaaccccaccgccgagcaactggctgacatcgccatccaatcggcgaaatctgccaaagcgttcggcattgaaccgcgcgttgccatgatttcttactcaaccatcaattcaggcagcggccctgatgtggatttggtggtggaagccacgcgccttgtgaaagaaaaagcgcccgaattggcggtggatggcccgctgcaatacgacgcggcggtggtggaaagcgtggcgaaatccaaagcgccgggcagccccgtggccggcaaagccaatgtgttcatcttcccgaacctgaccaccggcaactgcacctacaaagcggtgcaacgcaacgccaatgtgttgagcgtgggcccgatgctgcaaggtttgcgcaaacccgtgaacgatttgtcgcgcggggcgttggtggaagacattgtgtacaccattgcactgacggcgattcaagccacgcaaaaataa

SEQ ID NO: 1013 - DNA, 1767 bp, Rhodospirillum rubrum ATCC 11170
atgaccccccatgccgatcggcgaaccctgttcatcgccgccaccaccgccctgcccggcctttcggcggtcagccaggggctggtccgcgccttcgagcgccagggtctgcgcgtcgccttcgccaagccggtcgccgaccacgccgccgtcggcggcgatggcgcaccctcggccgatttggccgggccgatcccggcgcggcgagccgaggcgatgatccgcgccggtcagcgcgacggtttgcttgaagagatcgtcgagcgagccgaacgggcgcggggcgacagcgcggttctggtggtggaagggccactgcccgatgccgatcacccgttgttggccgagcttggccgcgatctcggccgcagtctcgccgccgaggtgatcgccgtcgtctcgggcgaccgtccgagcccgaccgacgttctcgaaaccgtggccgacaccctttaccaccagggcgccgccgccctgagcggcgtcgtcatcacctcgatccgcgagggccagcagggggacgcgttgaaagcagccctggccggcctgaacctgccttgcccgttggtcgcgctgtttcccggcgaaagcgagcggtccctgctcggcctgatcggaggcgccgcgcccggtcgggcccgtggcttgggcgaagacgacgcaagcgtcgtctggttgatcgagcatatcgccgaccatgtggcgcgcggtcatctgaccgacccgtcgcccacccaccgcgcggcgatgccgccgccgctgtttcgccaccggctggtcggcgcggcgcgcgccgccgaccgacgcatcgtcttgcccgagggcgacgagccgcgcaccctgcgcgccgcggcgatctgcgccaaaaagggcatcgcccgctgcctgctgctcggcgacccgtcgcgcatccgcgcccttgcccaggccaatgccatctgtttgcccgataccatcgagatcctcgatcccgagctggtgcgcgggcgctatgtcgaggctttggtcgagatgcgccgggccaagggattgaccgccgttcaggccacagcccagcttgaggacacggtcgtgctgggcacggtgatgctggccttgggcgaggtcgacggtctggtctcgggcgccgttcacaccaccgctagcacggtgcggccggccctgcagctgatcaagacggcgcccggcgccagcatcgtttcaagcgtgttcttcatgctgatgcccgatcaggtgctggtctatggcgattgcgcgatcaatcccaatccgacggccgagcaactggccgatatcgctattcaatcggccgatagcgccctggccttcggcatcgagccgagggtggcgatgatttcctattccaccggcagttcgggggtgggcgacgacgtggagaaggtccgcgccgccaccgccctggccaagctcaagcgccccggcttgatgatcgacgggccgatgcaatacgacgccgccagcgtggaaagcgtcggccgccagaaggcccccgacagcccggtcgccggtcgggccaatgtcttcgtcttccccgacctcaacaccggcaacaccacctataaggcggtgcagcgctcggccaatgtggtcagcgtcggcccgatgcttcagggcctgcgcaagccggtcaatgatctgtcgcgcggcgccctggtcgacgacatcgtctataccatcgccctgaccgccatccaggccgaccagggggaaccccggacgccgcacaccctggccaccgccgtctag

SEQ ID NO: 1014 - DNA, 2139 bp, Wigglesworthia glossinidia endosymbiont of Glossina brevipalpis
gtgtatgtgtctcgtacaattatattcgttccattagaaaaaagagttggattaaattacgtattttcaggaataattcaagccattaaaagaaaaaatataaaatttactgtatttcaaccgtttaaatattttaataatacaaaaaaaaatttcaatattattgattatacattaaaaaaatataatataaaaggtaatgatcataaagaacaattttcctttgattatatagtaaatgttttatcatctaacaaaaaaaattttttattagaaaaaatagttgaaaatttttacaaacaaaaaaaaaataatgaaatagttttaattcctggaatcaatatatataatggttatgaatttttggaaaaattgaattatgaattagctaaaatattagatgcagaaatagttttaatattaagattatacaaaaattttttggattatattaaattattatcttttaagttcggatttgaaaagaaaaataaaatttctgggattattttaaatgaattagattgtacaaaaaattcaaatcaatctattgattgtaaaagattattaaagaacgataatttatatgaaataaaaaaaaataatcatgagaactgttcattgataaatgaaaaatctataccaattatttcaaaaataccttttaatgaagatttttattttgtatatctatacaaaattaaagaacattttaaagcaaaatttttaaacaagaattataattatgtcataaaatcaattttattttgtgaagtatataaagaaaacatatttaaaaataattttaaacaatcattattagtgatatctaagaaacaaataaataaattttgtttgatgcatttaaaagaatcaaaatataatttttatagctcaatactaattattggatgcgacaaaaatgaaaatgaaataaaagttttttgcgaaatagcagaaaaaaaaaagatatcagttatatataataatatgagttttataaattttttttattatttaacaaaatttaaatttaatttttacaaaaaatttaatgatattattaaaataagtaattatatttctaattatatttcagatatttggatttctaatttttctttaaaaaaaaaagaaaaaaaatttttttctccagaaatatttcaatataatattttacagttatctcgttatacaaagaaaagtattatccttccagaaggagaagaaattagaatattatgcgctgcaaacatatgttcaaaaaaaaatattgctcattgcatattattaggcaatcctaaaaatattttagaaaaagctcgtttgaatggaattactatagaaaaaaatattgatattataaatcctgtagaaatacgtgaaaaatatatttctcatattattaatttaagaaaaaaaaaatgcatatcagaaatttcagcaagaaagcaaataaataaaaatattgtattagctactcttatgttaaacgaagggatagtagatggattagtttcaggagctacaactactacagcagacactcttagaccagcatttcaatttatcaaaactgatcctaagcattctttgatatcttcaattttttttatgctattaccagaacaaactttaatatatggagattgtgctattaatatcaatccgaattctaaacaattatcagaaattgcttttcaatctcataattctgcaatccaatttggaatagatcctaaaatagctatgatttcttattctactggatattctgggcaaggagaaagtgttgaaaaagtcagacaagcaactttaattgcaaagaagagttatcctaagttagttatagatggtcctttacaatatgatgctgcgacagttaaaagtgttgcaaaatctaaagctcctttttctgaagtagcgggaaaagcaacagttttgatatttcctgaattaaatacaggaaatactacatataaagctgtgcaaagatcatcaaatataatttgtataggtcctgttttgcaaggcataaaaaagccagtaaatgatttatctagaggagctagcatagatgatatagtatatactatagctataaccgctattcaatctattaaaaaagatcaaaattaa

SEQ ID NO: 1015 - DNA, 2148 bp, Buchnera aphidicola str. Bp (Baizongia pistaciae)
atgacacgaacaataatgctagttccaatagggaaaaatattggactaactactattagcttaagtgtaatttcagctatgaagcgttgtaagtttaatgtcaaatttttaaaatctgctattgagtattctaatactaattataatattgatgatacttctttaattttaaaagatacgcagtctttgtcttacattaatcctttaattgttgatttcattaatcaattttctttaaaacaaattaagcaacgaattgtagattatattttatcgaaagtatatgcaaaaaaagaaaaatatgacatttttttaatagaaggttttgatactaaatctcatacttatgtattatctaatgacattaattattatatttctaagagtataaatgtagaaatagtttttgtttgtgctgtagatagatctagtcaattagatattaacaatattgtttatattataaataatgtttttaaaaaaaataaaaatataaatatacgaggtgtgattataaatgaattatgtcaaaaagtacgcaatgattatggaaatgttaatttgttcgatatgtttaaaagttcagttaaaaaaataaattttggtgatgtcaaatatgattttttatttcaaaaaaatggaattgaagttttaggttgtgttccatggattcataaattaatggaaccatcagtaaaaattttgtgtgataaatatttgggagctaatataatttatgatcgatgcatgaattctcagtatatcaaaacttttattatttatgatacgaacgaagatataaaaaatgcaaaaaaatttcatcgttctttgttaattattcctgctatatctaatgataaaataaaagaaatatgtgttcaaataaacaaaaataaaattttgattagtgctattttattaacaaattttttaaatgttcatgataagtgtacagattttattgatcaacttaaaatagctaattgtactatttgttctacacccaacgatgtttttacggtagtgtcgttattacataaatttaattttaaattagataacaaaaattatcagctaaacataattgaaaatgatatgtccagacatattaatttggattggattagatcattgaaacattcatatcaatataatagtatatgtttgccttcattgtttatatataatttaaagcatttagcgaaaaaatttatgaaaaatatccttcttccagaaggatgtgaacttagaataataaaagcggcttctatttgttcgaagaatgatatagcgtattgtacattattaggcaatcctaaaaaaattaaaaacatagctgagtctaataatattgttttaaattctaatatagagattatagatccaaaattaattagaaaaaattatgttgagcgtttatgtcatcttcgcagacatcatggaataactttagctcatgctaatgaattagttaaagataattctattttgtctacgttaatattagaatctaaaaaagtagatggcttagtttctggatctattggtacgacttctagtattattcttcctgcattacaattaattaaaacgtctccgggttcttctttaatatcttctgtattttttatgttattgtcagattatgtaacactatatgctgattgtgctgtaaacattaatcctgatgctacacaattagcagaaattgcaattcaatcttcaaatactgcacgattgtttggaatatttcctaaagttgcgatgttatcttatgcaactggttgttctggttttggagatactgtagataaagttaaagaggctacaagaattgttcaagaacgttctccaaatttaattgttgatggaccaattcaatatgatgcagcaatcaatcgaagcgtagcaaaattaaaatgtccacattctttggtagcaggaaatgcaactgtgtttatttttcctgacttaaattctggaaatataacttataaagctgttcaacgttcagctaatattttgtcaataggacctattcttcagggaattaatcaacctgttaatgatttatcgagaggatcttcagttcaagacatagtatatactattgcagtcacagtattacagtctagtttatctcactaa

SEQ ID NO: 1016 - DNA, 1404 bp, Fibrobacter succinogenes subsp. succinogenes S85
atgaatcgtgtatacctagttgccacggctgcctccaacatggaagccaaagtccaggaacttgtcgacgctgttaccaaggctggtctcatcgctacagtctacaagccgcttgaagttttcaatgctgccgatagcgttgctgaaatcaaggccggcaagtctgccgtgctcatggaaaagatctgcgctgatttcctcaagcaggattttgacgatgtcgacgctgttgtcgtcgaaggtgcaacgggcatgaacgatgtcattgctcacaagtttaacgacgacctcgcctctgccctcgatgcaaagatttttgccgatggcgaagatgccgaactcttctgcccgaagcgcttgctccgttgcgaaaagtgcgttgctggtgacctcgccgctccggctgctgaacgccgcgtaagccaggccatgttccgcgcaagcctcctttccaaggcttccaagtgcgtgaagcgcattgtgctcccggaaggttctgaaccgcgtaccgtgcaggctgcctgcctcgctgttgaacgcaacatcgccgtgccggtcctcatcggcaagaaggccgatatcgaagctaccgcaaagtctgttggcgtgaagctcccggctaacatcgaaattatcgaaccgagcgcagaacttgctgaaaagtatgtgccgactctcgtggaactccgcaaggctaagggcatgactccggaatctgcacgcgctgctctttctgacaacgtaatgcttgctacgatgatgctcaagttcggtgaagtcgatggcctcgtttctggcgctatccactctactgccgatacgctccgtccggctctccagattatccgtaccgctccgggcgtgaagtccgtgagctccgtgttcttcatgtgcatgaaggacaagacttacatctacggcgactgcgctatcaacctgaacccgctcgccgaagaactcgccgatatcgctctccagtgcgatgacacggcaaaggcttttggcctcccgagccgcgttgctatgctctcttacagcaccatcaattcgggcaagggcccggatgcagacctcgtcgtggccgctactgccgctgcaaaggctgcccgcccggaaatgctcatcgatggcccgctccagtacgatgccgctaccgttccgagcgttggtgctctcaaggccccgaacagcccggtcgctggcaaggctaccgtgttcgtgttcccggacctctctgccggtaacatcggttacaaggctgtgcagcgttctgctcacggtacgatcgctatcggcccgatgctccagggccttgcaaagccggtgaatgatttgtctcgtggcgccctcgtcgaagacatcgtctacacgatcgccctcaccgctgttcaggcccaggcgtaa

SEQ ID NO: 1017 - DNA, 1194 bp, Mycobacterium tuberculosis T17
gccctggtttccggcctgcgattgcggttacctgtcatcgccacgcgtgggcactacgacaccgccagcgctgccgcgtcggcccgcgggctggtaacggcgacgtcgcaacgcaagatcgacaccgcgttggagctgatggaccgccacgtggacgtcgccggtctattggcgcagctgaccattcccatccctacggtcactacaccacagatgttcacttatcggctgctgcagcaggcccgttcggacctcatgcgcatcgtccttcccgaaggggacgacgatcgcatcctcaaatcggcgggccgcctgcttcagcgcggcatcgtcgacctgaccatcctgggcgatgaagccaaagtccgtctgcgggcagcggaactcggtgtggacctggacggcgccacggtaatcgagccatgcgcaagcgaactgcacgatcaattcgccgaccagtatgcgcagttgcgtaaggcgaagggaatcaccgtggagcatgcccgcgaaatcatgaacgatgccacatatttcggcaccatgctggtgcacaactgtcatgccgacggcatggtatcgggtgctgctcacaccacggcgcacaccgttcgtccggcgctggagatcatcaagaccgttccgggcatatccaccgtgtccagcattttcctgatgtgtctgccggatcgggtactggcgtacggcgactgcgcgatcatcccgaacccgacggtggagcagctcgctgatatcgccatctgctcggcacgcaccgccgcacagttcggcatcgagccccgggtggccatgctgtcctactccaccggtgactcggggaaaggtgccgacgtcgacaaggtcagagcggcaacggagttggtgcgcgctcgggagccgcagctgccggtcgagggtcccattcaatacgacgccgcagtggaaccgtcggtcgcggccaccaagttgcgcgattcgccggtggccggccgcgcgacggtgctgatcttccccgatctcaataccggcaacaacacctacaaagcggtgcagcgttctgcgggtgcgatcgcgatcggcccggtgctgcagggcttacgcaagccggtgaacgacctatctcggggtgcactggtcgacgacatagtcaacaccgtggccatcacggcgattcaggcgcagggcgtccatgagtag

SEQ ID NO: 1018 - DNA, 1059 bp, Capnocytophaga gingivalis ATCC 33624
ttgtggttcagaaggaatattaaaaaaaatagaacgataatgaacacatctgacgcaacgcctgatacctccaagaagttccaaaattacatggtagaaacggctaagaaacttcaaaaacgcattgttcttcccgaaggagaagataagagaatcctctctgcagcagctaagcttgctgaagatggattggcttatttgactatcttaggagaagaaaaagaagtcctcgctcgtgtggatgagttaggccttacttggaaccctgagcgtatccaaattgtctctcctaagaagaaccctaactatgaggcttattggaagaaattgtatgaaatacgcaaagaaaaaggcatgactgaagcacaagctcaagagctgatgcttgatgtctcttactatggtactatgatggtattcatgggagaggctgacgggatggtatctggagcagtgaactccacagcacacaccatacgcccctctttgcagtttgtcaaaactaagaaaggcgtgaagacagtctcttcagtcttctttatgatcttacctgatcgtgtattggtatatggagactgtgcggtagtgcctaagcctacagcagaacaattggctgaaattgctatcacctctgccgagtcagccaaagcctttggcatagaacctaaagtagcccttctttcttactcttcaggtacttcaggaagtggagaagatgtagacaaagtgcgtgaagccactgagatagtaaaagcacaacgccctgatctacttgtagaaggccctatccaatacgatgccgcagtggatgccactgtagccaaacagaagatgccagattctcctgttgctggtaaggctaatgtacttatttttccagacctcaatgcaggaaatatcacttacaaagccgtacagagagaaacgcactctatcgctataggacctatgctacaaggcttgcgcaagcctgtaaacgatcttagtcgtggggctacagtacctgatatttacaatacagtgcttatcaccgctattcaagcaggaatgcaagaataa

SEQ ID NO: 1019 - DNA, 999 bp, Candidatus Sulcia muelleri SMDSEM
atgtatattactccacaaaagtttaaaaaaaaaattttttttctaagtaaaaatgcacaaaaacatatagttttacctgaaggagaggaagaacgtattattatagctgcatcaatttttatatataataaacttggaaagttaactttattaggtgataaaaaaaaaattaaaaagaaaattaaaaatttaaatttattttgggatgaaaaacaaataaaaattataaatcctaaaaattctatatatttaaatgaatttgctgaaactttttatgaattaagaaaagagaaagggattaaatttgaagaagcaaaagttcttatttcagatttttcatattttggaactatgatggtttataaaggaataactgatggaatggtttcaggagcagtgaatactactgctaagacagttaggccagctttacagataataaaacctaaaataggtataaaaactgtatcatctatgttttttatgttattacaaaaacgtgtaataatatattcagattgtgctattatttctacaccgacatcagaacaattagctgatatagcaatatgttcagcagaaactgctaaattatttggaataaaacctaaaattgcaatgttatcatattcatctggcaattctggattgggaaaagaagtagagaaagttagaaaagcgacagagattgtgaaatacattaatcctagtcttagaatagatggtccgattcaatatgatgctgcagtagagaaaaaaatttgtaaaaaaaaattacctaattcaaaattagaaggtaaagctaatatatttatttttcctgatctgaattcagggaataatacttacaaagcagtaaaacatgaaactaaatcgatttcgattggaccaatattgcaaggattaaaaaaacctattaatgatttaagcagaggatctactgtaaaagatatatataatactattattattacttgtatacaagctcagaaaaaatga

SEQ ID NO: 1020 - DNA, 990 bp, Corynebacterium glutamicum
atgagcgccgaactctttgaaaactggctgctcaagcgcgcacgcgcagagcactcccacattgtgctgccagaaggtgacgacgaccgcatcttgatggctgcccaccagctgcttgatcaagacatctgtgacatcacgatcctgggcgatccagtaaagatcaaggagcgcgctaccgaacttggcctgcaccttaacactgcatacctggtcaatccgctgacagatcctcgcctggaggaattcgccgaacaattcgcggagctgcgcaagtcaaagagcgtcactatcgatgaagcccgcgaaatcatgaaggatatttcctacttcggcaccatgatggtccacaacggcgacgccgacggaatggtatccggtgcagcaaacaccaccgcacacaccattaagccaagcttccagatcatcaaaactgttccagaagcatccgtcgtttcttccatcttcctcatggtgctgcgcgggcgactgtgggcattcggcgactgtgctgttaacccgaacccaactgctgaacagcttggtgaaatcgccgttgtgtcagcaaaaactgcagcacaatttggcattgatcctcgcgtagccatcttgtcctactccactggcaactccggcggaggctcagatgtggatcgcgccatcgacgctcttgcagaagcacgccgacttaacccagaactatgcgtcgatggaccacttcagttcgacgccgccgtcgacccgggtgtggcgcgcaagaagatgccagactctgacgtcgctggccaggcaaatgtgtttatcttccctgacctggaagccggaaacatcggctacaaaactgcacaacgcaccggtcacgccctggcagttggtccgattctgcagggcctaaacaaaccagtcaacgacctttcccgtggcgcaacagtccctgacatcgtcaacacagtagccatcacagcaattcaggcaggaggacgcagctaa

SEQ ID NO: 1021 - DNA, 990 bp, Mobiluncus mulieris ATCC 35243
atgagtggttttaaggattcatttgtggccaacctggccaagcgagcggccgcgaatcggaagcggattgtactgcccgaggccactgacgaacgggtgctgcgagccgcagctcaggtgttacaagatggttcggccgaagtcatctttatcggcgaaaaagctgagattgacaccaaggctcgagtgcttggcgtggatttatccgctgccacggtggtttcattggacgacaccacccggctgaaccgctatgttcctaaactggtagagttacgccagcataaggggatgaccgaggaaaaggctcgggaaaccctcaaggatatttccttcttcgctaccatgatgattgtgtgcggggatgccgatggcatggtgtccggcgcggcacacaccaccgcccatacgattcgccccgctttgcaggttatcaagacccgcccgggcgtaaaactggtcagcggcgcattcctgatggtcttcgacgaccacttcgatgtgtattccgactgcgcggtgactattgctcccacggcggagcaactggctgatatcgccgtggtttcggccgcgaccgccacccagttcggcttagaacctaaagtggcgatgctgtcttattccacaattgattccggaactggcccgatggttgacctggtgcgcgaggctaccgccttggccaaggcggcggctccagaaatggccattgatggaccgctgcagtttgacgcagccgtggtggaatcagtggccgccaagaaagcacctggttcaaaggtagcgggtcaagccaatacctttattttcccggatttgaatgccggcaatatcacatacaaggcggtacagcgcacttccggtgccttggctatcggcccggtattgcaaggcctcaacgccccggtcaacgacttgtcgcgcggcgccacggtggacgacattatcaacaccgtggttatcaccgctatccaggcgcaaggctag

SEQ ID NO: 1022 - DNA, 1002 bp, Mobiluncus curtisii ATCC 43063
ttggagctggacgtgagcgacttcaaaaccttattcctcaacggcttgactaaaaaagctgcgggcagtcgaaaacgcatcgtgttaccggaatcagacgatgatcgcgtgctgcaagctggcgctcgagtcttgcaaaccggcgccgcggacattgtgttcctaggagaaacggaacaaatcgcacaatctgccaaacgactgcacctagacctggacgcggctgaaatagttagtctccacgatgacgaaaagctggcacgatacaccgccaagctggtggaactgcgctcgcataagggtatggacgaagccactgcgcgggagactctaaaagatgtttctttctttggcaccatgatgattgtctgcggggatgccgatggcatggtttcaggagcggctcacactaccgcccacaccattcgtcccgcgctgcaactcattaagacccagcccggcgtgaaactggtttcgggggctttcctcatggtttttgacgatcattttgacctatatgcagattgtgcagtgacgatttccccggatgccgcccagctggcagacattgcggtggtttccgcaaagactgcggcccagtttggcttggaaccgaaagttaccatgctgtcctattccacgcttgactccggttcaggtccgctggttgacctggtccgggaggcgacggcaaaagcccgtgcggcagcccccgagttgtccatcgacggtccgctccagtttgatgccgcagtagtcgagtccgtggctgcccagaaagctccgcattcccccgttgccggacaaacaaacacgtttatcttccccgatttgaactccggaaacatcacctacaaagcagtgcagcgcaccagtggcgcgctggcggtgggacctatcttgcaaggactaaacgccccggtcaacgacttgtcacgcggagccaccgtggatgacatcagcaacaccatcgtcattactgctatccaagcccaaggttag

SEQ ID NO: 1023 - DNA, 960 bp, Eubacterium hallii DSM 3353
atgtttaaaaaattagcagaacagttaaaagcaaatgcacgtactatcgttttcacagagggaacagatgcccgtattcttgaagcagcagataaactgacaacagaaggcattcttggagttatccttcttggaaaggctgacgaagtaaagagtgcagcaaaagaagctggttttaatattgaaaaatgtcagatcatcgatccagagcagtatgcagaaatcgatgctatggttgatgagatggtaacattaagaaaaggcaagatgacaccagagcaggttcgtgaagccctttccaaatcaaactactttggaacaatgttagtaaagatgggcaaggcagattgtctgttaggtggagcaacatactctacagccgatactgtacgtcctgcattacagttaattaagacaaaaccaggcaacaagattgtaagctcctgcttcatcatggtaaaaggtgataaaaagttagcaatgggtgactgtgcgatcaacatcgctccaaatgaagacgagttagcagaaatcgctatcgagacagctaagacagcaaaaatctttggcattgatccaaaggtagcaatgttatcttactctacatatggttcaggaaaaggcgagatggttacattaatggccaacgctacaaagaaagtaaaagagatggctccagatttagatatcgatggagaacttcagtttgacgctgccgtagcaccagaagttgcaaaagtaaaatgtgcaggttctacagttgccggacaggctaatactttcatcttcccagaaatcagtgctggtaacatcggatacaagattgctgcacgtcttggtgaatacgaagcaatcggaccagttcttcagggacttaatgcaccgatcaacgatttaagccgtggatgtaacgctcaggaagtttacaaaatggctcttgtaactgcagcattaagctaa

SEQ ID NO: 1024 - DNA, 1053 bp, Eubacterium hallii DSM 3353
atgttaacaaaaatgattgaaacattaaagaagaatcctcgtaccatcgtatacacagaaggtacagataaaaggattcttgaatcagcccatcgtctgacacaggaaggaattctcggcgttgtccttcttggtaagccagaagaagttaaggctgcagcaaaagcaggtaactttaatattgatgcctgccagattattgaccctgaaaattacgagggaattgatgctatggtagcagagatggttaagcttcgtaaaggtaaaatgacagacgagcaggtaagagcagctctttctaagagcaactactttggtactatgctcgtaaaaatgggtggagcagactgtctgttaggtggagctacatattccacagcagatactgtacgtccagctcttcagctcatcaaaacaaaaccaggcaacaacatcgtaagctcttgcttcatccttgtaagaggagacgagaagattgctatgggtgactgtgctatcaatattgatccatccgaagatgatttagtagagattgctatcgaatctgctaagacagctaagattttcggaatcgatcctaaagtagctatgttatcttactctacacttggttctggtaaaggaccttctgtaacaaaggtggctaacgcaacaaagaagattaaagaagctgctcctgaattagcagtagagggtgagattcagttcgacgcttctgtatctccagaagtagcagaagtaaaatgtcctggttcaccagtagctggacaggctaacacatttatcttccctgacatcaacgcagctaacatcggatataagattgcttcccgtttaggtggatatacagcagtaggtcctgtattacagggacttaacgctccaatcaacgacttaagccgtggatgtaacgcagaagaagtatacagcatgtctatcgtaactgctgcattaagcgttccagaagaagaaaaagtagacgaagaaggattagaagctatcgtaagagcggtggtagaaacaatgctcgctgctaagaagctggataaataa

SEQ ID NO: 1025 - DNA, 1026 bp, Faecalibacterium prausnitzii A2-165
atggctgatatgttcgcaccgctggtagcacagctgaaggcaaaccccaagacgatcgtttttaccgagggcaatgacccccgcatcctggaggcagccagcaagctgctggccgagggcgttctgaaggttgtcatggtgggcaacgaggctgagtgcaaggctgctgctgccgcaggcaattttgatatttccgctgctgagatcattgaccctgagaactacgcaggtttcgacgagatggtgaacaccatggtcgagctgcgcaagggcaagcagaccgctgaagagtgcaccgcaatgctgaagaagtccaactacttcggcaccatgctggtcaagatgggcaaggctgactgcctgctgggcggcgctacttactccaccgccgataccatccgccccgctctgcagctggtcaagaccaagaagggcgcacacctggtgagctcctgcttcattctggaccgtgactttggcgaagagggcctgaagcgcattgccatgggtgactgcgctgtcaacattgattacaccgataccgttgataaggctaccggcgaggtcaagatcgctgcttccgcaaagctggctgaggtggccgttgagactgccaagaccgcaaagctgttcggcatcgatccgaaggtcgcagttctgagcttctccaccaagggttccggcaagggcggcaccgttgctctgagccatgacgctaccatcaaggctcaggagatggaccccgagctggctgtggacggcgagctgcagtttgacgctgccgttgctcccgaagttgcacaggtcaagtgcaagggcagcaaggtcgctggccaggccaacaccttcatcttcccctgcatcgaggccggcaacatcggctataagatcgctcagcgtctgggcggctacgctgcctacggccccattctgcagggcctgaacgcacccatcaacgacctgtcccgtggctgcaacgctgacgaggtctataagatgagcttgatcactgcctgccagtcctaa

SEQ ID NO: 1026 - DNA, 990 bp, Bacteroides capillosus ATCC 29799
atgattcccatggagatgtttaacaagctcatcgagaccctgaaggccaaccccaagcgcatcgtctttaccgagggcaccgacgcccgtatcctggaggccagcgcccgtctgctgaccggctcctggctcaagcccgtgctggtgggcaacgtggacgaggtgaagaaggccgccgctgagcacggcttcaacatcgacggcgccgagatcgtggaccccgagacctacgagggcatggaggccatggttgagaagatggttgagctgcgcaagggcaagatgactgccgacgagtgccgtgccgctctgaagaagggcaactacttcggcaccatgctggtgaagatgggcgtggccgactgcctgctgggcggcgctacctactccaccgccgacaccgtccgtcccgctctgcagctgatcaagaccaagcccggcaacaagatcgtctcctcctgcttcatcctggtccgtgagacctccaccggcggcgccgacgtgctggccatgggcgactgcgccatcaacatcaagcccagcgacgatgagctggttgagattgccctggagaccgccaagtgcgccaagatcttcggcatcgaccccaaggttgccttcctgagctactccaccaagggctccggcaagggcgaggacgtggacaagatgcgttccgcctgcgagaaggccaaggctgccgctcccgacctggccatggacggcgagatgcagttcgacgccgccgtgtcccccaccgtgggccagctgaagttccccggctccaaggtggccggctacgccaacaccttcatcttccccgacatcaacgccggcaacatcggctacaagattgcccagcgtctgggcggctttgacgcctacggccccatcctgctgggcctcaacgcccccatcaacgacctctcccgcggctgcaacgccgacgaggtctactccatggccatcatcaccgccgctctctcctga

SEQ ID NO: 1027 - DNA, 1053 bp, Roseburia inulinivorans DSM 16841
gtgccgaaaattgtgtttatccggtacatagacacggttttagagaaaaagaaaagtgaggaaaataaaatgtttggatttggtcagttaattgacatcttgaaaaagaacccgaaaaaaattgtttttacagaaggaaatgatcctcgtatcttagaggcagcttccagacttctggcaagcaatttcttacatccaattttagttggtaacccggatgagattgcaaaagtagcagaggagagcggtttcaatatccgtggagcagagatcatcgatccaatgaagtatgacagatttgacgagatggttgagatgttctgtgaacttcgtaagagcaaaggtgttacaccagagcaggcaagaggaattctttcccaggcaaactactttggtaccatgttagtaaaaatgggagttgctgattcccttcttggtggagcaacatactctacagcagatacagtacgtccagcattacagttgatcaaaacaaaaccaggtaacacgatcgtatcttcctgcttcatcatggtacgtccggcagctacgggcgagaacgaagtacttgcaatggctgactgtgcaatcaacattcatccaacagaggacgagttagtagagatcgctggcgagacagcagagtgtgctaagattttcggtatcgatccaaaggttgcattcttaagttactcaacacttggttccggtaagggcgaggatgttgacaagatgcgcaacgcagcagcaaaagcaaaagaaaaatatccagagcttccaatcgaaggagaaatccagttcgatgcagcagtttctccacgtgttgcacgtacaaaatgcaaagattctcaggttgcaggacatgcaaacacatttgtattccctgacatcaatgctggtaacattggttacaagattgcacagcgtcttggtaacttcgaagcttacggaccaatcttacttggcttaaatgcaccaatcaacgatctgtcccgtggatgtaacgcttctgaagtatattctatggcaatcatcacagcagcacttgcttaa

SEQ ID NO: 1028 - DNA, 1041 bp, Roseburia intestinalis L1-82
atgatatgcgctggtagagagcgccaattacaatttataaaaagtgaggaattaatcatgtttggatttggacaactgatcgacatcttaaaaaaagatcctaagaaaatcgtgtttacagagggcgatgatcctcgtattttagaggcagcttcccgcctgttagcaggaacattccttcatccgatcttaatcggtaatccggataaaattgctgctgaagcggaagagtgcggttttaatatccgtggagcagagatcattgatccgactaattatgacagaatggatgagatggtagatttattctgtgaacttcgtaagagcaaaggtgtgacaccggagcaggcaagaggtattctttcccaggcaaactacttcggaaccatgcttgtaaaaatgggcgttgctgatgcacttctcggtggagcaacctattcaacagcagataccgtacgtccggcattacagctgatcaagacaaaaccgggcaacacaatcgtatcttcctgctttatcatggtacgtcctgcagctaccggtgagaacgaagttcttgcaatgggtgactgtgcaatcaacatccatccgacagaggatgagttagttgagatcgcaggtgagacagcacagtgtgcaaagattttcggtgttgatccgaaggttgcattcttaagctactctacacttggttctggtaaaggtgaggatgtagataagatgcgtaatgctgcagccaaagccaaagcaaaatatccggatcttccaatcgagggagaacttcagttcgatgcagcagtttctcctcgtgtagcacgtaccaaatgcccgggcaatccggttgcaggtcatgcaaacacatttatcttcccggagatcagtgccggaaacatcggttacaagatcgcacagcgtcttggtaatttcgaggcttatggtccgatcttacttggattaaatgctccgatcaacgatctgtcccgtggatgtaatgcagcagaagtttattctatggctatcatcactgcagcacttgcataa

SEQ ID NO: 1029 - DNA, 984 bp, Eubacterium rectale ATCC 33656
atgtttggatttggtcagttaatcgaaatattaaagaaagacccaaagaaaatcgtattcacagagggagaggatccacgtatccttgaggcagcttcgcgtttacttgcaagcaactttttacatcctatccttgtcggagatcctgagaagattagtgcaagcgctgagaagagcggtttcaatatccgtggagcagagattatagatcctatgaactttgaccgtatggatgagatggttgaattattctgcgagcttcgtaagagcaagggtgttacaccggagcaggctaagggaattctttcatcagctaactactttggaacaatgcttgtaaagatgggtatcgcagactcacttctcggaggagctacatactcaacagcagatacagttcgtccggcattacagcttatcaagacaaagcctggcaacacaatcgtatcttcatgctttatccttgttcgtccatctgcaacaggtgagaatgaggtgcttgcaatgagcgactgtgctatcaatatccatccaacagaggacgagcttgttgaaatcgcaggagaatcagcagagtgtgctaagatcttcggtatcgatccaaaggttgcattcttaagctactcaacacttggctcaggaaagggcgaggatgttgacaagatgagaaacgcagctcacaaggcaagagagaaatatccaaatcttccaatcgagggagaaatccagtttgacgcagcagttgcaccacgtgtagcccgcacaaagtgcccacagtctgaggttgcgggtcatgcaaatacatttatcttccctgacatcaacgcaggaaatatcggatacaagattgcacagagacttggtaatttcgaagcatacggcccaatccttcttggactcaatgctccaatcaatgacctttctcgtggatgtaatgcaggagaggtttactcaatggctatcatcactgcagcacttgcataa

SEQ ID NO: 1030 - DNA, 1050 bp, Clostridium sp. L2-50
atgattcgtataaataatcaatggaggactataatcgtggaagaacgtaaaaattttggtttcggtgtattgatcgatattttgaagaaaaatccaaaaacaattgttttgactgaaggtactgatccccgtattctggaagcatcttcaagacttcttgcaagtaacttcctgcatccgattcttgtaggagatcctgataagatttatgaagttgcagaggaaagcggttttaatataagaggttccgagatcattaatccaaggaattttgatcgtatggatgagatggtcgagatgttctgtgaactcagaaagagcaagggcgtgacaccggaacaggcaagagagatcctgtatcagaataactattttggtactatgcttgttaagatgggaattgcagattcacttcttggcggtgctacatattcaacagcagatacagtaagacctgctttacagctgatcaagaccagaccgggcaacacactggtttcatcctgtttcattctggtacgtccatttgcaacaggtggtaatgaagtgttcgctatgggtgactgcggtatcaacatcaagccaaacgaagatgagctggttgagatcgcagaggagacggttcgttgtgcaagaatcttcggtgtagatccaaaggttgcattcttaagctattcaacctatggttccggtaagggcgaagatgtggataagatgagaaatgcagcaagaaagacaaaggagcgtaacccggatcttccgatctccggtgagatccagttcgatgcagccgtatcacctagagttgcaaagaagaaatgtccacagtcagaggttgcaggaaatgcaaatacctttatcttccctgatatcaatgcaggaaatatcggttataagatcgcacagagaatgggtaacttctcagcatatggcccgatcctgttaggacttaattctcctatcaacgatctgtccagaggatgtacagcagatgaggtttattctatggcgatcatcacagcggcattagcagataataaagatgcataa

SEQ ID NO: 1031 - DNA, 987 bp, Shuttleworthia satelles DSM 14600
atgggttacggatttggtgcaatgatcgatcgcctgaaggcgaatccaaagaagatcgtatttacagagggcagcgatgagcgcatccttcaggctgcttccaggctgctggccggtacctggctgcagccggttctggtcggggatccgaaggagatccatcgcgttgccgaggcggacggggataatatcaatggcgccgctattattgatcccaacaactttgaccgcatggatgagatggtggatctctttattgagctgcgcggcgccaaggcaggcacaagagagcaggcggtcaagactttaaagcaggccaactatttcgggacgatgctggttcgcatgggctatgctgattccctgctgggaggcgcaacctattccacagctgacactgttcgtcctgccctgcagatcatcaaggctgcccccggcaacagcattgtctcctcctgctttattctggttcgtccttccgcaaccggcggaaatgaggttctctgcatggctgactgtgcgatcaacctggttcccacagaggatcagctggtcgagatctgcgggcaggccaccaagtgcgcggagcgcttcggcgtcgatcccaaggttgccttcttaagcttctccaccaagggatccggcaagggagaatcagtcaccaagatgcagaacgcaacggccaaggccaaggtcaagtatccggaccttcccattgagggggagctgcagttcgatgcggctgtttctccaacagtagcccgccagaaggctcccgactcccagattgcaggccactgcaatactttcatcttcccggacatcaatgccggaaatctcggctataagatcgcccagcgtatgggtaatttcgatgcctacggccccattcttctcgggttaaatgcgcccatcaacgatctctcccgcggatgcaattcccaggaggtatatgatatggcgatcgtgactgcttctctggcttaa

SEQ ID NO: 1032 - DNA, 972 bp, Eubacterium biforme DSM 3989
atgattattgatgaattagaaaaaaaggtccaaggaaagggagtacgtattgtattcactgaaggatgggatccacgtgtacaaaaggcagctattgatttgaaaaacaatgatgttgtttgtccagtattattaggaactccagaagaaatcgctggttgtgcacaaaaaaatagtttaaatgttgaaggaatcgaacaaattgatccaaataatttcgaacatatggatgaaatggttcgtaaaatggttgagttacgtcgtggtaaaatggacgaagaaaaagttcgtacagctttgaagagcacaaactattttggaactatgttagttcaaatgggatacgctgatggattattaggtggtgctacatattctacagcggatactgtacgtccagcattacaattggtaaaagcagctccaggaaacaaattagtttcttcttgcttcattttaattaaagaagaaactcaattgatcatgggtgactgctcaattaacatcaacccaaacacagatgatttagtagaaatcacaatgcaaacagctaagtcagctcgtcaatttggtgtagaaccaaaagttgcattattatcatattcaacaatgggtagtgcaaaaggtgaatgtgttgctaagatgactgaagcaagcgatcgtttacgtcgtattgctgacttcgatatcgatggagaaatgcaatttgactgtgcagtaagtgaagaagttgctagtttaaaagctcctaattcaaaagttgctggacatgcaaatacttttatcttccctaacttgtcaagtggaaatattgggtacaaaattgccgctcgtttaggtggatatgaagcagttggaccaatcttacaaggattgaatgctccaatcaacgacttgtctcgtggatgtacttcagatgaaatctacaagatggctattgtaactgctgctcaaaaagatatggatatctaa

SEQ ID NO: 1033 - DNA, 1011 bp, Eubacterium dolichum DSM 3991
gtgtataataaagccgaagagaaagtgaggatttttttcatgatcaataagcttattgaacaaattaaaggcaagggagtacgtatcgtatttactgagggaaacgatgcacgtattcaggaagccgctgttcgtttacacaaagaaaatatcttagttcctattttattaggagagaaagaggaattgttggaatccgcaaagaaaaacggatttgatttggacggcattgaattgttggatccaaaggaatatcagcacatggagctgatggtaacacgtgtggtagaacttcgtaagggtaaattggacgaagcacaggcaagagaggcttgcttgcaccgtaatttcttcggtacgatgtatgtgcagttaggttgtgccgatggtcttttgggaggagctacttattcaactgccgatacggtacgtccggcacttcagttgattaaaacacgtccgggaagctcattggtttccagctgctttattcttcaaaaggaagatcagtatcttgttatgggcgattgctccatcaatattgatcctagtgcagatgatttggttgaaattacgttacagacagcacataccgttcgtcaattcggtattgagccaagagtcggtttattgtcttactcaacgttaggatctgcgaaaggaccaagtgtttccaaggttcaagaggctgctgtacgtttgaagcgtatgccacttgattttgcagttgatggagaaatgcagttcgactgctgtgttgcacctgaggttgccagcttaaaagcacctggttcaaccgttgccggtaatgtaaatacctttattttcccggatatcaattccggtaatatcggttataagattgcatctcgtttaggtggatatgaagcgatcggtccggttcttcaagggttaaatgctccgatcaatgacttatcacgtggctgtaacgcagaagaggtttataagatggcaatcgtaacagctgcacagaaattcatggatatttaa

SEQ ID NO: 1034 - DNA, 993 bp, Eubacterium dolichum DSM 3991
atgggaaagacaagaattttatttgcggaaggcaatgatgagcgtatgatggaggcggcagttcatttgcatgaagaaggatttgtagaacctgttttgttcggtgattacaatcaaatcatgacgattgcaaaacaaaaaggtaagcagctggaaggaatcgaaatcatggatccgtcaaacatcagcaatgagatcaaggaacagatggttatggaaatgattcatttgcgcaaggggaaatgggatcaggcaatgtgtcgtgaaaagcttgaacatgccaattattttacgaccatggctttgcagattggattggttgatggcttattgggtggttcaacgacaacgacagcagatactttacgtccggctttgcagttgattaaaaccaatcccacatcgtctttagtatcaagctgttttttgatggtaaaggacgagaaggtgtttttattcagtgattgttccttaaatatcaatccaagtgctgatgaattggttgatataaccctacaaaccgtagagagcgccaatcaattgggcattgtacctaaagtcggtattttatcatattctacacttggctctggaaagggagaaagtgtggataagatgcgtgaggtagccaaacgtttgaaacgaatgatgcttgactttgaggtggaaggagaaattcaggttgatgcggcactatcaaaggaaacggcggctttaaaagcacctaacagcacgatagcgggaaatatcaatgtattgatttttccatcacttgatgcaggaaatatcggctataagctagttgccagattgggaggctatgaggctatcggcccgattgttcagggtttgaataaaccggtaaatgatttgtcgcgtggctgtacgagtgaagaagtatataagatggcaagaattacggcgatgcaggtaagtgagcgaaagcagcaaaatagcgaagaatcactggataggctatcgacaagagtgtag

SEQ ID NO: 1035 - DNA, 987 bp, Anaerococcus hydrogenalis DSM 7454
atggcaaacgatggagttatggaactcgctactgaaaatattaggggtaaaaaccgtacaatagtatttccagaaggcgatgattcaagagtattaagagcagctataagacacaatgaagatggacttatagttccaatattacttggtaacaaagatgaaattcaaaaagtagcagaccaagaaggggtaaaattaggagatatccaaattattaacccaagagaaagtgaactacttgatgaattagtagatagatacgttgagcttagaaaaggcaaaaatacaagagaagatggtgaatatcttcttaagaaagacaacaactatttcggaactatgcttattgaaacaggaaaagcagacggaatggtttcaggtgcagctcatccaactggagatacagtaagaccagccctacaacttatcaaaacaagaaaaggtgtaaatagggtttctggtgttatgattatgcttggacctaacggggaaaaattattatttgcagatacagcaattaatattacccttcaatctaatgaacttgcagaagttgcagtagaagctgcaagaacagctgaagaatttggtatagaaccaatagttgctatgctatcattttcaacaaaaggatcagctaaacacgaacttgcaagaaaggtagaagaagctacaaaacttgcaaaagaaatggatccagacttaagaattgatggagaaatgcaatttgatgcagctatttcaccacaagtagcaagaaagaaaattccaaactcagatgttgctggaagggcaaaagtatttatattcccagacctacaagctgcaaacattggatataaaattggtcaaagacttggaaattacgaagctttaggaccaatacttcaagggttaaacaaaccagtaaatgacctttcaagaggatgtaacgaagaggatgtatataaactaacaattctaacagctaaccaagttagagattaa

SEQ ID NO: 1036 - DNA, 987 bp, Anaerococcus vaginalis ATCC 51170
atggcaaacgatggagttatggaacttgctactgaaaatattaggggcaaaaatcgcaaaatagtatttccagaaggcaatgactcaagagtattaagagcagctattagacatcaaaatgatggtcttatagtaccaatacttttaggagataaagaagaaattcaaaaagtagcagaagaagaaggggtaaaattaggagatattcaaataataaaccctagagaaagcgaactacttgatgaattagtagataaatacgttgaacttagaaaaggcaaaaacaccagagaagatggtgaatatatactaaagaaagataacaattactttggtacaatgctagttcaaactggaaaagctgacggaatggtttcaggagcatcaaatccaactggagatactgtaagaccagccctacaacttatcaaaactagaaaaagtgtaaatagggtatccggtgttatgattatgcttggacctaatggagaaaaattattatttgcagatacagcaataaatattactcttcaatcaaacgaacttgcagaagttgcagttgaagcagcaaaaacagcagaagaatttggaattgaaccaatagttgctatgctatcattttcaacaaaaggatctgcaaaacacgaacttgcaagaaaagtagaagaagctacaaaacttgcaaaagaaatggatccaaatcttaaagttgatggagaaatgcaatttgatgcagcaatttcaccacaagttgcaagaaagaaaattcctaattcagatgtagcaggaaaagcaaaagtatttattttcccagatctacaagctgcaaatattggatataaaattggacaaagacttggtggatacgaagctttaggaccaatacttcaaggattaaacaagccagttaatgacctttcaagaggatgcaacgaagaagacgtatataaattaacaatactaacagcaaatcaagttagagattaa

SEQ ID NO: 1037 - DNA, 987 bp, Anaerococcus tetradius ATCC 35098
atgccaaaaggtatattagaaaacgcaagagaagcaatagagggaaaaaatttaaaaatcgtttttccagaaggtagcgatccaaggatacttgctgctgctttaagacataaacaagagggacttcttatcccaatagttttgggagatcaaggcgaaattcaaaaaacagctgacaagctaggattaaaacttggtgatttaaaaataattaacccacaatattcagaagattttgataaattagttgaaggctttgtcgaggctagacgtggcaaaacaagcaaagaagaagcggaatttctactaaaaactaatgtaaactattttggcgtaatgctaattaaagaaggctttgcagacggaatggtttcaggtgctattcatacaacaggagataccataagaccagctcttcaaattatcagaacaaaaccaggtgtaaatagagtatctggtgtaatggttatgataggaccaaaaggcaaccaacttgtatttgctgatacagcagtaaatatcaccctagaatctgatgaacttgcagaagttgctgtagaaactgcaaagagtgctaaatcatttggtatggatccatatgttgcccttctatcattctcaactcatggttcagcccaccatgatttagctacaaaagttgctaaggcaaagactagagccttagaaattgatcctgatatcaaaatagaaggagaaatccaatttgacgcagcaatcgaccctgaaactgcagctcacaaggctccaggatcaaaagtagctggtaaatgtaatgtattcatcttcccagaccttcaagcaggaaatattggttataagattgcacaaagactaggtggatacaaggccctaggcccaatattacaaggattaaacgcacctgttaatgacctttcaagaggttgttcagaagaagatgtttatgaaatagcaataattacagcttctcaagcattaaatagataa

SEQ ID NO: 1038 - DNA, 984 bp, Anaerococcus prevotii DSM 20548
atgccagaaggtatactagaaaacgcaagaaaaaccatagcaggcaaagacttaaaaatcgttttaccagaaggtagcgacccaagagttctagctgctgctttaagacataaagaagagggacttcttacaccaatagttttaggagatcaaggtgaaatccaaaaaacagctgataaagaaggactaaaacttggtgatttacaaatcataaatccacaatatttcgaagatttcgataaattagttgatgttttcgttgaggtaagaagaggaaagacttcaaaagaagaagctgaattcttactaagaactaatgtaaactatttcggagttatgttagttaaagcaggctatgccgatggaatggtatctggtgcggttcatactacaggagatactattagaccagctcttcaaataattagaacaaaacctggtgttaatagagtatcaggagttatggtaatgataggaccagacggaaatcaattggtatttgcagatacagctgtaaatattaccctagaatctgacgagcttgcagaagttgcagttgaaactgcaaaaagtgctaaatcttttggtatggacccatatgtagcattattatcattctcaactcacggttcagcccaccacgatctagctacaaaggtagctaaggctaaacaaagagccctagagattgatccagaactaagggttgaaggtgaaatccaattcgatgcagcaatcgatccaaaaacagcagctcaaaaggctccaaaatctgaagtagctggtaagtgtaatgtatttatcttcccagacctacaagcaggaaatattggttataagatagcccaaagacttggtggatacaaggcattaggtccaatactacaaggtcttaacgcaccagtaaacgacctttccagaggttgttctgaagaagatgtgtacgaaatagcaattattacagcatctcaagctgtaaattaa

SEQ ID NO: 1039 - DNA, 1020 bp, Anaerococcus lactolyticus ATCC 51172
atggcaagaattggaattctagaagaagctattaacataataaaaggaaaaaaccttaccatagtcttaccagaaggtaatgaccctagagtattagaggcagctattaggcaccaagaagagggacttattaagccacttgtcttaggggaccaaggtgaaatccaaaaaacagcaaataaattaggaaaaagtatttctgcaattaaaattttaaatccagaaacttttgaacaatttgaagacatggttgatgcctttgcagaaattagaaaaggcaaaatcgacagagatgaagcagaatttatcctaaagagagacctaaactactttggcgttatgctagtaaaacttggttatgcagacggacttgtttctggtgctatccatacaacagcagatacaattagacctgccctacaaattataagaacaattccaggtagaaagagagtatctggtgttatggtaatgttaggaccaaatggtgaacaactagtatttgcagacacagcagtaaatatcaccctagaagcagatgagcttgcagaagtagcagtagaaacagctcatacagcaaaaacatttggtcttgatccatatgtagctatgctatcattctcaacacatggctctgctcaccacgaccttgcaactaaggtagccagggcaacagctattgctaaggatataaatccagatatgaaaatagttggtgaaatccaattcgacgcagccattgatccagaaacagcaaaaaataaagctcctgaatctgatgtagctggcaagtgcaatgtatttatcttcccagacctacaagcaggtaacatcggctataagatagctcaaagacttggtggttacaaggccctaggaccaatactccaaggattaaatgcaccagttaacgacctttcaagaggttgttcagctcaagatgtgtatgaaatagctatcatcacagccatgcaagcagcagaaagagctagagaagcggctgaagcagctaataaataa

SEQ ID NO: 1040 - DNA, 996 bp, Streptococcus pyogenes MGAS8232
atgagtattcgtagtttattcggtggtttaagagaaaaaattcttggtaaaaacatgaagattgttttcccagaaggtaatgatgagcgcgtcgtccgtgcagctgctcgtttgaaatttgaaggactcttagaaccgattatccttggacagtcagaagaggtacgcaaccttttgacaaaattaggcttcgctgatcaagactatactatcattaatccaaatgaatatgcggattttgacaaaatgaaagaaacttttgttgacatccgtaaaggaaaagcaacgcttgaagatgctgataaaatgctttgtgatgtgaattactttggtgttatgttggttaaaatgggattagcagatggaatggtatctggtgctattcattcaacagctgatactgttcgtccagcccttcaaatcattaaaaccaaaccaggtatttcaagaacttcaggtgttttcttgatgaatcgtgaaaatacgagtgagcgttacgtgtttgctgattgtgctatcaatattgacccaacagcacaagaattggcagaaatcgctgttaacacagctgaaacagctaaaatctttgatattgatcctaaaattgctatgttaagcttctcaacaaaaggttctggtaaagcgcctcaagttgataaggtaagagaagcaacagaaattgctaaagggttgaattctgacttagctcttgatggtgaattgcagtttgatgcagcctttgttcctgaaacggcagctatcaaagcatcagattcagcggttgctggccaagccaatacttttattttccctgacttacaatctggaaatattggttacaaaattgcacaacgtttaggaatgtttgatgctattggaccaatcttacaaggattgaacaaacctgttaatgatttatctcgtggctcaagcgctgaagatatttacaaattagctattattacagcagcacaagctatcgaaagccaagggtaa

SEQ ID NO: 1041 - DNA, 996 bp, Streptococcus pyogenes M1 GAS
atgagtattcgtagtttattcggtggtttaagagaaaaaattcttggtaaaaacatgaagattgttttcccagaaggtaatgatgagcgcgtcgtccgtgcagctgctcgtttgaaatttgaaggactcttagaaccgattatccttggacagtcagaagaggtacgcaaccttttgacaaaattaggtttcgctgatcaagactatactatcattaatccaaatgaatatgcggattttgacaaaatgaaagaagcttttgttgaggtccgtaaaggaaaagcaacgcttgaagatgcagataaaatgcttcgtgatgttaattactttggtgttatgttggttaaaatgggattagcagatggaatggtatcaggggctattcattcaacagctgacactgttcgtccagctcttcaaatcatcaaaactaaaccaggtatctcaagaacttcaggtgtcttcttgatgaaccgcgaaaatacgagcgagcgttacgtgtttgctgattgtgctatcaatattgacccaacagcacaagaattggcagaaatcgctgttaacacagctgaaacagctaaaatctttgatattgatcctaaaattgctatgttaagcttctcaacaaaaggttctggtaaagcgcctcaagttgataaggtaagagaagcaacagaaattgctacagggttgaaccctgatttggcacttgatggcgagttgcaatttgatgcagcctttgttcctgaaacagcggctatcaaagcaccagattcagcggttgctggtcaagctaatactttcgttttccctgacttgcagtctggaaatattggttacaaaattgcacaacgtttaggaatgtttgatgctattggaccaatcttacaaggattgaacaaacctgttaatgatttatctcgtggctcaagcgctgaagatatttacaaactagccattattacagcagcacaagctattgaaagccaagggtaa

SEQ ID NO: 1042 - DNA, 993 bp, Streptococcus uberis 0140J
atgagtattagaagtttatttggtagtttgaaagaaaaagttgtcggtaaaaatgttaaaatcgtttttcctgaaggcaatgatgaacgtgttgttcgagctgctgcacgtttaaaatttgaaggcttagttgagcctatcattttaggaaaagcagaggacattcgagctttattgactaaattaggctttgctgatcaagattaccaaattattaatccagaagattatgctgattttgaaaaaatgaaagcagaatttgttgagattcgtaaaggaaaagcaacgatagaagatgctgataaactcttaagagatgtcaactattttggtgtaatgcttgttaaaatgggcttggctgatggtatggtttcaggtgccattcattcaacagctgatacagttcgtccagctctacaaattattaaaacaaaaccaggtatttctcgcacatcaggcgtattcttgatgaaccgcgaaaacacaaatgaacgttatatttttgcagactgtgccattaatattgatccaaatgcacaagaattagctgaaattgctgtcaatacagctgaaacagctgcaatttttgatattgatccaaaaattgcaatgttaagtttctctacaaaaggatcaggaaaagctccacaagttgataaggttgcagaggcaacacaaatcgctaagagcttaaatcctcaattagctttggatggtgaattacaatttgatgctgcatttgttccagaaacagcagcaatcaaagcaccagattcagacgttgcaggtaaagctaatacctttattttccctgatttacaatctggaaatattggttataaaattgctcaacgtttagggatgtttgatgctattggtccaattcttcaaggcttaaacaaacctgttaatgacctatcacgtggatcaagtgcagaagatatttataaattaggtattattacagctgctcaagctatcgaagctaaatag

SEQ ID NO: 1043 - DNA, 1002 bp, Streptococcus equi subsp. zooepidemicus
atgagtattcgtaatttatttggtggtttaagggaaaaaattgtcggtaaaaacatgaagattgttttccctgagggaaatgatgagcgtgttgtacgtgcggcagcacgtctaaagtttgaaggacttgttgagccaattatccttggtcaggcagatgacattcgcagccttctgacacagctgggctttgctgatcagcattacaccatcatcaatccaaatgattatgctgattttgagaagatgaaagcagcttttgtagagcttcgtaagggcaaggcaacgcttgaagatgctgatagactgcttagagatgttaactattttggtgtgatgttagttaagctgggcttagcagacggtatggtttcaggggctattcattcaacagctgatacggtgcgtccggcgcttcagatcatcaagacaaagccgggcatttctagaacatcaggtgtctttttgatgaatcgcgaaaatacagagcagcgtttagtgtttgctgattgtgccattaatattgacccaacggctcaggagctcgcagaaattgcggtaaacacagcagatactgcgaaaatttttgatattgatcctaaggttgccatgcttagcttttcaacaatgggctctgctaaagccccacaggttgaaaaggttcaagaggccgtccgtattgctaaggaattgaggccagagcttgctttagacggtgagcttcaatttgacgcagcctttgtaccaagtacagcagcgatcaaagcccctgattcatcagtggcaggccatgcgaatgtttttgtcttcccagatttacagtctggaaatattggctataagattgctcagcgcttaggcatgtttgatgctatcggaccaatcctgcaaggattgaacaagcctgttaatgatttatcacgtggctctagtgcagaggatatttacaaactagctattattacagcagcgcaagcgcttgaaaatgagtctatcaattaa

SEQ ID NO: 1044 - DNA, 996 bp, Streptococcus mutans NN2025
atgggtattcgctctttatttggcagcttgagagaaaaaattgttagcaaaaatgtgaggatcgtttttcctgaaggaaatgatgaacgtgttgttcgggcagctgctcgtcttaaatttgaaggtttgattgaaccaattattttaggagatgcgactgaagtccgtaatttgttgacaaagctcggttttgctgatcaggactatacgatcattaatcccgaagactatacagattttgaacatatgaaacaagaatttgtagaaattcgcaaaggtaaagcaaccattgaagatgctgagcagctattgaaagatgtcaactattttggtgtaatgttagtaaaactcggtttagcagatggtatggtttctggtgctattcattcaacagcagatactgttcgccccgcacttcaaattatcaaaacgaaaccaggaatttcgcgaacatcaggtgtcttcttaatgaatcgtgaaaccactgaccaacgtttgatttttgcagactgcgctatcaatattgaaccggatgaacaagaattagctgaaattgccatcaatacagcagatacagcaaaaatttttgatattgatcctaaaatcgctatgctgagtttttctactaaaggcagtgcaaaggcttctcaagttgaaaaagttcaagaagcaacccgcattgctaaagaacttcgtcctgaaattaccttagatggagaacttcaatttgatgctgcctttgtaccgacaacagctaaaattaaagcgccggaaagtgacgtagcaggacaagccaatgtctttattttcccagatctccaatcaggaaatattggttacaaaatcgctcaacgtctgggaatgtttgatgctatcggaccaatcttgcaaggtttaaatatgccagtaaacgatctctcacgcggatcaagtgctgaagatatttacaaacttgctattatcacagctgcgcaaacccttgataatactaaataa

SEQ ID NO: 1045 - DNA, 999 bp, Streptococcus infantarius subsp. infantarius ATCC BAA-102
atgggaattcgatctttatttggtagcttaagggaaaaaattgttggtaaaaacctcaaaattgtttttcctgaaggaaatgatgaacgtgttcttcgtgcagccgctcgtttaaaatttgaaggtttgattgaaccaattattttaggagaagctacggaagttcgagaattactggctaaattcggttttgctgatcaaaactatgtgattattaacccgcaaacttatgataagtttgatgagatgaaggaagcctttcttgaaatccgaaaaggtaaagcaagtcctgaagatgctgatcgtctattgaaagacattaattattttggtgtcatgttggtcaaacttggtttggctgatggtatggtttctggtgcgattcattcaacagcagatactgttcgcccagctcttcaaatcatcaaaacaaaaccgggcatttccagaacatcaggtgttttcttgatgaaccgtgaaagcactgatcaacgttttatgttcgcggattgtgctatcaatattgatccgaatgctcaagaattatctgaaattgctttaaacactgctgaaacggcaagaatttttgacattgatccaaagattgccatgcttagcttttcaacaaaaggaagtgccaaagcacctcaatctgaaaaagttcgtgaagccactcaactggctaagggacgtcagcctgaattggctatcgatggtgaattgcaatttgatgccgcttttgttccaagtacagcagaagtaaaagcaccagatagtgatgtcgctggacaagcaaacgtctttatcttcccagaccttcaatcaggaaacattggttacaagattgctcaacgtcttggtatgtttgaggcaatcggtccaattcttcaaggattgaacaaaccagtcaatgatttatcacgtggttcaagtgcagaagatatttataaattagctattatcacagcagctcaggctgttgatgacatgaacgaataa

SEQ ID NO: 1046 - DNA, 993 bp, Streptococcus agalactiae A909
atgcgttccttatttggtggtttaagagaaaaagttgcaagtgattatgttaagattgttttccctgagggaagcgatgaacgtgtattacgtgcagcagctcgtttgaaatttgaaggtcttgttgatcctgttattttaggtaaggctgacgaagttcacgattctttggcaagacttggttttgttgatcaagattatagcgttattgaccctgaacaatacgaaaaatttgaagagatgaaagaagcttttgttgagattcgtaaaggcaaagctactatggaagatgcagatcgtcttttgaaggatgttaactattttggggttatgttagtaaaacttggtttggcagatggtatggtatcaggggccattcattcaacagctgatactgtacgtcctgctcttcaaattattaaaacaaaaccaggaatttcacgcacttcaggtgtattcttgatgaaccgtgaaaatacacaggaacgttatatttttgctgactgtgctattaacattgatcctaatgcacaagagctagcagaaattgcagtaaatactgcggatacagctaaaatatttgatattgatcccaagattgctatgcttagtttttcaacaaaaggaagtgcaaaagcgcctcaagctgaaaaagttcaagaagcagctaaaattgccaaagatttatctcccgaattagctgttgatggagaattacaatttgatgcagcttttgttccggaaactgcagaaattaaagctcctaatagtgatgttgctggaaaagcaaatgtttttattttcccagaccttcaatcaggaaatattggctataaaattgcacaacgtttgggtatgtttgaagcaatcggaccgattttacaaggattgaatgctccagtaaatgatttatcacgtggatcaagtgctgaagatatttataaacttgctatcattacagctgctcaagctattgatgagaaatcaaaataa

SEQ ID NO: 1047 - DNA, 984 bp, Streptococcus salivarius SK126
atgcgtagtctatttggtgaacttcgtgaacgtattgcagggaaaggtgttaagattgtcttccctgaggggaacgacgaccgtgtggttcgtgctgctgcccgtttgaaatttgaaggattggtggatcctattattttgggagacccagctgaggttcacaaaatcttgaacgatcttggttttgcagactttaactatacaattattaatcctgaaacctatgaagatttcgaggaaatgaaggaaaaatttgttgaaatccgtaaaggaaaagcaacaatcgaagatgcggaaaagttgcttcgtgatgtcaattattttggtgttatgttagttaaacttggtctggctgatggaatggtttcaggtgctattcactcaacagcggatacggtacgtcctgcccttcaaattatcaaaacaaaacctggtatttctcgtacatcaggtgtcttccttatgaaccgtgaaaataccgatcatcgcttgatgtttgctgactgtgctatcaatattgaaccaaatgctcaagaattggcagaaattgcaattaatactgccgaaacagctaaagtttttggtattgaccctaaagtggccatgcttagcttctcaacaaaaggttctgctaaatcgccaaaagttgacagggttgttcaagcaacaaatattgctaaagaaatgcgtcctgacttggctattgatggggagttgcagttcgatgcagcatttgttccagcaacagcggctattaaggctccagatagtgacgtagcaggacatgctaatgtctttgttttccctggcttgcaagcaggtaacattggatataagattgcccaacgtttgggaatgttcgaagctatcggaccaatcttacaaggtcttaataaaccagtaaacgatctttctcgtggtgctagtgctgaagacatttataatttagcgattatcacagctgctcaagctcttaataactaa

SEQ ID NO: 1048 - DNA, 984 bp, Streptococcus thermophilus LMG 18311
atgcatagtctatttggtgaacttcgtgaacatatttcagggaaaggagttaggattgttttccctgagggtaatgatgaccgtgtggttcgtgcagctgcccgtttgaaatttgaagaattagttgatcctattattttgggagaccctacagaggttcacaaaatcttgaacgatcttggttttgtagactttaactgtactattattaatcctgaaacctatgaaggcttcgaggaaatgaaggaaaaatttgttgaagtccgtaaagggaaagcgacaattgaagatgcagacaagttgcttcgtgatgtcaactattttggtgttatgctagttaaacttggtttagcagatggaatggtttcaggcgcgattcactcaacagcggataccgttcgtcctgctcttcaaattatcaaaacgaaacctggtatttcttgtacatcaggtgtcttccttatgaaccgtgaagacaccaatcatcgcttgatgtttgccgactgtgctatcaatattgaaccaaattctcaagaattagcagaaattgcaattaatactgcagaaacagctaaagtttttggtattgatcctaaagtggcaatgcttagcttctcaacaaaaggttccgctaaatcaccaaaagttgacagggttgttcaagcaacaaatattgctaaagaaatgcgtcctgacttggctattgatggtgagttgcagtttgatgcagcctttgttccagcaacagcagctattaaggcaccagacagtgacgtagcaggacaagctaacgtctttgtcttcccatgtttacaggctggtaatattggttataagattgcccaacgtttgggaatgtttgaggctatcggaccaatcttacaaggtcttaataaaccagtaaacgatctttctcgtggtgctagtgctgaagatatttacaacttagctattatcacagctgctcaagctcttaataattaa

SEQ ID NO: 1049 - DNA, 975 bp, Streptococcus pneumoniae CCRI 1974
atggaagtttttgaaagtctcaaagccaaccttgttggtaaaaatgctcgtatcgttctccctgaaggggaagagcctcgtattcttcaagcaacaaaacgcttagtaaaagaaacagaagtgattcctgttttgcttggaaatcctgaaaaaattaaaatttatcttgaaattgaaggaatcatggatggttatgaggtcatcgaccctcaacattatcctcaatttgaagaaatggtttctgccttggtggagcgtcgcaagggcaaaatgactgaagaagatgtacgcaaggttttggttgaagatgtcaactactttggtgtgatgttggtttacttgggcttggttgatggaatggtgtcaggagcgattcactcaacagcttcaacagttcgtccagctctacaaatcatcaaaactcgtccaaatgtaactcgtacttcaggagccttcctcatggttcgtggtacggaacgttacctatttggagactgtgccattaacatcaatccagatgcagaagccttggctgaaattgccatcaactcagcaatcacagctaagatgtttggcatcgaacctaaaattgccatgttgagctattctactaaaggttcagggtttggtgaaagcgttgataaggtcgttgaagcaactaaaattgctcacgacttgcgtcctgaccttgaaatcgatggtgagttgcaatttgatgcagcctttgttcctgaaactgcagttctgaaagctcctggaagtacggtagctggtcaagcaaatgtcttcatcttcccaggtatcgaggcaggaaatatcggttacaagatggctgaacgcctgggtggctttgcggctgtaggacctgttttgcaaggtttaaacaagccagttaatgatctttctcgtggatgtaatgcagatgatgtttacaagttgaccctcatcacagcagctcaagcagttcatcaatag

SEQ ID NO: 1050 - DNA, 978 bp, Streptococcus sp. 2_1_36FAA
atgaaaatttttgatgatattcgtgatgccttgcaggataaagaagtgaaaattgtcttgcctgaaggagaagaacctcgtattcttcaagcaactaagcgccttgtaaaagaaactagtattactccagttcttttgggtaatcctgaaaaaattcgtatttatttagaaatagaaggaataacagaagggtatcaggtcattgatcctacaaactgttcttgctttgaggaaatggtggaagcttttgtcgagcgtcgtaaaggaaaaattactgcagacgaagcgcgtcaattgttgaaggaagatgtcaattatttcggtgttatgctagtctatcttggtaaggttcaaggaatggtttcaggcgctattcactctacagcagcgactgttagacctgctcttcaaatcatcaagactttgccatgggtttcgcgcacttctggtgcctttctaatggttcgtgatgatgagcgctacatttttagtgactgtgccatcaatattgatccagacgccaatgttttagcagagattgctattaactcagctttgacagcacaaatttttgatattgatccgaaagttgccatgctcagctattctaccaaaggttctggttttggagaaaaggttgataaggtcgtagaggcaactaagctggctcaggaaatgcgtccagatttggctatcgatggcgaattgcagtttgatgcagctttcgtgcctgcaactgcagagctgaaagcacctggcagcccagtggctggtcaagcgactgtctttgtcttccctagcattgaagctggtaatatcggctacaaactggctgaacgtttgggtggattctccgcagtaggtcctatcttacaagggcttaatcatccagttaatgatctttctcgtggatgtaatgcggatgatgtttacaagctgaccttgattacagctagtcaggcagttggtcattattaa

SEQ ID NO: 1051 - DNA, 981 bp, Streptococcus suis 05ZYH33
ttgttcatgaaaatttttgagcaattagctacaaagctagagggtaaaaaagtacgtatcgtattgccagaaggtgaagaaccacgtatcttgcaggcgacaaaacgtttggtaaatgagtcggatgtagtacccgtcttgcttggaaacccagatcgtattaagatttaccttgacattgaagggattacagaaggttttgaaattattgacccagctcattatgatagatatgatgagatggtagctgctttggtagagcgccgtaaaggtaaggtatcagaagagcaggcacatgagttgttgaaagatgtgaactactttggtgttatgttggtatatatgggcgtagtagaaggtatggtatctggtgcgattcattcaactgcttcaacagttcgtccagctcttcaaatcattaaaacagagccaggtgtatcgaaaacatcaggtgccttcttgatggtaaaaggtgaagagcgttatatttttggtgactgtgctatcaacattgatccagatgctcaaaccttggcagaaatcgctatcaactcagcacgtactgctaaaatgtttggtattgatccaaaagttgcaatgctcagctattcaacaaaaggatctggctcaggtcctaaagttgataaggtggttgaagcaactaaaattgctcaaaaattgcgtccggagttggatttggacggtgaattgcaatttgatgctgcctttgtccctgctacaggtaaattaaaagcaccaggttcgagtgttgctggtcaagcgactgtatttatcttcccaggtatctcagctgggaatattggttataaaattgccgaacgtatgggtggatttgcagcggtaggtcctgttttacaaggtttgaatcagcctgtaaacgacttgtctcgtggttgtaaccctgatgatgtttacaacttgaccttgattactgcggttcaggctttggagcaccgttaa

SEQ ID NO: 1052 - DNA, 978 bp, Lactobacillus johnsonii NCC 533
atgaaagtatttgactcacttaagaaaaaagcagaagaatcaaagaaagtaattgtttttccggaaggaaacgatgacagaataataaaagctgctgttcgcctcgaaaaagaaggtattgttaaaccacttttactgggaaagcctgatgaggtaataaagactgctcaaagcttgaatgttgatctaggctcaattgaaattattaatccggcagtttaccctgattttgaaaaaatgtgtcaagactttgttgagctaagaaagggaaagaatactttagccgaagcaaaggaaattttacaagatgtttcttactttggcacaatgttagtatatgaaggaaaagccgatgggatggtttcaggagctactcattctactgctaatactgtgcgtccagctcttcaaattattaagactaaaaaaggtatgagccgtgtctcaggagctatgatcatggaacgcggagatgaaaagtatatttttgctgattgtgctattaatattgatccagatagtgaaactctagctgaaattgcttatcaatcaagtaaaacagctgaaatgattggtcttgagcctaaaattgcaatgcttagcttttcaactaagggatcagcaaagggcccaatggtaactaaggtgcaagaagcgactgagttagtacaccaaaaatatccagacttaatttgcgatggagaattacaatttgacgctgcaattgttcctcgtgttggagaagcaaaagccccaggttctgcagttgctggacacgcaaatgtgtttattttcccagaactacaatctggtaatatttcttataaagtggcagaacgtttaggtggatttagcgcaattggtcctgtattgcaaggtcttgctgctccaattaacgatttgtcacgtggatgcaagacggaagatgtgtatttattagctattttaactgctgctcaagctaatatggagaaataa

SEQ ID NO: 1053 - DNA, 990 bp, Lactobacillus acidophilus NCFM
atgagcgtattttcattattcaaagaacaagttgaacaagctgatgaaaagaaaaaaattattttcccagaaagtaatgatcttagaatcttaactgcagtttccaatttaaataaggacaatattatcgatccaattttgattggtaaaagagaagatattgaaaaattggctgcagaaaataatttagatcttgatggtgtaaagatttatgatcaaaataattatgctggtttagatgaaatggctgaagcatttgttaaagctagaaaaaaggatactagtattgccgaagcaaaggctaagctagcaaaaggtaattactttggtactatgctagtaaagatgggaaaagctgatggaatggtatcaggtgctgcgcattcaactgctaatactgttttacctgctttacaattaattcatgctgctaaggggatgcatcgcgtatcgggtgctttcgtaatggaaaaaggcgatgaaagatatatttttgctgattgtgctattaatattgatccagatgaagaaactttggcagaaattggttatcaatccgctcaaactgctaaaatggcaggaatcgatcctaaggttgcatttttaagcttttcaactaaagggtcagctgaaggtcctatggtaaataaagttcatgacgctgctgcaatgttccaaaaagatcatccagaaatccctgcagatggtgaattacaatttgatgctgcatttgttccatcagttggtgaaaaaaaagcaccaggctctaaggtggcaggacatgctaatgtatttgtattcccagaacttcaatctggaaatatcgcttataagatggtgcaacgacttggtaactttactgcagtaggtcctattttacaaggtctagctgctccagttaatgacttatcacgtggttgtagtgaacaagatatttacgatttggctatcgttactgctgcacaagctttggcaaaggatgaaaagtaa

SEQ ID NO: 1054 - DNA, 990 bp, Lactobacillus ultunensis DSM 16047
atgagtgtattttcattatttaaaaaacaagtagaagaagctagtgaaaagaagagaatcgtttttccagaaagtgacgatttaagagttttaactgccgtttctaatttaaataaagatggtattattgaacccatattaattggtaacaaagatgaagtgcaaaagttagctgcagatcataatttagatattgatggcgttaaaatttacgatcaaaataattatgatgatcttgatgaaatggcagatgcttttgttaaggctagaagaaaggatactagtattgctgaggctaaggcaaaattagctcaaggcaattactttggcacgatgttggttcaaatgggtaaagctgacggtatggtttccggtgctgctcattcgactgctaacacggtattgccagctttgcaattgattcatgctgctaaagggatgcatagggtctcaggtgcctttgtaatggaaaagggcaatgagagatatatctttgccgactgcgctattaacatcaatcctgatgaagaaactttagctgaaattggatatcaatcagcacaaactgccaagatggctgaaattgatcctaaggttgcctttttaagcttttcaactaacggttctgctactggtccaatggttgataaagttcatgatgctgccgccatgttccaaaagaatcatccagaaattccagctgatggtgaattacaatttgatgccgcatttgtacctgctgttggtaaaaagaaggctccagactccaaagttgctggccatgccaatgtatttatcttcccagaattacaatcaggcaatatcgcttataagatggttcaacgtcttggtggctttactgcggttggtccgattttgcaaggacttgcagctccagtaaatgatttgtcacgtggctgcagtgaacaagacatttatgatttagcaattgttactgctgctcaatctttagcaaaggataataaataa

SEQ ID NO: 1055 - DNA, 990 bp, Lactobacillus crispatus JV-V01
atgagcgtattttcattattcaaaaaacaagttgaagcagcaaaagataagaaaagaattgtttttccagaaggcgatgatttaagaattcttactgccatagctaatttgaaaaaagatggcattatcgaaccaattttaattggaaatccagatgagattgctaagttagttaaagaaaataatttagacttagctggtgttaagatctatgacctcaatcattatgatgaacttgatcaaatggcagcggaatttgttaaagctagacgaaaagataccagtattgctgaagcaaagctcaagttagcccaaggtaattactttggtaccatgttggtgaagatgggaaaagcagacggtatggtttccggtgctgctcactcaacggctaacactgttttgccagctttacaattaattcatgcagctaaggggatgcatcgagtatccggcgctttcgtaatggaaaagggcgatgagcgttacatttttgccgactgtgccatcaacattaatcctgatgaagaaactttagctgaaattggctatcaatctgctctgactgccaagatggccgaaattgatcctaaggtcgcatttttgagcttttcaactaagggttcagccgaaggaccaatggttgataaggtacatgatgcagcagctatgttccaaaaggatcatccagaaattccagctgatggtgaattgcaatttgatgccgcttttgtacctgcagttagtgaaaagaaggctccaaactcaaaggtagctggacatgcgaatgtctttgttttcccagaattacaatcaggcaatatcggttataagatggttcaaagattaggtggcttcactgctgttggtccaattttgcaaggtttagcagctccagtgaatgacctatctcgaggctgcagtgaacaagatatttatgatttagcaattgttactgccgcacaagctttagcaaaggatgaaaagtaa

SEQ ID NO: 1056 - DNA, 990 bp, Lactobacillus helveticus DSM 20075
atgagcgtattttcattatttaaaaaacaagttgaagcagcaaaaaacaaaaagagaattgtgtttcccgaaagcgatgatttaagaatcttgactgccgtttctaatttgaacaaggacggcataattgaaccgattttaattggtaacaaagagaatattgccaagacagctgaagaaaataatttggatcttgccggagtaaaaatttatgatcctaataattatgcagatttagatgaaatggtaaaagtatttatagaagctagaagaaaagatactagtgaagctgaagccagagcaaaattagctaaggaaaattatttcggcaccatgcttgtaaagatgggcttagctgatggaatggtatcaggtgcagctcattcaactgcaaatactgttttgcctgctttgcaattgattcatgcggctgaagggatgcatcgtgtgtccggtgcctttgtcatggaaaagggcgatgaaagatacatttttgccgattgtgcaattaatattgaaccagataaagaaactttagctgaaattggttatcaatcagcattaaccgctaagatggctgaaattgatccaaaagtagcatttttaagcttttctactaaaggatctgccgaaggaccaatggttgataaggttcatgatgcaaccgcaatgttccaaaagagtcacccagaaattcctgcagatggggaattgcaatttgatgccgcatttgttccaactgttggtgaaaagaaagcacctggttctaaagtagctggtcatgcaaatgtctttgtatttccagaacttcaatcaggaaatatcgcatacaagatggttcaacgtttgggtggtttcactgctgtaggaccaattttacaaggtctagctgcaccagttaatgatttatctcgtggatgcagtgaacaggatatttatgacttggcaattgttaccgctgcccaagctttagcaaaggatgaaaaataa

SEQ ID NO: 1057 - DNA, 978 bp, Lactobacillus jensenii JV-V16
atgagtatttttgatgaattaaaagaaaaaattgttggacaggaaaaagtaattgtttttcctgaaggagaagatgagcgtgtattgaaagcagctgttaaattaaagaatgaagggattatccaaccactcgtgttgggtgatgaaactcaaataaagcaaactgctaaaacacatgagcttgatttaacaggattgaaaattattaatcccaaaaatgacattagaaaagatgattttgctaagcaatactatgaactgcgtaagggaaaagaaagtgaagaacaagcaaaaaagcaaatttcagacccaaattattttgcaaatatgcttgtgtataatggcttggcagatggttgtgtatctggagcagctcattcaactgcagatactgtacgaccagcactaaaaattattaaaactcaagcaggtatgaaacgagtaagtggccaatttatcatggaaaaaggccagcaaagatatatttttagtgattgtgctatgaatattgacccagatgcagatactttagtagaaattgcatatcaagcggcccaaacagctaaaatggttggattagaaccaaaacttgcatttttaagtttttcaacgatgggatcagctaagggagaaatggtaagtaaagtgcaagatgcaactgctagttttaaagaaaagtatcctgaaattagtgcagatggagaaatgcaatttgatgcagcttttgtaccaagtgttggggctaagaaagcaccagattcaaatgttgctggtcatgctaatgtctttattttcccagaattacaatctggaaatatcggctataagattgcacaaagattaggtgattttacagcgattggaccaattttggcaggtttagcaaaaccggttaatgacctatcacggggatgtagtagtcaagatgtctatgaagcagcaattttaacagcagcacaaagtttggatgtagaataa

SEQ ID NO: 1058 - DNA, 978 bp, Lactobacillus jensenii 269-3
atgagtatttttgatgaattaaaagcaaaaattgttggacataagaaagtaattgttcttcctgaaggcgaagatgaaagagtcttatctgcagcagttaagttaaatagcgaaggaattattaaaccacttgtattaggtgatgaagctcaaataaaagaaacagctaaggatcacaagcttgatttaactgggattgaaattattaatcctaaaactgatactagaaaaggcgaatttgctaaacaatactttgaacttcgtaaaggtaaagaaagtgaagaacaagcaagtagccaagtattggatccaaattattttgcaaatatgcttgtttataatggcttagcagatggttgtgtttcaggtgcagctcactcaactgcagacactgttcgtccagctcttaagattattaaaactaaagctggcatgaaacgagtaagtggtcaatttatcatggaaaagggtgaccaaagatatatctttagtgattgtgctatgaatattgacccagatgcagatactttagtagaaattgcatatcaagcggcccaaacagctaaaatggttggattagagccaaaacttgcatttttaagtttttcaacgatgggatcagctaagggtgaaatggtaagtaaagtacaagctgcagctgcaagttttaaagaaaagtatcctgaaattagtgctgatggagaaatgcaatttgatgcagcctttgtcccaagtgttggtgccaaaaaggctcccgattcaaatgttgctggtcatgctaatgtctttattttcccagaattgcaatctggaaatattggctataagattgcacaaagattaggtgattttactgcaattggaccagttttggcaggtttggctaaaccggttaatgacctatcacggggatgcagtagtcaagatgtttatgaagcagctattttaacagcagcacaaagtttggatgaagaataa

SEQ ID NO: 1059 - DNA, 990 bp, Lactobacillus delbrueckii subsp. bulgaricus ATCC 11842
atggaagtttttgaacaattaaagcaattgattaagcaaaaagacaagcagcggatcgttttcccggaaggggaggacccgcggatcctgacggcggtcagccgcttaaagcaagatgacctggttgaaccgatcgtcctggggcaaaaggaccaggtcctggctttggcggaaaaagctggcttggacatgaccgggatcgaaatcgtggactaccaaaacagcccggactttggcgagatggtggaaaagttccacgaacggatggccgggggcaagcacttccagaccatggaagaagcggaagctgccttgcgcgacgccaacttctacgggaccatgctggtttacaccggccaggccgacgggatggtgtccggggcggctcactcaacggccgacacggtccggccagccctcttcattttgaagaccaagccggggatgcaccggatttccggttccttcatcatggaaagaggggaagaaaagtatgtctttgctgactgcgcgatttccatcgacccgaccagcgaccagctggttgaattcgcggcccagtcagctgctacggccaagatgatcgggattgaccccaaggtggccttcctcagcttctcaacccacggctcagccaagggcccgcaggtagacaaggtggcagaagcggccaagctgttcaaggaaaagtacccggacatcccggcagacggcgatttgcagtttgacgcggccttcgtgccggcagttgctgaacttaaggcacctggttcagccgttggcggcagggctaatgtctttatcttcccggaactgcagtcaggcaacattgcctacaagattacccagcgcctgggcaactttacggccatcgggccggttttgcaggggattgccaagccggtcaacgacctctcccggggctgcagcgctgatgacgtctacaagatcgggattttgacggcggctcaagccgttatggaagggtag

SEQ ID NO: 1060 - DNA, 981 bp, Lactobacillus iners DSM 13335
atgaaagtatttgatatcttaaaacaaaaggcattatcttgtgaacaaagtattgtttttccagaaggtaatgatttaagggttttggaggcagtttgtcgacttaaatcagaaagaatggttaatcctattttattaggggatgttgacgaaataaaaaaattggcactgcaaaaccatttaaatttggcggatattcgaattattaatcctttaacttataatcaaatcgatgagatgattgatgccttggtcaaacgtcgtaatggcaagaatactgtacaagaagctgcagaaatgctcaaacatggttcttattttggaacgatgttggtatatttacataaagctgctggaatggtatcgggagcagctcattctactgccgatacagttagaccagcattgcaaattattaaaactttaccaggtatgtctcgtgtgtcgggtgcaatgattatagaaagagaaacggagaaatatatattttctgattgtgctattaatattgatccagatgcacaaactctagctgaaatcgcatatcaatcatacttaacagctaaaatgattggattagatcctaaagttgctatgttaagtttttctaccaaaggatctgctaagggacctatgatagacaaagtgattcaagcaacaaaaatcgtgcatgaaacgcatccagaagtgaaaattgatggtgagttacagtttgatgcggcttttgtagctaatgttgctgctaaaaaagctcctaattctgaagttgctggtaaagctaatgtttttgtttttcctgagttacaatcaggaaatattggttacaaaattgcacaaaggttgggtaattttacggcagttggtcccgttttgcaaggactagcagctccaatcaatgatttatcacgtggttgctcggcaaatgatgtttatttagcaggaatcttaacagctgtgcaagcaattgaggctaaaaaatga

SEQ ID NO: 1061 - DNA, 972 bp, Bacillus subtilis subsp. subtilis str. 168
gtggcagatttattttcaacagtgcaagaaaaagtagctggaaaagacgttaaaattgtatttcctgaaggcttagacgagcgtattttagaagcggtcagcaagcttgcaggaaacaaagtgctgaatccgattgtgatcggcaatgaaaatgagatccaagcaaaagcaaaagaattgaaccttacgctgggcggcgttaagatttatgatcctcatacatatgaaggcatggaagaccttgtacaagcattcgtagaacgccgcaaaggcaaagcgactgaagaacaggctcgtaaagcattattagacgagaactacttcggtacaatgctggtgtataaaggacttgcagacggacttgtaagcggagctgctcactcaactgctgacactgtccgcccggctcttcaaatcatcaaaacaaaagaaggcgtgaaaaagacttcaggcgtgttcatcatggctcgcggagaagagcaatacgtattcgcagattgcgcgatcaacattgcacctgacagccaagatcttgccgagattgcgatcgaaagtgccaatacggcaaaaatgttcgacattgagcctcgcgtggcaatgctcagcttctctacaaaaggctcagcaaaatctgatgaaacagaaaaagtagcggatgcagtgaaaatcgcgaaagaaaaagcgcctgaactgacacttgacggcgaattccaatttgatgctgcatttgttccatctgtagctgagaaaaaagcgccggattccgagatcaaaggggacgctaacgtattcgtattcccaagtcttgaagcaggaaacatcggctataaaatcgctcagcgtttgggcaactttgaagcggtaggaccaatcctgcaaggtttaaatatgcctgtaaacgacctttcaagaggatgtaacgctgaagatgtttacaatctcgcattaattacagcggcgcaagcactgtaa

SEQ ID NO: 1062 - DNA, 972 bp, Bacillus amyloliquefaciens FZB42
gtggcagatttatttacaaaagtacaagaaaaagtcgcaggaaaagatgtgaaaatcgtatttcctgaagggttggacgaacgtatcctggttgcggtcaacaacttggcgggcaacaaggtattaaagccgatcgtagtcggcaataaagaagacattcaagcaaaagcgaaagaattaaatcttacgcttgacggcgtggacatttttgacccgcatacatatgaaggcatggaagaactcgttcaggctttcgtagaacgccgcaaaggcaaagcgacggaagaacaggcccgcaaagctttgctggacgaaaactatttcggcacgatgcttgtgtacaaaggtctcgcagacggacttgtcagcggagctgcacattctactgctgatacggtgcgccctgcactgcaaatcatcaaaacaaaagaaggcgtgaaaaaaacatcaggcgtcttcatcatggcccgcggtgacgagcagtatgtgttcgctgattgcgcgatcaacattgctcctgacagccaggaccttgccgaaatcgccattgaaagcgccaatacggctcaaatgtttgacattgacccgcgcgttgccatgctcagcttctctacaaaaggatcggcgaaatcagacgagacggacaaagtggctgaagccgtgaaaattgcgaaggaaaaagcgcctgagcttacgcttgacggcgaattccaattcgacgctgcatttgtgccgtctgtcgcggagaaaaaagcgccggactccgacattaaaggagacgcgaatgtatttgtattcccaagccttgaagcaggaaacatcggctacaaaatcgctcagcgcttaggcggctttgaagcggtcggaccgattctgcaaggattaaatatgcctgtaaacgatctttctagaggatgtaatgcggaagacgtctacaatcttgcgttaattacggctgctcaagcgctgtaa

SEQ ID NO: 1063 - DNA, 972 bp, Bacillus licheniformis ATCC 14580
gtggcagatctatttacaacagtgcagggaaaagtagcaggaaaaggagttaaaatcgtatttccggaaggtttggacgagcgtattcttacagctgtcaacaaattggccggaaacaacgtgttaaagccgatccttgtaggaaacgagcaggaaatcaaagataaagcaaacgggttgaatttaacgctggatggcgttgacatatacgatcctcatacatatgaagggatggaagaccttgttcaggctttcgttgaacgccgcaaaggcaaagcgacggaagagcaggcccgccaaatccttttagacgaaaactactttggaacgatgcttgtttataaagggcttgccgacggccttgtcagcggtgcggctcattcaacagcggatacggttcgcccggcgctgcaaattattaaaacaaaagaaggcgtgaagaaaacatcaggcgtctttatcatggcgcgcggcgatgagcagtacgtattcgcagactgtgcgatcaacattgcgcctgacagccaggaccttgcggaaatcgcaatcgaaagtgcgaacacagcgaaaatgttcgacatcgaacctcgtgtcgccatgctcagcttttcaacaaaaggttcggcaaaatcagacgaaactgaaaaagtagccaacgcggttgcaatcgcaaaagaaaaagcgcctgagcttacacttgacggcgaattccaatttgacgcggcattcgttccgtctgtcgctgagaaaaaagcgccggactccgtcattaaaggagatgcaaacgtatttgttttcccaagccttgaagcggggaatatcggctataaaatcgctcagcgcctcggcaactttgaagcggtcggtccgattctgcaagggctgaacatgcctgtaaacgacctgtccagagggtgcaacgctgaggacgtttataatcttgcgctgattacggcggctcaagctctgtaa

SEQ ID NO: 1064 - DNA, 972 bp, Bacillus pumilus ATCC 7061
gtggcagatattttttcaacagttcaggaaaaggttgcaggtaaaggagtaaagatcgtttttcctgagggaatggacgaacgcattctaacagccgttcaaaaactagcagatggcaaagtcttgcagccaattgttgtaggtaaaacacaagaagttgaagcaaaagcaaaagaattaggtcttacacttgatggtgttgacgtgtatgatcctcatacatatgaaggttttgaagagcttgtacaagctttcgtagaaagacgtaaaggcaaagcaactgaagagcaagcaagaaaagcattactagatgaaaactacttcggtacgatgcttgtgtacaaaggtcttgcagacggacttgtgagcggtgcagcacactcaactgctgacacagtacgcccagcacttcaaatcattaaaacaaaagaaggcgtaaagaaaacatctggcgtcttcatcatggctcgcggcgaagagcaatatgtgtttgctgattgtgcaatcaacattgcaccagacagccaagatctagctgaaattgcaatcgaaagtgcaaacacagccaaaatgttcgacatcgaaccacgtgtggcaatgcttagcttctctacaaaaggctcagcaaaatcagacgaaacagaaaaagtatctgaagcagttcgtattgcaaaagaaaaggcacctgagcttgtacttgatggggaattccaattcgatgcagctttcgttccttcagtagcagcgaaaaaagcaccagattccgtcattaaaggcgatgctagcgtatttgttttccctagcctagaagctggaaacatcggctacaaaattgcacagcgcttaggtaactttgaagctgtaggtccaatcttacaaggcttaaatcagccagtaaacgacctttcaagaggttgtaatgccgaagacgtttacaaccttgcacttatcacagcagctcaagcactataa

SEQ ID NO: 1065 - DNA, 984 bp, Anoxybacillus flavithermus WK1
gtgagtgatttatttgcagccttaaaacaaaaggtggcaggaaaaaatgtaacgatcgtgtttccggaagggctagatgaacgtattttaacagctgtcggacgtctagcggcagaaaatgtattgtgtccgattgtcatcggcgagaaagaagcggtcgcccaaaaggcaaaagaacttggtttaacgctggagaaagtagaaattatcaatccgcatacgtacgaaggaatgaatgagatggttgccgcgtttattgaacgtcgcaaaggaagagtgacagaggaagatgcgcgcaacattttactcgatgaaaattacttcggtacgatgcttgtgtatatgggaaaagcgcacggacttgtgagcggtgccgcacattcgacagcggatacagttcgtcctgcgctacaaattattaaaacaaaaccgggtattcgtaaaacatcaggtgtgttcattatggtgcgcggcgatgagaaatatgtattcgccgattgtgctattaacattgcaccagatagccaagatttagcagaaatcgctgtagagagtgcacaaacagcgaaaatgtttgatattgagccgcgcgtagcgatgcttagcttctcaacgaaaggatcagcgaaatcgccagaaacagagaaagtgatcgaagcggtgcgcatcgcaaaagaaatggcgccagagttaacgcttgatggcgagtttcaatttgatgccgcgttcgttccatctgtggcgaaaaagaaagcgccagattccgtcattcaaggtgatgcgaacgtctttattttcccaagcttagaagcgggaaatatcggctataaaattgctcaacgtctcggcaactttgaagcggtcggtccaattttacaaggattaaatcagccagtaaacgatttatcgcgcggatgcaacgccgaagatgtatacaaattatcacttatcacagcagcgcaggcgcttgcggcgatgaaatga

SEQ ID NO: 1066 - DNA, 975 bp, Geobacillus sp. WCH70
gtgagtagcgatttattttctgccttaaaagaaaaagtagtaggaaaacaacggaaaattgtgtttccagaaggtcttgacgagcgtattttaactgcggtaagccgtctggccaatgaacaagttgtcataccgattgtgatcggcaacgaggaagcggtaaaacaaaaagcaaatgagcttggattgacccttccgaatgtcgaaatcatcgacccgcatcaatacgaggaaatggatgagcttgtcaaagcatttgtcgaacgccgcaacggaaaagtgacagaagaagtggcgcgggaaatgcttctcgatgaaaattactttggcaccatgcttgtgtacatggataaagcgcatgggcttgtaagcggtgcggcacattcgactgccgatacagtaagacctgcattgcaaattattaaaacgaaaccaggcatccgcaaaacgtcaggcgtatttattatggtgcgcggtgacgagaagtacgtgtttgccgattgcgcgattaacattgcgccagacagccaagatttagcggaaattgctgtagagagcgccaacactgcaaaaatgttcgatatcgaaccacgtgtggcgatgttaagcttttcgacaaaaggatcggcgaaatcaccggaaacggaaaaagtcgtcgaagcggtgcggcttgcgaaagaaatggcgccagacttagtgttagacggcgagtttcaattcgacgcagcgttcgttccatctgtcgcgaaaaagaaagcgccggattcggtcattcaaggagatgcgaatgtatttatcttcccaagcttagaagcgggaaatatcggttataaaatcgctcagcgtctcggtaattttgaagcagtcggtccgattttgcaagggctgaataagcctgttaacgacctgtctcgcggctgcaatgcggaagatgtgtacaagcttacgctcattaccgcggcgcaatcgctataa

SEQ ID NO: 1067 - DNA, 975 bp, Geobacillus thermodenitrificans NG80-2
gtggcaaacgatttatttacagcattaaaggagaaagtggttggcaccggacggaaaattgtatttccggaaggaacggatgaccgcattttgacggcggcaagccgattggcggcggaacaagtgcttctgccgatcgttcttggcgatgaacaagcgatcaaagcgagagcagcggagcttggcttaccttttgacggagtggacatcatcaatccgcgcgactatgcggagtttgatcagctcgtttccgctttcgttgagcgccgtaaagggaaagtgacggaagaagcagcacgcaaactgttgttggatgaaaactatttcggtacgatgcttgtctatacaggtgcagcggacggtctcgtaagcggggcggctcactcgacagccgatacggtgcgcccggctttgcaaattattaagacgaaaccgggagtccgcaaaacgtccggcgttttcattatggtgcgcggcgaggagaagtatgtgtttgccgactgcgccatcaacattgcccctgacagtcaagacttggccgaaattgcgatcgagagcgcccggacggctgctatgttcggcctccatccgcgcgtggccatgcttagcttttcgacgaaaggctcggcttcgtcgccggaaacggaaaaagtcgcagaggctgtgcgattggcgaaggaaatggctcctgacctcgtccttgacggcgagtttcaatttgacgcggcgttcgtgccagaagtagcgaaaaagaaagcgccggattcggtcattcaaggcgatgcaaacgtctttattttcccgagcctcgaggcaggcaacatcggctacaaaatcgcccaacgcctcggcggctttgaagcggtcggcccgattttgcaagggctgaacaagccagtaaacgacttatcacgcggctgcagcgcagaagatgcctataagctcgccttgattacggcagctcaatcattatag

SEQ ID NO: 1068 - DNA, 981 bp, Geobacillus kaustophilus HTA426
gtgacaaccgatttatttacggcattaaaagcgaaagtaaccggtacgggtcgaaaaatcgtgtttcccgagggaaccgatgaccgcatcttaacggcggcgagccgtttggcgacggagcaagtgcttcggccgatcgtccttggcgatgagcaagcgataagggtgaaagcagctgcgcttggcttgccgcttgaaggggtggagattgtcaacccgcgccgctacggcgggtttgatgagctagtttcggcgtttgtggagcggcgcaaagggaaagtgacagaagaaacggcgcgcgagttgcttttcgatgaaaactatttcggtacgatgctcgtttatacgggagcggccgacggcctcgtcagcggggcggcacattcgacggcggatacggtccgaccagccttgcaaatcattaaaacgaagccaggcgttcgcaaaacgtccggcgtgttcatcatggtgcgcggcgacgaaaaatatgtgtttgccgattgcgccatcaacattgctcctaacagtcaagatttggctgaaatcgcggtcgagagcgcccggacggccaaaatgttcggccttaagccgcgcgtagcgctgttaagcttttccacgaaagggtcggcctcgtcgccggagacggaaaaagtcgttgaggcggtgcggttggcgaaagaaatggcgccggatctgatccttgacggtgagtttcaatttgacgccgcgtttgtgccagaggtggcgaaaaagaaagcgccggactcggtcattcaaggggacgcaaatgtctttattttcccgagccttgaggcgggcaacatcggctacaaaatcgcccagcgccttggcggctttgaagcggtcggcccgattttgcaagggctgaacaagccggtcaacgacctatcgcgcggctgcagcgccgaagacgcctacaagctcgcgctcatcaccgcggcgcagtcgcttggggagtaa

SEQ ID NO: 1069 - DNA, 972 bp, Bacillus sp. SG-1
atgagcaatctatttgaaacactaaaagcgaaagtcacagggaaagacttgaagattgtatttccagaaggtcaagatgaaagaattttacaagcagcctcccgtctggcttcagatggaattcttacaccggtgatcatcggaaatgccggcaatgtcgaggcaaaagcccaagaagtgaatgtgtcactcgaaggctgtgaaattcttgatccagcagataacgaattcatggacgagctcgttcaatcatttgtggatagacgaaaaggcaaagcgacagaagaggatgcgaagaagatccttcttgatgaaaattacttcggaaccatgctcgtgtacacaggcaaagctcacggcttggtaagcggtgctgctcactctacggcagacactgtccgtccggcgcttcaaatcattaaaacaaaagaaggcattcgaaaaacgtcaggtgtatttatcatggtccgtgaaggtgaaaaatacgtctttgctgattgcgccatcaacattgcccctgacagccaggatctagctgaaattgcaattgagagtgcgaaaacagctgaaatgtttgatattgacccacgggtagcaatgttaagcttctctacaaaagggtccgcgaaatccccagaaacagaaaaggtgacagaagcagtcaacattgcaaaggaaaaagcccctgaattgactctggacggcgaattccaatttgatgctgcctttgtaccctccgtggcaagcaaaaaagctccggactctgtattgaaaggcgatgcaaatgtcttcatcttccctagccttgaagcagggaacatcggatacaaaattgcacagcgccttggaaacttcgaggcagtgggtccaatccttcaaggattgaatgcaccggtcaacgacctttcccgagggtgtaatgaagaagatgtctataaacttgcgctgattacagctgcgcaggctttataa

SEQ ID NO: 1070 - DNA, 972 bp, Bacillus coahuilensis m4-4
atgagcgatttatttcagtcattaaaagacaaagtgtctggacaaaacttgaagatagtttttccagaaggcttagatgagcgtattttaacagcggccagccgtctagctgccgataaaatagtgacacctattttagttggagcaaaagaagatgttgagaagaaagcaaaagaattaaatgtcatagtagatgggtgtgaaatttacgaccctgctacatatgaaaaaatgccagaactggtagcagcttttgtagaacggcgtaaaggaaaagcaagtgaggaagatgcaaagcgtattctccaagatgaaaactattttggaacgatgcttgtgtacacgaagcttgctcacggtcttgtgagtggtgctgcacattcaactgctgacactgttcgtccagcacttcaaattattaaaacaaaagaaggcgtacgcaaaacgtctggtgtcttcattatggtacgtgaagaggagaagtacgtatttgcagattgtgccatcaacatttctccagacagccaagaccttgctgaaattgctattgaaagcgcaaaaacagcggaaatgtttgatattgacccacgcgttgcgatgctaagtttctcaacggctggttcagcaaaatctccagaaacagaaaaagtagtagaagcagtgaaagtagcacacgagcgggctcctcacttaacattagatggagagttccagtttgatgctgcatttgttccatctgttgcagcgaaaaaggcaccaaattcagtcatccaaggggacgcaaacgtattcgtattcccaagcctagaagcagggaacattggatacaaaatcgcccaacgcttaggtaactttgaagcagtgggacccatccttcaaggattaaatgctcccgtgaatgatctttctcgtggctgtaacgaagaagatgtgtacaagcttgcgctcattacagcagcacaggcactataa

SEQ ID NO: 1071 - DNA, 978 bp, Bacillus sp. NRRL B-14911
atgagtgatctttttgaaggattaaggaataaggtttccggcaataatctgcgaatcgtatttcctgaaggaacagatgaaaggattctgactgcagcaggccgtctggcagctgacaaaattcttacccctattctgatcggggatattgcacaaatcgaggataaagcaaaatcattggatgtatcccttgattctgtcgaaatctatgacccgaaaaactttgccatgatggacgaacttgttgctgcatttgttgagcgccgcaaaggaaaagcgacagaagaagatgcccgccgcattcttcttgatgaaaactatttcggcaccatgcttgtttatgccaataaagcagacggccttgtcagcggagcagctcactctactgcagatacagtccgaccggctcttcagatcattaagacaaaagaaggcgtcaaaaagacttccggtgtcttcatcatggtccgcgaagatgaaaagtatgtatttgccgattgtgcaatcaatatcgcaccagacagcgcagatcttgcggaaatcgccatcgaaagcgccaagacagcaagaatgttcgacatcgacccgcgcgttgccatgctgagcttctctaccaaaggctctgcaaaatcccctgaaacggaaaaagtatcccaggcagttgaagaagccaagcttcgtgagccattgctcatcgtggacggcgaattccagttcgacgcagccttcgtaccatccgtagccgagaagaaagctccggattcaccgctgcagggagatgctaatgtatttgtattcccaagcctggaagcagggaatatcggctacaaaatcgcccagcgccttggtaactttgaagcggtcggaccgatccttcaaggcctgaaccgtccggtaaatgacctttcccgcggatgtgaccaggaagacgtgtataagcttgctttgatcacagcagctcaggcattgaatcagtaa

SEQ ID NO: 1072 - DNA, 975 bp, Oceanobacillus iheyensis HTE831
atgggattattcgaacaattagctgaaaaagtaacggctgctgataagaaaattgtctttccagaaggattagatgaacgtatattaactgcagcaagtcgcttagcagaagaagggatcatgacaccaattttaattggcggtacacaagatgtggaggcaaaagcaaaagatcttgatgtatcattaaaaggttgtgaggttatcgatccagctaactatgatgagttttctgacatggtttcagctttcgtggaacgaagaaaaggaaaagcaacagaagaagatgcaaagaaaattcttcttgacggaaattatttcggaaccatgcttgtttatttaaataaagcggatggactagttagtggtgcggctcattccactgcagatactgtacgtcccgcattacaaatcattaaaacaaaagaaggcgtaaagaaaacttctggtgtattcatcatggttcgtgatgaggaaaagtatgtatttgctgattgtgctatcaacattacacctgacagtaatgatctagcagaaattgctgttgagagtgcaaaaacaggggctctatttgatgtagatcctaaagttgctatgttgagtttctctacaaaaggttctgcaaaatcaccagaaacagaaaaagtgtctgaggcattagaaattgctaaagagaaggatccatctctagtaatagatggagaattccaatttgatgctgcatttgttccaagtgtagcagagaaaaaagctcctgattccgttctaaaaggcaatgctaatgtatttgtattcccaagtttagaagcagggaacatcggatataagattgcacaacgtttaggtggatttgaagcagtaggtccaattcttcaaggattgaatcgtccagtaaacgatctttcccgtggatgtagttctgaagatgtctataatttagcattaataactgccgcgcaagcagtaggagaataa

SEQ ID NO: 1073 - DNA, 972 bp, Bacillus cereus BGSC 6E1
gtgagcaacttatttacaacagtaaaagaaaaagttcaaggaaaaggcatttctatcgtacttcctgaaggaactgatgaaagaattttaggcgctgcagagcgtttagcaaaagaagagttagtaaaaccaatcttagttggtaataaagaagaaattagcgcaaaagctgctagcatgaatttaacattagcaggcgttgatatttacgatccagctacatacgaagaaatggaagcaatggtagcatctttcgttgaacgccgtaaaggtaaagcaacagaagaagacgctcgcaaaatccttaaagacgaaaattacttcggtacaatgcttgtatacatgggcaaagcacacggtttagtaagtggtgcagctcactctacagctgatacagttcgtccagcacttcaaattattaaaacaaaaccaggtgttacaaaaacttctggcgtattcatcatggtacgtgaagaagagaaatatgtattcgctgattgcgcaattaacatcgcaccaaatagccaagatttagctgaaattggtatcgagagtgcgaaaactgctgaactattcggtattgacccacgcgttgctatgttaagcttctctacaaaaggttctgcgaaatctccagaaacagaaaaagttgtagaagcaactcgcattgcaaaagaaatggctccagaattaactttagatggagaattccaattcgatgcagcattcgtaccatctgtagctgagaaaaaagctccaggttctacaattaaaggtgatgctaacgtattcgtattcccaagcttagaagctggtaatatcggctacaaaatcgctcaacgtttaggtaacttcgaagcagtaggaccaatcttacaaggcttaaacatgcctgtaaatgacctatctcgtggatgtaacgaagaagaagtgtacaagttagctttaattacagcagctcaagcactttaa

SEQ ID NO: 1074 - DNA, 978 bp, Listeria monocytogenes str. 4b F2365
atgagtgatttatttactacaatcaaaggacaagttactgggaaaaacgtgcgcatcgtactacctgaaggaacagatgaacgtattgttggagcagctgcacgtctgcaaaaagaaaatatcgtaaaaccaattttgcttggtaacaaaggtgaaattgaagcaaaagcaaaagaaattggcgtttctgttgaaggaatcgctattcacgaacctgcgaccgatccactttttgatgaattagtggctgcatttgtagaacgtcgtaaagggaaagcaacagaagaagctgcacgtaaaatgctcgttgatccaaactattttggaacaatgcttgtatacactggaaaagcagaaggtcttgtaagtggcgcggctcactctactggtgacactgttcgcccagcactacaaattattaaaacaaaaccaggcgtaagtaaagttgccggcgcaatgattatggttcgcggtgaagaacgctatttattcagtgatgtagctatcaacattgcaccagttgcagcagacttagcggaaaatgcgattgtaagtgcggaaacagcagaaatcttcggcattgacccgcgtgttgcaatgttaagtttctctacaaaaggttctgcaaaatccgatgaaacggaaaaagtcgtagaagcaactgctcttgcaaaagaaaaagcacctgaattaacgcttgatggtgaattccaatttgacgcagcatttgttccaacggttgctgagaaaaaagcgccaggatccgttattaaaggggacgcaaatgtatttatcttcccaagcctagaagcaggaaacattggttacaaaattgcgcaacgtttaggtaactttgaagcagttggcccaattttacaaggcttaaatgcaccagttaatgatttatctcgtggttgtaatacagatgacgtttataacttaacgttaattacagcagcgcaagcagtgaataaataa

SEQ ID NO: 1075 - DNA, 978 bp, Listeria grayi DSM 20601
atgagtgatttatttggaacgatcaaacaacaagtaactggtaaaaacgtacgtatcgtcttaccagaaggggaagatgaacgtatcatcgaagcaactgcccgcctgcaagaagagggtatcgtagtgccgatcttactgggaaataaagcaagcatcacagaaaaagcagcagcactcaacatctcgctggaaaacgtagtgatccgcgatccggaaagcgatgccgactttaacgagttagtagctgcatttgttgaacgccgcaaaggaaaagcaactgaagaagatgctaaacgcatgctgaaagatccgaactattttggaacgatgcttgtcttcactggcaaagcagacggtttagtaagtggtgcagcacattctactggcgacactgtccgtccagcacttcaaatcatcaaaacaaaaccaggcatttctaaagtagctggcgcaatgatcatggtcaaagaggaccaacgctatctattcagcgacgttgcgatcaacattgctccatctgcagaagatttggctgaaaatgctattgtcagcgcagaaacagcttcgattttcggaattgatcctcgcgtagctatgctaagcttttccacaaaaggttctgcgaaatctgatgaaacggaaaaagtagtagcagcaactgcgatcgcgcaagaaaaagcaccagaattagcattagacggtgaattccaatttgatgcagctttcgtcccatctgttgctgaaaagaaagcaccaggatctaaaatcaaaggtgatgccaatgtcttcatcttcccaagcttggaagcagggaacatcggctacaagatcgcacagcgtttaggcgattttgaagcagtgggtccgatcttacaaggattgaatgcaccagtaaatgatctatcccgcggttgtaatgctgcagatgtatatcatttaacactgatcactgccgctcaagcagtgaataaataa

SEQ ID NO: 1076 - DNA, 993 bp, Bacillus halodurans C-125
gtgagtgatctctttcgtaacattcaagaacaagtgaagcgtcaccaaccgactattgtgctgcctgaaggtacggatgagcggattttagaggcggcagcaaatttagcaaaagatgaagtggtgaagccgattcttgtggggaatgttgcagatattcaggcacgtgcatctgagttaaatattgaccttggatctgttgagattatcgaccctaaatcgtatggggcatttgacgatatggtacatgcgttcgtggagcgtcggaaagggaaggaaactgaagagacagcccgtgaaaagctagtagatgttaactattttggaacaatgctcgtatatacaggtgtagcagacggccttgtaagcggggctgcccattcgaccggagatacggtccgcccagcattgcaaatcattaaaacacagccaggtattaaacgaacatctggtgttttcattatggtgaaggaagatcaaaagctcgtctttgctgattgtgcgatcaacattgccccaactgccgaagaattagcagaaattgcagttgctactgctgagacagcgaaagtgttcgacattgatcctaaagtggctatgcttagtttctcgacaaaaggctctgccgtctcacccgagacagagaaagtggcagaggcaacaaagcttgcccaagaagctcgcccagatttagtcattgatggcgaatttcaatttgatgctgctttcgttccagctgtggcgcaaaaaaaagcacctgaatccccattgaaaggggaggctaatgtctttgtattcccaagcttagagtcaggaaacatcggctataaaattgcacaacgattaggtggttacgaagcaattggtccaattttgcaaggcttgaaccaaccggtgaatgacttgtcccgtggttgcaacgcatccgatgtttacaagctgtctttaattactgcgttacaagccattaaccaaaaaggcgacaataactag

SEQ ID NO: 1077 - DNA, 996 bp, Bacillus clausii KSM-K16
gtgggcgatttatttgctgacattaaacggcaagtagagtctcataagccaagtatcgtcttgcctgaaggaacagacgaacgggtattgcaagcagcggccaaacttgctgccgataacgttgtaaaaccgattgtcataggggataacgatgcgattttagcgcttgctgataaattaaagattacactagaaggaataacgatttacaatccagagacataccctggaatcgatgaaatggttgacgccttcgttgcccggcgcaaaggcaaagaaacggaggagtctgcacgcaagctgttacaagatgtgaactattttgggacaatgcttgtctacatggaaaaagccgacggccttgttagcggtgctgcccattctacgggagatacggtccgcccagctttacagattattaaaacacaacctgggattaagcgcacgtctggcgtttttgtcatggtcaaagaagacaaaaaatttgtctttggtgattgcgcgatcaacatatcgccaaatgaagaagaactggcggaaattgctactgctacagcggataccgcgaagctatttggtattgaaccaaaagtcgcgatgcttagtttttcaacgcttggttctgcttcatcgcaagaaacgaaaaaagtgtctgctgctactaaaattgcgcaagaaagccgtcctgaccttatcattgacggtgaatttcaatttgacgctgcttttgttcctgcagttgcccaaaagaaagcgcctgattcccctttaaaaggagaagctaacgtatttatttttccaagcctcgaatcaggaaaccttggctacaaaattgcgcaacgccttggcgggtatgatgcgattggcccaattttgcaagggttaaacaagccagttaacgatctgtcccgtggttgtaatgttgacgatgtatacaaactaagcttaataacaggaatgcaagctattacacaaaaaacaggacaaggagtttaa

SEQ ID NO: 1078 - DNA, 990 bp, Exiguobacterium sp. AT1b
atgaaattatttgaaacgttgaagcaaaaagttagcccggttcgtccgaccatcgtcttcccggaaggtatcgatgagcgtgttcttggagccgctgttcgattgaaagcagacggtatggtagaaccgatcgtcgtcggtgcgaaagcagatctcgaagcggttgcggcgaaacacggtttcgacatctcaggtttgacacaatatgacccagcgacatacgaagacatcgacgttctcgtcgaatcattcgtcgagcgtcgtaaagggaaagcgacggctgaacaagcacgcgaactccttacatcagacgtgaactacttcggaacaatgctcgttcacacaggcaaagcagaaggtcttgtctcaggcgcgatgcacgcgacggctgatacggtacgtccggcactacaaatcatcaaaatgcaaccaggcatcaaaaagacgtcaggtgtgttcatcatggtacgtgacgacgagcaatatgtcttctcggactgtgcgattaacattgcaccagacgcagcggacttagcagagaacgcgttcttgtcggcagcgacagcgaagacgttcggcatcgacccacaagttgcgctccttagcttctcgacgaaaggttctgcgaagtcacctgaaacagagaaggttgtggaagcgacacgcctggcgaaagagaaatcaccgaaccttccaatcgacggagaacttcaattcgatgcggcattcgtccctagcgtagcggcgaagaaagcaccgggttctgacgttgctggtaaggcgaacgtattcgtcttcccaagtcttgaagcagggaacattggctacaagatggttcaacgtttcggtggattcgaagcgatcggtccaatccttcaaggtctcaacaaaccagtgaacgacttgtcacgtggctgtaacgaagaggacgtctacaaattgacgctcatcacagcagcacaagcaatcgacgagcgcaacgaagcgtaa

SEQ ID NO: 1079 - DNA, 987 bp, Exiguobacterium sibiricum 255-15
atgcaattattcgaaatgcttgagacaaaagtcaaagcccaccagccgacgatcgttttccctgaaggaatcgatgcacgtgttctcggtgcagctgtacgtttgaaaaaagacggtttagttacaccgatcgtcatcggaccacgcggtcaaatcgaagagacagcttcagcaaacaacattgatgttgcagatcttgaaacgattgatccggcttcatatgaaggaatcgaagaactcgttgcttcattcgttgagcgtcgtaaaggaaaagcaacggaagaacaagcccgcgccctcatcctgaaagacgtcaacacgtttggtacgatgctcgtccacacaggaaaagcagaaggtctagtttccggtgcgatgcacgcaacaggtgatacggttcgtccggcacttcaaatcatcaaaatgcaagaaggctataaaaagacatcaggtgtcttcatcatggttcgtgacgacgagcagtatgtgttcgccgactgtgcaatcaacatcgcaccggacgctaacgatttagctgaaaatgcaatcgcgtctgcgaaaacggcaaaaacattcggaatcgatccgaaagttgcgttgctcagcttctcgacaaaaggttcagcgaaatcaccggaaacagagcgcgttgtcgaagcaacatgtttggcaaaagaacgtgcacctgaactctcaatcgacggtgaattacaatttgacgcagcattcgtcccgagtgtcgcaaaatcaaaagcgccggaatcagatgttgccggtcaagcaaacgtctttattttcccaagccttgagtctggaaacatcggctataagattgcccagcgtcttggcggttttgaagcaatcggaccaattctgcaaggactcaacaaaccggtcaacgatttgtcgcgcggatgtaacgaagaagacgtctacaaactggcgatcattacagcggcacaagctgtcgaagaacgccaagcgtaa

SEQ ID NO: 1080 - DNA, 978 bp, Bacillus selenitireducens MLS10
gtgagtgatatgtttaccgcaatcgcggaaaaagtaaaaactgtcaaaccgtcgattgtttttccggaaggtaccgatgaacggattctcgaagcgacggtccgattaaaaaaagaaggaatccttgagccgcttcttgtcggcaaccctgatgaagtcaaagcgaaggcgggagaggccggcgtcaatgttgatgacctgacgatctatgacccggagacgtatgacggctttgacgccctcgtcgatgcgttcgtggaacgccgtaaaggcaagaacacgaaagaacaggcccaagagattttgaagaccccgaactatttcgggacgatgcttgtctataccggccttgccagcggtctggtgagcggtgcggctcatgcgacgggtgacaccgtccgtccggccctgcagattatcaagacaaaagaaggcgtgaagaaaacgtccggcgcattcgtcatggtccgtaatgacgaacgatacatcttcggtgactgtgcgatcaatatcgcccctgatgcaagcgacatggccgaaaccgctgtggaagcagcaaaaacggcccgtgtctttgatattgacccgaaagtcgccatgctcagcttctccacgaaaggctctgccgtgagcccggaaacggaaaaagtcgttgaagcaacggcccttgccaaagagaaggatccgaacctcgtcgtggacggagaatttcagtttgacgcggcatttgtgccgtccgttgccaaaaagaaggcaccggattcgccgttaaacggggaagcaaacacgttcatcttcccgagccttgaagcaggcaacatcggctacaaagtggcccagcgccttggcggattcgaagccatcggcccgatccttcagggactgaaccagccggtgaatgacctgtcccgcggctgtaatgtggaagacgtgtacaagctgtctcttatcacagcgatgcagggacttgcagactga

SEQ ID NO: 1081 - DNA, 990 bp, Staphylococcus epidermidis M23864:W1
atggctgatttattaaatgttttacaagacaagctatctggaaaaaatgtaaaaattgtattacctgaaggtgaagatgaaagaattttaacggcagcaacacaattacaggaaagagattatgtttcaccgattgtcttaggtaatgtggacaaaattaaatctttagcagaagaaaaatctcttgatatagctaatattgaaatgatcgatccttcttcaagtgatttaaaacctgaacttgtagatgcgtttgttgaacgcagaaaaggaaaagcgactaaagaacaagcagaggagttactggaaaatgtgaattacttcggtacaatgcttgtttacactggcaaagcagctggattagtaagtggtgctgcgcattcaactggtgacacagtgcgtccagctttacaaattatcaaaacaaaaccgggcgtgtctaaaacttctggtattttcttcatgattaaaggtgatgaacaatatatctttggtgattgtgcgattaatcctgaactagatgcgcaaggactagcagaaattgcagttgaaagtgctaagtctgcacaaagttttggaatggaacctaaagtagcgatgttaagtttctctacgaaaggctcagcaaaatctgatgacgtaactaaagttcaagatgcattgaaattagcacaagaaaaagttgaagctgacaacattgagaatgttgttattgatggagagtttcaatttgatgcagccatcttaccaagtgttgctgaaaagaaagcacccggtgcaaaaatccaaggcgatgccaatgtgtttatcttccctagtttagaagcgggtaacattggttataaaattgcgcaacgtttaggtggttatgacgctgtgggacctgtacttcaaggtttaaactcaccagttaatgatttatctcgtggttgctcaatagaagatgtgtataacttatctattattactgcagctcaatcactacaataa

SEQ ID NO: 1082 - DNA, 990 bp, Staphylococcus capitis SK14
atggctgatttattaaatgtattacaagaaaaattatctggaaaaaatgtaaaaattgtattacctgaaggggaagacgaaagagttttaacggcagcaacgcaattacaagagagtgattatgtttcacccatcgtgttaggtaatgaagaaaaaattaaatctttagcagaagaaaaatctctcaatttaactaatattgaaattattgatccttcatcaagtgatttaaaacctgaattagtagatgaatttgtagagcgtagaaaaggtaaagcgactaaagaacaagctgaagaaatgttagataatgttaattatttcggtacaatgcttgtttacactggtaaagccgcaggtttagtaagcggtgctgcacattcaactggtgatacagtacgtccagcattacaaattattaaaactaaaccaggtgtatctaagacttctggtatcttctttatgattaaagatgacgagcaatatatcttcggcgactgtgccatcaaccctgaattagatgctcaaggattagctgaaattgctgaagaaagtgctaagtctgcactaagctttggtatggaaccaaaagtagcaatgttaagcttctctacaaagggctctgctaaatcagacgacgtgactaaagttcaagaagcattaaaattagctcaagaaaaagttcaatctgataatattgaaaatgttgtgattgatggggaattccaatttgatgctgcgattgtccctagtgtagctgagaaaaaagcgcctggcgctaaaattcaaggagacgctaatgtgtttatcttcccaagtcttgaagcaggtaacattggctataaaattgcacaacgtttaggtggttatgatgcagttggtcctgttcttcaaggtctaaattcgcctgttaatgacttatcacgtggatgctcaactgaagatgtttataacttatctattattactgcagctcaatcactacaataa

SEQ ID NO: 1083 - DNA, 990 bp, Staphylococcus warneri L37603
atggctaatctattaaacgtattagaagacaaattagcagggaaaaatgtaaatattgtattacctgaaggggaagacgaacgtgtgttaactgcagcaacgcaattacaagtgactgactatgtaacaccaatcgttttaggtaataaagataagattcaatcattagcaaaagacaaaggtttagaccttgccaatatagaagtcatcgatccttcaacaagtgaattgaaatcagaattggtagacgcatttgttgaacgtcgtaacggtaaagcgacaaaagaacaagctgaagaattattagataatgttaattactttggaactatgcttgtatacactggtaaagcagcaggattagtaagtggtgcagcacattctactggagatacagtacgtccagcactacaagtcattaaaactaaaccaggtgtttctaaaacatcagggatcttctttatgatgaaaggtgaagaacaatatatctttggtgattgtgcaattaatccagaattggatgcacaaggattagctgaaattgcagtagaaagtgccaaatctgctcaaagtttcggtatggaaccaaaagttgctatgttaagcttttcaactaaaggttctgctaaatcagacgatgtgactaaagttcaagatgcattgaaattagcacaagataaagtagctgaagaacaattagattatgttgtcattgatggtgaattccaatttgatgccgcaattgtaccaagtgtagctgagaaaaaagcaccaggtgcaaaaattcaaggagatgcaaatgtgttcattttccctagtttagaagcgggtaatattggctacaagattgcacaaagattaggtggctatgacgctgttggtccggttcttcaaggacttaattctcctgtaaatgatttatcacgtggatgctctatcgaagatgtctataatttatcaattattactgctgcacagtcattacaataa

SEQ ID NO: 1084 - DNA, 990 bp, Staphylococcus epidermidis ATCC 12228
atggctgatttattatctgtattacaagacaaattatccgggaaaaatgtaaaaatagtattacctgaaggtgaagatgaacgagtgctcattgctgcgactcagctacaaaaaactgactatgtttcacctatcgttctaggaaacgaagataatattaaatctcttgcttctaaacacgctttagatttaactcaaattgaaatcatagatccagcaacgagtgaacttaaagatgagcttgtagatgcttttgttgaaagacgtaaaggtaaggcaactaaagaacaagcagttgaattattagataatgtaaattatttcggaacaatgcttgtgtatactggaaaggctgaaggtttagtgagtggtgctgcacattctactggagatacagtcagaccagcattacaaattatcaaaactaaacctggtgtatctagaacatctggtattttctttatgattaaaggcgacgaacaatatatttttggagattgtgcgattaatccagaattagatgctcaaggacttgctgaaattgcagtagagagtgctaaatcagcacaaagctttggaatggaccctaaagtagctatgttaagcttttctacaaaaggttctgctaaatcggatgatgttactaaagtgcaagaagcattgaagttagctcaagaaaaagctgaagcagatcaattagatcatgtagttattgatggagaattccaatttgacgctgctattgttcctagcgtagcagagaagaaagcacctggtgcaaaaattcaaggtgatgcaaatgtatttgttttccctagtctagaagcaggtaatattggttataagattgctcaacgtttaggtggatacgatgcagtaggaccagtcctacaaggattaaactctccagtcaatgatttatctcgtggttgctcaactgaagacgtttataacttatctattattacagctgctcaagctttacaataa

SEQ ID NO: 1085 - DNA, 987 bp, Staphylococcus aureus A9635
atggctgatttattaaatgtattaaaagacaaactttctggtaaaaacgttaaaatcgtattacctgaaggagaggacgaacgtgttctaacagctgcaacacaattacaagcaacagattatgttacaccaatcgtgttaggtgatgagactaaggttcaatctttagcgcaaaaacttaatcttgatatttctaatattgaattaattaatcctgcgacaagtgaattgaaagctgaattagttcaatcatttgttgaacgacgtaaaggtaaagcgactgaagaacaagcacaagaattattaaacaatgtgaactacttcggtacaatgcttgtttatgctggtaaagcagatggtttagttagtggtgcagcacattcaacaggcgacactgtgcgtccagcattacaaatcatcaaaacgaaaccaggtgtatcaagaacatcaggtatcttctttatgattaaaggtgatgaacaatacatctttggtgattgtgcaatcaatccagaacttgattcacaaggacttgcagaaattgcagtagaaagtgcaaaatcagcattaagctttggcatggatccaaaagttgcaatgttaagcttttcaacaaaagggtctgctaaatcagacgacgtgacaaaagttcaagaagctgtcaaattagcacaacaaaaagctgaagaagaaaaattagaagcaatcattgatggcgaattccaatttgatgctgcgattgtaccaggtgttgctgagaaaaaagcgccaggtgctaaattacaaggtgatgcaaatgtctttgtattcccaagtttagaagctggtaatattggttacaaaattgcacaacgtttaggtggatatgatgcagttggtccagtattacaaggtttaaattctccagtaaatgacttatcacgtggctgctcaattgaagatgtatacaatctttcaattattacagcagcgcaagccttacaataa

SEQ ID NO: 1086 - DNA, 990 bp, Staphylococcus haemolyticus JCSC1435
atgtctagtttattagatgtattacaagaaaaactttcaggaaaaaatgtcaaaatcgtattacctgagggtgaagatgagcgtgtgttaacagctgctacacaattacaagcaactgactatgtaacacctgtagttttaggtgactatgacaaaattaacttattagctaaagataaaggattagatgtttcagacatcgaaatcattaatccatctacaagcgaattaaaaccagaattagttaaatcattcgttgaacgccgtaaaggtaaagcaactgaagaacaagctgatgaattattaaataacgttaactatttcggtacgatgttagtttacgctggtcatgctgacgggttagtaagtggtgcagcacattcaactggagatactgttcgccctgcattacaaatcattaaaacgaaaccaggcgtatctaaaacttctggtatcttctttatgattaaagatgatcaacaatatgtattcggtgactgtgcaattaacccaacattagaatcatctgatttagcagaaatcgcagttgaaagtgcgaaatcagctaaaagcttcggcatggacccacgtgttgctatgttaagcttctcaactaaaggttcagctaaatctgacgatgttgataaagtagcaaatgcagttaaattagctcaagaaaaagtagaatctgaaggcttaacagacgttgtaattgatggtgaattccaatttgatgctgctattgtaccttcagtagctgaaaaaaaagcgccaggcgctaaaatccaaggtaatgcaaatgtctttgtattcccaagtttagaagcaggtaatattggatacaaaattgctcaacgtttaggtggttttgacgcagttggtcctgtattacaaggtttaaactcacctgttaacgacttatcacgcggttgctcaactgaagacgtttataaattatcaatcattacagctgctcaaacattacaataa

SEQ ID NO: 1087 - DNA, 990 bp, Staphylococcus hominis SK119
atgtctagtttattagatgtattacaagaaaaactttcaggaaaaaacgttagaattgtattaccggaaggtgaagatgaacgagtattaacagcggctacaaagttacaagcaactaactatgttacacctttagtattaggtaatgaagaaaaagtaaatactttagctcaagataaaggattagatatctctaatattcaaattatcgatccttctaaaagtgatttgaaacctgaattagtcaaatctttcgtagaacgtcgtaaaggtaaagctactgaagaacaagctcaagaattattaaacaatgttaactattttggaacaatgttagtatacgctggtcatgctgagggattagtaagtggtgctgcacattcaactggagatactgtccgtcctgccttacaaattattaaaacaaaacctggcgtatctagaacatctggtatcttctttatgattaaagaagataaacaatatatatttggtgattgtgctatcaatccaacattagaatcttctgatttagcagaaattgccgtagaaagtgcaaaatcagcaaaaagttttggtatggacccacgtgttgctatgttaagtttctcaactaaaggttcagctaaatcagatgatgtagaaaaagtcgctaacgcagtaaaattagcacaagaaaaagtggaatctgaaggtttagataatgtagtggttgatggagaatttcaatttgatgctgcgattgtacctgcagttgcagagaaaaaagcacctggagcaaaaattcaaggtgacgcaaatgtatttgtattcccaagtttagaagcaggtaatattggctacaaaattgcacaacgtttaggtggatttgaagcgattggtccagttttacaaggtcttaattcacctgtaaatgatttatctcgtggttgctctactgaagacgtttataacttatcaattattactgctgctcaaacattacaataa

SEQ ID NO: 1088 - DNA, 987 bp, Staphylococcus xylosus
atgtctttattagatgtattacaagaaaaactttcaggaaaaaacgtgaaaatagtcttacctgaaggggaagatgaacgagtactaacagcggcaacacaattacaagggacagactatgtgacacctgtagtattaggtaatgaagcaaatgttaaagctttagctaatgacaaaggtttagatattgctaatttagaaatcatcgatccagaaacaagtgaattaaagcaagaattagtaactgcttttgttgaacgtcgtaaaggtaaagcaacagaagaacaagcacaagaaatgttgaaaaatgttaactatttcggaacaatgcttgtttatactggtaaagcagaaggacttgttagtggtgctgcccattctactggagatactgtgcgcccagcattacaaattatcaaaacaaaacctggtgtatctaaaacttcagggatcttctttatgattaaagacgaccaacaatatatttttggtgattgtgcaattaaccctacacttgaagcacaagatttagctgaaattgcagttgaaagtgctaagtctgctaaaagtttcggaatgtcaccacgcgttgcaatgttaagtttctcaacaaaaggatctgctaaatcagatgatgttgaaaaagtctcaaacgctgtagacatggctcaagagaaaattaaagctgacaatattgaagacgttgtcgttgatggtgaattccaatttgacgcagcaattgtaccagaagttgcgaagaaaaaagcgccagacgctaaaattcaaggcgatgcaaatgtattcgtattcccaagtttagaagctggaaatataggttataaaattgctcaacgtctaggtggatttgatgcagtcggtccagtattacaaggtcttaattcaccagtaaatgatttatcacgtggttgttcaatagaagacgtatataatctgtcaatcattactgctgcgcagtcattacaataa

SEQ ID NO: 1089 - DNA, 987 bp, Staphylococcus saprophyticus subsp. saprophyticus ATCC 15305
atgactttattagatgtattacaagaaaaacttacgggaaaaaacgtgaaaatcgttttaccagaaggtgaagacgagcgcgtattagaagcggcaacacaattacaaggtactgattatgtttctcctatattattaggaaatgaatcgaacatcaaagccttagctagtgataaaggtttagaaatttcagatttagaaatcattgacccagaaacaagcgaattgaaacaagaacttgttactgcatttgttgaacgccgtaaaggtaaagcgactgaagaacaagcgcaagagatgttgaaagatgttaactactttgggacaatgcttgtttatactggtaaagcagaaggtttagtaagtggtgcggcacattcaactggtgatacggtacgtccagcgttacaaatcatcaaaacaaaaccaggtgtctctaaaacttctggtattttcttcatgattaaagacgataaacaatatatctttggagattgtgcaatcaatccaacacttgaagcacaagatttagcagaaatagctgtggaaagtgcaaaatctgctaaaagctttggcatgtcaccacgcgttgcaatgttaagcttctcaactaaaggttctgcaaaatctgacgatgttgaaaaagttgcaactgctgttaacttagctcaagagaaaattgaagcagatcatttagaagatgttgttgtagatggtgaattccaatttgacgcagcaattgtacctgaagttgctaagaaaaaagcacctgatgcaaaaattcaaggcgatgcaaatgtattcgtattcccaagcttagaagcaggtaatattggttacaaaattgcacaacgtttaggcggatttgatgcagtaggtccagtattacaaggtcttaattctccagtgaatgatttatcacgtggctgttctaaagaagacgtgtataatttatcaatcattactgcagcacaatcattgcaataa

SEQ ID NO: 1090 - DNA, 990 bp, Staphylococcus carnosus subsp. carnosus TM300
atgcctagtttattaaatgtattacaagacaaactttcaggaaaaaacgtaaaaatcgtattgccggaaggtgaagatgaacgcgtattaacagcagcagtaaaattacattcaactgattatgtagaacctatcgttttaggtgatgctgaaaaagttcaatcacttgccgatgataaagggttagatatttctggaattgaaatcattacacctgaaacaagtgacttgaaaccagaacttgtagatgcttttgttgagcgtcgtaaaggtaaagcaacaaaagaacaagctgaagatatgttgaataatgtgaattatttcggaacaatgcttgtttacactggtaaagctgatggactcgtaagtggtgcagcacattcaactggagatacagtgcgtcctgcattgcaaattattaaaacaaaaccaggtgtgtctaaaacatcaggtgttttctttatgattaaaggtgacgaacaatatgtattcggagattgtgctattaatccaacattagaagcagcagacttagcagaaattgctgttgaaagtgcaaaaacagcgaaaagtttcggaatggatcctcgtgttgctttgttaagcttctcaactaaaggttcagcaaaatctgatgatgtagaaaaagtagaatcagctactaaattggcacaagaaaaaacggaagaagaaggattaactgatgttgttatcgatggtgaattccaatttgatgcagcgattgttcctaaagtagctgctaaaaaagcaccagatgctaaaattaaaggcgatgcaaatgtcttcatcttcccaagcttagaagctggaaatattggttataaaattgcacaacgtttaggcggttatgaagcaatcggaccagtattacaaggtttgaattctccagtgaatgacttatcacgcggttgctcaactgaagacgtttataacttatcaattatcactgcagcacaaactttacaataa

SEQ ID NO: 1091 - DNA, 990 bp, Macrococcus caseolyticus JCSC5402
atggctaatttattagaagtattaaacgagaaactttcgggaaagaatgtaaagattgtactacctgaaggtaacgatgagagagtattacaagcagcagttgagttacataaaggtgataaagttgcacctatcgttctaggtgataaagctgaaatcgaagcacttgctgctaagttaggtgttgccattgatggtattgaaataatggatccggctacgagcgaattacgtgaagacttaattacgaagtttgtagagcgtcgtaaaggtaaagcgacagaagaacaagcgactgaaatgttaaaggatccgaactatttcggtacgatgttagtatatgctggtcatgctgcgggacttgtatcaggtgcagcgcattctacagcggatactgtccgtcctgcattacaaattatcaagacgaagccaggcgtatctcgtacatcaggtgtattcttcatgatgcgtggagaagaacagtacgttatgggtgactgtgcaattaaccctcaattagattcacaagcattagctgagattgcgattgaatcagcgaagactgcaaaacaattcggtatggaaccgaaagtagcaatgttaagcttctcaacgaaaggttcagcaaaaacacctgaaactgagaaagtaacagaagcaacgaaattagcacaggagaagttagcttcagaaagcgatttacaaggtgtcgtaattgatggtgaattccagtttgatgcagcgtttgttccttcagttgcagcgaaaaaagcacctgagtctccaattcaaggtgatgcaaatgtgttcgtattcccttcattagaagcgggtaacatcggctacaaaattgcacaacgtttaggtggattcgatgcagttggaccaatcttacaaggattaaatgcaccagtaaatgatttatcacgcggatgttctactgaagatgtagtatcattatcaatcattactgcagcacaatcactataa

SEQ ID NO: 1092 - DNA, 975 bp, Lactobacillus fermentum ATCC 14931
atggacatttttgaaaagttagctgaccaactgcgcggccaagataagacgatcgttttcccggaaggtgaggacccacgtgtgttaggggcagcaattcgcctgaagaaggatcaattggttgaaccagtggtgcttggtaaccaagaggccgttgaaaaggtcgctggggaaaatgggttcgacctgactggcctgcaaattcttgatccggcaacttacccagccgaagacaagcaagcaatgcacgatgccctattggaacgccgaaacgggaagaacacaccggaacaagtggaccaaatgctggaagacatttcctactttgctacgatgctagtttacatgggtaaggttgatggaatggtttccggggcggttcacgcaactggggataccgttcgcccagcccttcaaattatcaagactaagccaggttcccaccggatttccggtgccttcatcatgcaaaagggtgaggaacgttacgtctttgctgattgtgccatcaacattgaattagacgcgccaacgatggccgaggtggctagccaatccgctgaaacggccaagctgtttgggattgaccctaaggtagccatgttaagcttctccaccaagggctcagccaagggggacatggttaccaaggtcgctgaagccactaagctagccaaggaagccaacccggaccttgctatcgatggggaactgcaatttgacgctgccttcgttccatcagttggggaactaaaggcccctggttcagacgttgctggccacgctaacgtattcatcttcccgagtctagaagccgggaacattggctacaagattgcccaacggttcggcggctttgaagccatcggtccagttttgcaaggattaaacgccccggtggctgacctatcccggggaacggacgaagaagcagtttacaaggtggccttgattacggccgcccaggcactttaa

SEQ ID NO: 1093 - DNA, 966 bp, Lactobacillus coleohominis 101-4-CHN
atggatatttttgaaaaactagccaatgatttaaaaggacaacaacggacgattgttttcccagaaggtaatgatgaacgaatcatgggtgcagcgattcgtctgcataatgacggaattttacaaccaattctacttggtaacgaagccgatttaggacaagttgctaaggatcacggttggaacttaactggaattgagattatcgatccggcaacttatgataagcaagcgatgcatgatgcattgttagaacggcggaagggtaagaataccccagaacaagtggaccaaatgttggaagacgttagttactttgccacgatgttagtgtacatgggaaaagtggacgggatggtttctggcgctgttcacgccactggtgatacggttcgtccagctttgcaaattattaagactaaacctgggaccaagcggattagtggtgcattcattatgcaaaagggtgcagaacgctatgttttcgctgattgtgccattaatattgaactggacgcaccaacgatggcagaagtagcgatggaaagtgctcatacggcgaagttatttggacttgatccaaaagtggccatgctgagcttctccaccaagggatctgccaagggtgagatggttacaaaggttgcagaagctacccaactggttcacaaacaagcaccagaattagctgtggatggtgaattacaatttgatgcagcatttgtaccgacggttggtcaattgaaggctcccgattcaaaggtggctggtcacgcgaatgtctttatctttccaagtttggaggctggaaatatcggttataagattgcgcaacggtttggcgggtttgaagcagttggaccaattttacaaggcttgaatgcaccggtggctgacctttcccggggtaccaacgaagacgaagtttacaaagtcgcaattatcacagcagcccaggttgattag

SEQ ID NO: 1094 - DNA, 975 bp, Lactobacillus vaginalis ATCC 49540
atggatttatttgatgaaattgctgcaaaggtaaaggggcaagacaaaaccattgtcttccctgaaggtgctgacaaacgaattttaggtgctgccgttcgtttaaagaatgatgacttagtagaaccaattttacttggctcaaagagtgaaattgaagcaacagctaatgaaaataattttgatattactggtttgcaaattattgatccagcagcttatccagaagcagacaagaaggccatgtttgatgcacttttggaacggcggaagggaaagaatacccctgaacaagttgaaaagatgctggaagacgttagttactttggtaccatgcttgtatacatgggcaaggccgatggaatggtttccggtgcggttcactcaaccggttcgaccgttcgtccagcattacaaatcattaagacaaagccaaatgctcaccgaattagcggggctttcttgatgcaaaaaggcgatcagcggtacatttttgctgattgcgcaatcaatattgagttagatgcggacaccatggctgaagttgctgttcaaagtgccgaaactgccaagctatttggaattgatcctaaggttgctctccttagcttctctactaagggatccgctaagggagacatggttaccaaggttgccgaagctacagaaaaggttcacgaaatggaaccagaacttcctgccgacggtgaaatgcaattcgatgctgctgttgttccttcagttggtgagttaaaggctccaggttctaaggttgccggccatgcaaatgtctttattttcccaagccttgaagccggaaatattggttacaagattgctcaacgttttggcggctttacggctgtgggcccaattcttcaaggcctgaatgctccaattgctgacctttcacggggatgcagtgaggatgatgcatacaaggtggccattattacagcagcccaagcattataa

SEQ ID NO: 1095 - DNA, 975 bp, Lactobacillus reuteri DSM 20016
atggaattatttgatgagattgctgcaaagattaagggacaaaacaagacaattgttttccctgaaggtgaagataagcggattttaggagctgctgtccgcttaaagaaagataatttagtagagccgattttacttggtgatgaagaagcgattaaagaagttgcaagtaaaaacggttttgatcttgctggccttcaaattatcgatccagcaacttatccagaagacgataagcaagcaatgtttgactcattaatggaacggcgcaaagggaagaatactcctgaagaaattcaaaagatgcttgaagatgtgagctactttggaacgatgcttgtttacatgggaaaggctgatggaatggtttctggtgctgttcattcaactggggcaactgttcgacctgcattacaaatcattaagactaagcctggtgcccatcgaattagtggggctttcctcatgattaaaggcgatcaacgttatatctttgctgattgtgcgattaatattgaattggatgcgccaacaatggctgaagtggcaattcaaagtgcagaaacagctcgcttatttgaaattgatcctaaggttgcgcttcttagtttttcaactaagggttctgctaagggcgaaatggttaccaaggttgcggatgctgctaagctagttcatgaattggatcccgacttaccagctgatggtgaactacaatttgatgctgctgttgttccatcagtaggtgaacttaaagcccctgattcaaaagttgctggtcatgccaatgtctttattttcccaagtctggaagcaggtaatattggttacaagattgcgcaacgatttggcgggtttacagcagttggtcctattcttcaaggacttaacgcaccgattgcagacctttcacggggatgtagtgaagatgatgcttataaggttgcaatgattaccgcagcacaagcattgtaa

SEQ ID NO: 1096 - DNA, 972 bp, Lactobacillus antri DSM 16041
atggaattatttgaagaaattgctgctaaggtaaagggacaaaacaagacgattgtttttcccgagggcgaagacaaacgggtgcttggtgcagcggttcgtctgcaacaagatggcctggtaaagccgatcctgctcggcaagcgcagtgagattgaagcgactgccaaggagaacggctgggacctttctgcactgacggtgttggatccggccgagtacccagcggaggacaagcaagccatgtttgacgccctgctggaacggcgcaagggcaagaacactcctgaacaggtcgagaagatgctgcaagacgtcagctacttcggcaccatgctggtttacctgggcaaggctgatgggatggtttccggggcggttcactctaccggttcaaccgtccggccagcactccaaatcgtcaagaccaagccgggatcccaccggatcagcggggccttcttgatgatcaagggcgaccagcgctacatctttgctgactgtgcaatcaacatcgaattggacgccccaacgatggcggaagtagcggtgcaaagtgccgaaaccgccaagctctttgggattgacccgaaggttgccctcctgagcttctccaccaagggttcggccaagggtgagatggtcaccaaggttgctgaagccacggaaaaggttcacgaattagcaccggacctggctgctgatggtgaactgcaattcgacgcggccttcgtaccagaagtcggcgagttaaaagcgcctgactccaaggttgctgggcacgccaacgtctttatcttcccaagcctggaagccggtaacattggctacaagattgcccagcgtttcggcggctttaccgcagtgggcccgatcctgcaaggattaaatgcgccgattgccgacctgtcacggggctgcaatgaagacgacgtttacaaggtggccctgattacggcggctcgggcataa

SEQ ID NO: 1097 - DNA, 981 bp, Leuconostoc mesenteroides subsp. mesenteroides ATCC 8293
atggaactttttgagcaattaaaaaataaaattaccggtcaaaataagacaattgtatttccggaaggtgaagatccccgtatccagggcgcagctatcagattagcagctgataatttgatcgagccaatattgttgggggatgcacaggaaatttcaaaaactgcccaagcccataactttgatttatcgaacatagagacgattgatcctgcttcatatgatgagaatgaattggcaaaattaaatgcgacacttgtcgaaaggcgcaaagggaaaacagacgctgagacagctgccaaatggctacaaaatgttaactattttgggacaatgctggtttatactggcaaagctgacggtatggtgtcaggcgcagtacatccaactggtgatacagttcgtcctgcgttgcagatcattaaaacggcgcctggctcatcacgtatttctggtgcattcattatgcaaaaaggcgaagagcgttatgtatttgcggacgctgccattaacattgacattgattcggacacgatggctgaaattgcaatacaatcagcccacacagctcaagtgtttgatattgaaccaaaagttgcgatgctttcattttcaactaagggctccgcgaaatcacccttggtcgataaggtggcaactgccactgcattggctaagaagttagcacctgaactggcggactcaattgatggagagttacagtttgatgctgcgtttgttgaatctgttgctgccgcaaaggcgcctgattcaaaagtcgcaggtaaagcgaacacatttattttcccaagtctagaagcaggtaatattggctataaaattgcacaacgcttgggtgggtttgaagcgattggacctattttacaaggcttagcaaaacctgtttctgatttatcgcgaggagccaatgaagaggatgtttataaagtagctattattactgctgcgcaagcattataa

SEQ ID NO: 1098 - DNA, 993 bp, Leuconostoc citreum KM20
atgcttgtggtggaattatttgaacaattgaaggggaaaattagcggtcaaaacaaagtgattgtttttcctgagggtgaagatgttcgtattcagggcgcagcggtgcgtttggctgctgaaggcctaattaagccgattttgttgggcgcacaaaaggctattgaagcaacagcggttgccaataactatgatttatcggacttagtaatcattgatccagcaacatatgatgaaaaagcgcttgctaaattaaatgccgccttagttgaccgtcgcaaaggaaaaactgatgcagaaacggcagcaaagtggttggctgatgttaattacttcggcacaatgctggtttacactggtcaagctgacggcatggtttcgggtgccacacatccaaccggtgatacagttcggccggcattacaaattattaaaacagcgccaggctcgtcacgcatttcaggtgcctttattatgcaaaaaggtgaggcacgttatgtattctctgatgcagctattaatatagatgttgatgcagaaacaatggctgaaattgctgtacaatcagccaaaactgcacaagtctttgacattgaaccaaaagtggccatgttatcattttcaactaaaggctctgcaaaatcaccactggtcgataaggttgcagaagctacggctatagctaaaaaactggcacctgatttagctgatagtatcgatggtgagttacaatttgatgcggcttttgtagcttctgttggtgaggcaaaggcaccaaactcaaaagttgctggccatgccaacacatttattttcccaagtttagaggctggtaatattggttataaaattgcgcaacgtctaggcggttttgaagcaattgggcctattttgcaaggactagccaagccagtttctgacttgtcacgtggcgcaaatgaagaggatgtgtacaaagttgcaattattacagcagcacaggcattagtataa

SEQ ID NO: 1099 - DNA, 981 bp, Weissella paramesenteroides ATCC 33313
atggagttgtttgagcaattagcaaataagataaaaggacaaaataagacacttgtatttccagagggggaagatgcacgtattcaaggtgcagcaattcgtttagctgctgatggtctagttaagccaattttgttaggaaagcagtcattgatcgatgcgacggcagaaaaacatcaatttgatttatcaaacataacagttattgatccagcaagttatcctgaagataagttgaacgacatgattcatgaacttattgaacgtcgccatggaaagacagatacagcgaccgctaaaaagtgggttactgatgtgaactatttcggtacgatgttagtctatatgaatttagctgatggtatggtatctggtgcaacacatccaactggggatactgttcgtcctgctttgcaaattatcaaaacagcgccaggttcatcaagaatttctggtgcgtttgtgatgcaacgtgatgatgaccgttatatctttgctgatgcagcaatcaatattgacattgatgcacaaacgatggcagaaatcgctattcagtcagctaagacggcaaaagtctttggtattgatccaaaggttgcgatgctaagcttttctacaaagggctcagccaaagcaacacaggttgataaagtttcagaagcaacgaaaattgctaaagaactagaaccatcactagcacttgatggtgagctacaatttgatgcagcgttcgttcctgaggttgctaagtcaaaggcaccagattctgaaattgctggccaagcaaatgtctttatcttccctgatctacaatctggaaatattgggtataaaattgcccaacgtttaggcggctttgaagcagttggcccaattttacaagggttagcaaagccggtttcagatttgtcacgaggcgccaatgaggaagatgtctataaggtcgctattattacggctgcacaggcattagaaaactag

SEQ ID NO: 1100 - DNA, 1095 bp, Oenococcus oeni ATCC BAA-1163
atgacaaatttatttactgagttggctgataaaattaagggaaaaaaactgagactcgtttttccggaaggggatgattcaagagtccagggggcggccatccgtttaaaaaaagatggtttactaacgccgatattattgggagatcaggcagcggtcgaaaagacagctgcagataatcatttcgacctgagtggcatcaagcttatcgatccgcttaaattcgatgagaagcagttcaatcaattgatcgataaactggttacccgacgaaaagggaaaactgacccgcaaacggcagctatgtggctgcaggaagtaaattatttcggtaccatgcttgtttataccggcaaggccgacgcaatggtttccggtgctgttcatccaaccggcgatacggttcgtcccgctttgcagattatcaagacagctcctggtgtcagtcgtatttccggtgcttttattatgcaaaaaaatgatgaacgctatctgtttgccgattcggcaattaatatcgaacttgatgcacaaaccatggctgagattgccgttcaatcagcccatacggctaaaatatttggaatcgatccaaaagttgccatgctgagtttttcaaccaaaggatcggcaaaacatgcattggtcgataaagttgctcaggcaactaagctggcgcaggagatggcaccggatttagctgataatattgatggtgaattacaattcgatgcagcttttgtcgaatcggttgccaaattaaaagctccgggatcaaaagtggccggtcatgcgaacgttttcatttttccaagtttggaagccggaaatattggttataaaattgcccaacgcttgggtggatacgaagcaattggtcctattttgcaaggattggcagcacctgtttccgatctgtcgtgtggagcaagtcaagaagacgtatataaagttgcaattatatactgctgctcaggctttaaaaaattagttatcttcgtttccttcgataataaccgtactgccttccgaatcatggattctcagggcaatttttttattaaatcgatgttctggttcggctatttcagttaa

SEQ ID NO: 1101 - DNA, 990 bp, Granulicatella adiacens ATCC 49175
gtggaattatttgaagaattatcacttaaagtgaaagggaaagacgttaaaatcgtatttccagaaggagatgaaccaagaattattggtgcggctgttcgtttattagcagatggactttgcaaaccaatcttacttggaaatgtagatgctattaatgaagtagcagaagctcgtggatttaacatttctcatttagaaattatcgatcctgaaacttatgcggacgataaatatgcagaaatggttgcaagctttgtagcacgtcgaaacggtaaagtatctgaagaagatgcgcaaaaattattacgtgacgtaacttacttcggaacaatgatggtatacatgggcttagcagacggattagtatctggtgcggttcactcaacaggggacactgtacgtccagcattacaaatcatcaaaacaaaaccaggagtatctcgtacaagtggtgcgttcatcatgatcaacagcgacaaatctaagaaatacttattctcagactgcgcaatcaacattaaccctaacgcacaagaattagctgaaatcgcagtagaatctgctaaaacagctgaattattcggtattgaaccaaacgttgcaatgttaagtttctcaactaaaggttctgctaaatctgaagaagcattaaaagtagctgaagcaactaaaatcgctcaagaattagctccaaactacaacatcgacggagaattacaattcgatgctgcattcgtaccaagcgttggtaaacaaaaagctccagactcaccagtagctggacaagcaactgtattcgtattcccagaaatccaatcaggtaacatcggatacaaaattgcacaacgtttcggtaacttcgaagctattggaccaatcttacaaggattaaataaaccaatctctgacttatcacgtggatgtaacgaagaagacgtctacaaattagcgatcattacagctaaccaagcgttgatggaaaactag

SEQ ID NO: 1102 - DNA, 984 bp, Granulicatella elegans ATCC 700633
gtggaactatttgaagaattgtcaggcaagattaaagggaaaggattaaaaattgttttcccagaaggaagcgaacctcgtattttaggtgctgttgtacgtttgaaagcagatgaattatgtcatcctattttattaggtaaaaaagatgaaattgaagaagtagcgcaaagacgtggatttaatttacatgatattactgttattgatccagaaacttatgaaaactttgatgcagtagtagaaagttttgtagaacgtcgtaaaggaaaggctactccagaagctgctcgtgaattattaaaagatgtgacttattttggaacaatgatggtacatatgggattagcagatggtttagtatctggtgcagttcactctactggagacactgtacgtccagctttacaaattattaaaacaaaaccaggtgtatcacgcacaagtggtgcatttatcatgattaatagtgataaatctaagaaatatttattctctgattgcgctattaacattaatccaaatgcgcaagaattagctgaaattgctgttgaatcagctaaaactgcagaattatttgggattgaaccaaatgttgctttattaagtttctcaactaaaggttctgcaaaatctgaggaagcattaaaagtagcagaagctgctcgtattgcgaaagaattagctcctaattacaatattgatggagaattacaatttgatgctgcatttgttccaagtgttggtaaacaaaaagctccagattcaccagttgcaggggaagctacagtatttgtattccctgaaattcaatcaggaaatattggttataaaattgcacaacgtttcggtaactttgaagcaattggaccaatcttacaaggattaaacaaaccaatttctgatttatctcgtggatgtaatgaagaagatgtttataaattagcgatcattacagcaaaccaagctttaatggaagcataa

SEQ ID NO: 1103 - DNA, 981 bp, Carnobacterium sp. AT7
gtggagctaattgaaagcttatcaagcaagattaaaggaaaaaaagttcggattgtatttccagaaggatctgaacctcgtattcttggtgctgtagttcgtttggcatcagaagatttagttcaaccggtattaattgggaaccccgaagttgttaaagaagctgcaaaaaatcgtggcttcaatgtagaaaacattgaaattgttgacccagcaaattatgctaaaatagatgaaatggttgcttctttcgtagaacgtcgtaaaggtaaagtttctgaagaaaaagcaattgaattattaaaagatgaaaactattttggtacaatgttaacctatatgggattagttgatggcttagtaagtggagcaatccactcaacaggagacactgttcgccctgcattacaaattattaaaactaaaccaggcgttagccgtacaagtggtgcatttattatgatgcgtggacgtggacaagaaaaatacttattctcagattgtgcaatcaatgtgaatccaaatgctcaagaattagctgaaatcgctgtagaaagtgctaaaacggctgaaatgtttggtatcgaaccaaaagttgctatgttaagtttttcaactagaggatcagcagttgctgaagaagcaactaaagtagcagaagcaactaaaattgctcaagaactagctcctcaatatgatatcgatggtgaaatgcaatttgatgctgcattcgtagcttctgttgctgaacaaaaagcaccagattctaatgttgctggacaagcaagtgtttttgtattccctgaattacaatcaggaaacattggttataagattgcgcaacgttttggtaattttgaagcaatcggacctatcttacaagggttaaataaacccatctcagacttgtctcgtggttgtaacgaagaggatgtttacaaactaacaatcatcacagcaaatcaaacattaatgaattaa

SEQ ID NO: 1104 - DNA, 984 bp, Enterococcus gallinarum EG2
gtggaactattcgaaagtttaaaatttaaaatcgtgcgtcgtcatatcaaaatcgttttcccagaagcaacagatcctcgtatccttggtgcagcaagccgtctacgttcagaagaattggtagaaccagttttgattggtaaccctgctgagattgagaaagcagcggaagctcgaggaatcaacatcgctaattttgagatcctagatcctgaaaactatgaccggtgggatgaaatggtcgaagcttttgttgagcgccgaaacggcaaagcaacaaaagagcaagccgaagaaatcttaaaagatgttaattattttggtacgatgttaacttacatggggatcactgaaggaatggtttcaggtgcgatccattcaacgggcgatacggttagacctgcattgcagatcattaaaacaaaaccaggcgttagccgcacaagtggtgcctttttgatggttcgtggtcgtgatcaagaaaaatacctattttctgactgtgccatcaatgtgaacccttctgcccaagaattagcagagatcgctgttgattcagcaaaaacagcggaattatttgatatcgatccaaaagttgccatgcttagcttctcgacaaaaggttcagctaaagcaccagaagtcgataaagtggttgaagcaacaaaaattgcccaagaattggcgcctgagtacgaaatcgatggtgaattgcaattcgatgctgcttacatttcagctgtcgctcaattaaaagcaccagaatcagaagtagctggtaaagcaacggtctttgtcttcccagatttacaatctggaaacattggctacaaaatcgcacaacgcttcggtaacttcgaagcaattggaccaatcctgcaaggattgaacaaaccaatctcagacctttctcgcggatcaaacgaagaagacgtctacaaactatccatcatcacagcagcacaaacattgatggataaataa

SEQ ID NO: 1105 - DNA, 1026 bp, Enterococcus faecalis TX0104
gtgtatgatggattttgtaaatataaaactggagggtttatcgtggaattattcgatagcttaaaatttaaagtcgtacgccgtaatatcaaaattgttttccctgaagcaacagatcctagaatcttaggtgctgctgcccgcttaaaatctgatgaattagtagaaccaatcttaattggtgatccaacagatatcgcaaatgctgctatggctcgtggaatcaacacatcaaactttattattatcaaccccaatgattatgaaaaatgggatgaaatggtcgaagcatttgttgaacgccgtaatggaaaagctactaaagaagatgctgaaaaaatcttaaaagatgtcaactatttcggtactatgttaacttacatgggtattgctgatggtatggttagtggtgctatccactcaacaggtgatacagttcgtcctgcgttacaaattattaaaacaaaaccaggtgtgagccgtacaagtggtgccttcttaatgattcgtggtcgtgaccaagaaagatatttattctcagactgcgcgattaacgtgaacccaactgcacaagaattagctgaaattgctgttgatagtgccaaaacagctgaattatttgacattgaaccaaaagtttcattgttaagtttttcaacaaaaggttctgcaaaagcaccagaagtaacaaaagttgctgaagctacaaaaattgcgcaagaattagcacctgaatatgcgattgatggtgaattacaatttgatgcttcttatgtatcttctgtcgcacaattaaaagcgcccaactcaaaagtggctggagaagcaacagtctttgtattcccagatttacaatcaggaaatattggctacaaaattgctcaacgtttaggtaactttgaagcaattggcccaatcttacaaggattgaacaaaccagtttctgatttatcacgtggtgcaaacgaagaagatgtttataaattatcaatcattacagctgctcaaacattaatgaacgactaa

SEQ ID NO: 1106 - DNA, 1017 bp, Enterococcus faecium TX1330
atgataatacatataaaaacgtctggaggtcatcttgtggaattgtttgatagtttaagatttaagattgttcgccgtgggatcaaaatcgttttcccggaagctactgatgctcgaattttaggtgcagctgctcggttgaaagcagaagaactggtggaacccattttagtaggaaacgaagaagaaataagaaatgcagcacatgccagaggaatcaaaacatctagctttacgatcattagtcctgatacttatgataagtgggatgaaatggtagatgcatttgtcgaacgtagaaatggaaaggcatccaaagaacaagcagaaaagattttaaaagatgtgaattactttggtacgatgcttacgtatatgggtgttgcagacggcatggtctctggagcaatccattcgacgggtgacactgttcgtccagcactccaaatcatcaaaacaaaacctggtgtcagtcggacaagtggtgcgatgatcatggtacgtggaagagaccaagaaaaatacgtcttttctgattgtgcaatcaatgtgaatccaactgcacaagaattggcagaaatcgctgtagattctgcaaaaacagctgaactgttcgatatcgaaccaaaagtggcgatgatgagcttctcgacaaaaggttcagcgaaatcgccagaagtagacaaagtagttgaagccactaaaatcgctaaaaaactagcaccacaatatttgatcgacggcgaattgcaatttgatgcttcttatgttccttcagttgcacaactgaaagcgccagattcagaagtagctggtcaagcaacagtctttgtatttccagaattgcaatcaggaaatattggctataaaattgctcaacgttttggtaactttgaagcaatcggaccaatcttgcaaggtttgaacaaaccggtttctgatttgtctcgtggggcaaatgaagaagacgtatataaattatcgattatcacagcagcacaaacattgattgattaa

SEQ ID NO: 1107 - DNA, 987 bp, Lactobacillus sakei subsp. sakei 23K
ttggatttatttgaaagtttgaaagcaaaaattacgcgtcatgattttaagattgtttttcctgaaggaacagaacctagaattattggtgcagcagcccgtttaaatgctgatcgaattttaaaaccaattttaatcggggatgcagctgatattcaaagcattgcatctgccaaagggtttaacctcacagggattacaattattgatcctaaagcgtatcctcaagcagattttgacacaatggtagcagcttttgttgaacgtcgtaaaggtaaagcaacggcggaacaagcccaaactattttacaagatcctaattactttggcacaatgatggtttatcttgatttggccgacgggatggtctcaggtgctgttcactcaaccggtgatacagtccgtccagctcttcaaattattaaaacaaaacctggcatccaacggacaagtggagccttcatcatgcaacgcggtcgcgacaatgaacgttatttgttctcagactgtgcgatcaacatcaacccaaatgcacaagaattagcagaaattgcagtggcttcagcacgcacagctgaattatttgatattgatcctaaagtggcacttttgagcttctcaacaatgggttctgcccgtggtgaagaagtgacaaaagtccaagaagcaacgaagattgcccaagaattagcacctgacttagacatcgacggtgaattacaattcgatgccgcttatgtcccagtagttgctaaccaaaaagcaccagattcaaaagtcgctgggcaagccaacgtcttcgtattcccagaattacaatcagggaacattggctacaagattgcccaacgatttggtaacttcgaagcaatcggtccaatcctacaaggcttaaacaaaccaatctcagatttatcacgcgggagcaatgaagaagatgtctataagttagccatcatcacagctgcccaagcattacaaaactag

SEQ ID NO: 1108 - DNA, 984 bp, Catonella morbi ATCC 51271
atggtaatgttcaaacgcttagctaacaacatcaagggtaaacacctcaagattgttttcccagaagctaacgacaaacgtgtattaggggcagctgttcgtctacgtgtagatgacttagtagagccaatcctcttggggaatgtagaagaagtcaaggccttggcagcacaaaacagctggaatatcgacgcctttaccattatcgatccagaaacttatgcagaatacgatgccatggtagcagctttcgtagaacgccgtaagggcaaagcgactgaagaacaagcgcgcgaattgctcaaggacgtgtcctacttcgggactatgttggtctacatgggcttagcggatggtttagtcagcggggctgttcactcaactggtgacaccgttcgtccagccttacaaatcatcaagaccaagccaggcattagccgtacatctggggccttcatcatggtgccagctgagagcgacggtcaaaaattagtcttcgccgactgcgcgatcaacatcaacccttcagcgcaagaattagctgaaatcgcagtagaatctgcgcacactgctaaaatcttcgacatcgaaccacgcgtagctatgctcagcttctcaaccaagggctcagctaaggcacccgaagtggacaaggtggtagaagcaactaagttggcgcaagaattagcgccagaagtgctcatcgatggggaactccaatttgacgcttcttactcggaaatcgtggctgaccaaaaggcacctggttctgaagtagccggtcatgcaacggtctacatcttccctgacctccaatctggtaacatcggctacaagattgcccaacgtttgggtcgctatgaagccgtaggtccaatcttacaaggtttgaacgcgccaatctctgacttatctcgtggttgcgtggaagaagatgtctacaaggtagccattatcaccgctaaccaagctttagcaaactaa

SEQ ID NO: 1109 - DNA, 981 bp, Lactococcus lactis subsp. cremoris MG1363
atggaactttttgaatcactgaaacaaaagattagtggaaaagacttaaaaattgtctttcctgaaggaactgatacacgtattttaggtgctgcaaatcgtcttaatgccgatggattgattacacctgtctttattggaaatgtcaaagaagtcactgaaacattgatttcacgtggaattaacccagagggctttgagatttacgacccagaaaattgtggacgttttgaaacaatgacagaaacatttgttgaacgtcgcaagggtaaagttacagaagaacaagcaaaagaaattttgaaagacccaaattactttggaacaatgcttgtttatatgggaattgctgacggaatggtttctggtgcaattcattcaactgctgatactgttcgtccggctctccaaatcattaaaacaaaaccaggagtaaaatctgtttctggtgcctttattatggttcgcggtcgtgatgacaatgaaaaatatatttttggtgactgtgcaattaacatcaaacctgatgctccaacacttgctgatatcgccgtagcctcagccgaaactgcaagactctttgatattgaccctaaaattgcgatgctttcattctcaactaaaggttctggtaaatcagaagatgtggataaagtggttgaagcaacaacactagttaaagaaggtcaccctgaagttgaaattgatggggaacttcaatttgatgctgcctttgttccagctgttgcacgtcaaaaagcacctgattcagaagttgctggtcgtgcaaacgtctttatcttcccagacattcaatcagggaatattggatacaaaattgcgcaacgtctaggtaattttgaagccattggcccaatcttacaaggattgaatgcgcctgtttctgacctttcacgcggttgtaacgaagaagatgtttataaacttgcaatcatcacagctgctcaagctttaaaataa

SEQ ID NO: 1110 - DNA, 978 bp, Lactobacillus casei ATCC 334
ttggacctatttgaaagtttaaaagacaagattaatggcaaaaatttacggattgtatttccggaaggcgaagatccgcgcgttttgggcgcagcagttcggctcgcagctgacgggttgatacaggccatcgtgctaggtaatcctgataagattcagacattggcagctgctaaaagctgggatctcagcaagttgacagttcgcgatccagccaacgatgaccttcacgctaaaatggttgcggcctttgttgagcgtcgcaaaggcaaggcaaccccagaacaggccgaaaaaattgttcaggatgccaattattttggtacgatgctggtttacatgaaggaagcagacggtatggtttcaggcgcagttcattcaacggctgacacagtccggcctgctttgcaaattatcaagacgcgtcctggcgtgcatttggtcagtggtgcgttcattatgcagcgtggccgtgacgaacgctacttattcgcggataacgccatcaacattgatccagatgctgatcagctggctgaaattgcggttgagtcagctaaaactgctgccttgtttgatatcgaaccaccgcgcgtcgccttgctgtcattctcaaccaaaggcagtgctaagggaccgcaagtagataaggtagttgaagccactaagaaagctcatgaactggcacctgatttggccttagacggtgagttacaatttgatgctgcttttgtcccaaccgttgccaagcaaaaagcccctgattccaaagtggctggggaagcgaatgttttcattttccctgaattacaatccggtaatattggttataagattgcgcaacgattcggcgggtttgaagccattggcccaattttgcaaggtttgaatcagccagtttctgatttgagtcgtggggcaaatgaagaggatgtctataagttggccattattacagcggcccagaccttgctatga

SEQ ID NO: 1111 - DNA, 978 bp, Lactobacillus plantarum WCFS1
atggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaa

SEQ ID NO: 1112 - DNA, 975 bp, Lactobacillus brevis ATCC 367
atggaactttttgatagtctcaagcaaaaaattaatggtcaaaataaaaccatcgtctttcccgagggggaggatgaacgcgtcttaggtgccgctagtcgattggtcgctgatgggttggtcaaagcaattgtcttgggcaaacaaagtcagattgagaccacggcaacgaaccatgcaattgatctgagccagttaacgattctggacccagcccagatgccaagcgatcaacatcaggcgatgttagatgcgttggttgaacgtcgtaagggtaagaatacaccggaacaagctgccgaaatgttaaaatatccgaactacgtaggaactatgatggtttatatggggcaggctgacggtatggtttctggtgcggtgcacgcaactggtgatacagtgcgcccagccctacaaattattaaaactaaagctggcgttcaccgtattagtggggcctttatcatgcaaaagggtgacgaacgctacgtatttgccgactgtgcgattaatattgaattggatgcagctggaatggctgaagtggccattgaaagtgcgcacacggctaaggtctttgatattgatcccaaagttgccatgctgagcttctccactaaaggatcagccaaaggtgatatggtgacgaaggttcaagaggcaacggctttggcccatgaatcggcgccagacctaccattagatggtgaattacaatttgatgcggcctttgttcccagtgtcgggacgcaaaaggcgcctgattctaaggttgctgggcatgccaatgtcttcgtctttcctgaattacaatctggaaatattggctacaagattgcgcaacggtttggcggcttcgaagccatcggaccaattctgcaaggcttgaacaagccagtttccgacttatctcgtgggtgtaatgaagaagatgtgtacaaggtagccatcattacggcggcacaatcactataa

SEQ ID NO: 1113 - DNA, 978 bp, Lactobacillus hilgardii ATCC 8290
atggaactatttgaaagtctcaagcaaaaaatcaacgggaaaaatattagtattgtttttcctgaaggtaacgatgttcgtgtactcggtgctgcaagccggctggctaaggatggtcttatcaaaccggttattttaggtgataaaaatgaggttgagcaggttgcaggtgacgcaaacgttgatttgaatgatgttcaaattattgattacctaaatcagcctcaagatcaaattgatgcaatggtctcggcaatcgttgaaaggcgaaagggcaaaactgatgaggccaaagctcgtgaatggttgaaagatcctaattattttggaacgacattggtatacatggacaagatagacggaatggtttcaggtgcaaatcacccaacaggtgacacggttcgcccggccttacagattattaaaacaaagccaggcgttaaattaatcagtggttcttttattatgcaaaagggtgatcaacgttatctgtttgctgattgtgccattaatattgatttggatgctgctggattggcagaagtagccgttgagagtgctaaagtggctaagacatttgatattgatcctaaagttgctttacttagtttttcaactaaaggttcagctaagggtgatatggttacaaaagttcaagaagcaactgaattggctaagcaacaggcgccggatattccaatcgatggcgagttgcaatttgatgctgcctttgtgccaagtgttgctgataagaaagcaccaggttcaaatgtagcgggacatgcaaccgtctttattttcccagaactacaatcaggaaatatcggttataagattgcacagcgttttggtggatttgaagcaattggaccaattttacaagggttaaataaaccggtttcggatttatcccgtggtagtaatgaagaagatatctacaaggtttcgatcattacggctgctcagacgttgtcttaa

SEQ ID NO: 1114 - DNA, 987 bp, Lactobacillus sanfranciscensis
atggatttatttgaaagtttaaaaagtaaaattaaagatcgtaaaattaaattagtttttcctgaaggggaagacgaacgaattatttcagcagctagtcgcttagctaatgatgatttagcaattccagttttattaggtaacgaagctgaaattaagaaaacggcggatgctcttaacgtatcacttgatggcattgaaattgttgatattgaaaatgttcctggtgaagttcgtcaacaaatggtacaagcaattgttgaacgacgtaaaggaaaaactactgctgaccaagcagctcaatggcttaaagatcctaattattttggaactaccatggtttatatggatgatgttgatggaatggtttcaggtgctgctcacccaactggtgatactgtgcgtcctgctcttcaaatcattaaaacaaaacccggtgttaacttaattagtggctcatttgtaatgcaaaagggagatcaacgttatctctttgctgattgtgccatcaacattaacccaaatgaaactcaactagctgaaattgcagttgaaagtggtaaaactgctcggctatttgatattgacccacgagttgctttattgagtttttcaactaacggttctgccaagagtccagaggtagaaaaagtgcataatgccactaagttagctcaagaaatggatcctgcaatgccaattgatggtgaaatgcaatttgatgctgcgtttgtacctgcagttgccaaagcgaaatactcagattctaaagttgctggtcacgcaacggtctttgtttttcctgaactacaatctggaaacattggctacaagattgcccaaagaatgggtggttttgaagcaattggaccaattttacaaggtttaaacaaaccagtttccgatctttcacgtggatgtaatgctgaagacgtttataaagtatcaattattactgctactcaagcattagcagataaggattaa

SEQ ID NO: 1115 - DNA, 978 bp, Lactobacillus ruminis ATCC 25644
atggatttatttgaaagtttgaaaaataagatttctggcaagaacatcaaaatcgtttttcctgaaggaaacgacgaacgcatcgttaaagcagcggttcgtttggcaaatgacggcatgatcaggccaatcattcttggagcaaaagaaacggtcgaagattcgaataatggacaggctttgccggaaagcatcgaagtaatcgatcctgacaagtatccttcggaagaatttgaaaagatggtggcagctttcgtcgagcgacgcaagggcaagaatactgaagaacaggcacgaaagatgctgaaagatgttaattatttcggaacgatgatggtctacatgggaaatgccgacggactcgtttccggtgccattcatccaacgggcgacacggtccgtcctgcgcttcagattattaaaacgaagccaggcgtcagtcggacgagcggtgcattcatcatgagtcgcggtgatgagcgctattattttgccgattgtgcgatcaacatcaatcctaatgctgaagaactggcagaaattgccgttcaaagcgcaaaatctgcgcgtttgttcgatattgatccgcgcgttgcgctgctcagtttttcaacgatgggctctgcaaaatcggatgaggtcacaaaggttcaagaagcaaccaagcttgctaaggaaatggctcctgatgagcaaatcgacggcgaactccaatttgacgctgcatttgtcaaaagcgttgcggaaaagaaggctaaagactcaaaagttgccggcagcgcaaacgtctttgtctttcctgaactgcagtcaggaaacatcggctacaagattgcgcagcgtttgggcaatttcgaagcggtcggaccgattcttcaaggcttgaatgcgcctgtttccgatctttcgcgcggatgctccgaagaagacgtttataaggttgctttgatcacggcagcgcaaacgctgggggactaa

SEQ ID NO: 1116 - DNA, 978 bp, Lactobacillus salivarius UCC118
atggatttatttgataacttaaagcaaaaagttgcaggagcaaacaaaacaatagtattcccagaaggacaagaaccacgcatttttcgtgcagctattcgattgaagaatgacggtttagtagttcctattttgttaggaaaagttgatgaaattaagcaaaatgcggaaaatgaaggggtagatttaggagatattgaattaattgatccaaatacttatcctgaagataaatttgctgaaatggtagaagcttttgttgaacgcagaaaaggcaaaaatactaaagaacaagcagaaacaatgctacgtgatgtaaattattttggaacaatgttagtttacatggataaagctgatggcttagtttcaggtgctattcattcaacaggggatacagtacgcccagcattacaaataattaaaacaaagccaggcgtaagtagaacaagtggtgcatttgtaatggttaaaggcgacgaaagatatttatttgcagattgcgctatcaacattaatccaggtgcacaagaattagctgaaattgctgtggaaagtgcaaacactgctaaaatttttgatattgatccacaagttgcaatgctaagtttctctacaatgggttcagctaaatcagatgaagtaacaaaagttcaagaagcagtaaaattagctaaagaattagcacctaatgaaaagattgatggagaactacaatttgatgcagcttttgtaccagttgttgctaaacaaaaggcaccggaatcagaagttgcaggacatgctaatgtctttgtattcccagagttacaatctggaaatattggatataaaattgcacaaagattaggaggattcgaagcaattggacctgttcttcaagggttaaataaacctgtatcagatttatcaagaggttctgttgaagaagatgtctataaggttgcaattattacagcagctcaagctttgatgtaa

SEQ ID NO: 1117 - DNA, 981 bp, Erysipelothrix rhusiopathiae ATCC 19414
atggatttatttgaaggtttaaaagaaaagatttccgggaaagatattaaagttgtttttccagaaggtattgatgcacgtattattggtgctgcagtacgtttagcagctgatggactgtgtcatccaatcatcttaggtaataaagaagtaattttatcgtcagcacaagatttaggtttcttgatggataaagtagagattatcgatccagaaacttatcctgaagacaaaaaagaagcaatggttgatgcccttgtggaacgtcgtaaaggtaaattagctaaagaagatgcttacgagtggattaaaaatgtaaactattttggaacaatgttaacatatatgggtgatgcggatgctatggtgagtggtgctattcactcaacaggtgatacggttcgtccagcattacaaattattaaaacaaaacctggtgtaagccgtacaagtggcgcatttattattttcaaacgtcatgagtcatacttattctcagattgcgcaattaacatcaaccctaattcacaagaattagcagaaattgctgttgaaagtgcaaaaacagctgagctctttgatatcgatccaattgtttcgttattaagtttctcaactaaaggttctgcaaagagcgacgaagttgataaagttgttgaagcaacacgaatcgctcaagaacttgctcctgaatatcaaattgatggtgaactacaatttgatgcttcatttgtacctacagtagctcaattaaaagctcctgagtcaaatgttgcaggtaatgcacgtgtctttattttcccggatttacaatcaggtaacattggttataagattgctcaacgtcttggtggatatgaagcgattggaccaattcttcaaggacttaacaaacctgtatcagatttatcacgtggttgtgttgaagaagacgtttataaacttgcaattattacagctgcacaaactttaattaaataa

SEQ ID NO: 1118 - DNA, 972 bp, Pediococcus pentosaceus ATCC 25745
atggatttatttgaaggtttgaagtcaaaaattaagggccaaaatagaacagttgtatttcccgaaggtgaagatgttcgagttttagctgccgctattcgactagctgatgatggcttagttcaatcaatcttactcggagtggaagctgatattaaagctactgctgaaaagcatggattaaaccttgaaaatgtgcaaattattgatccgagccaatatccggaagccgatcaaaaggaaatgattgataagttagttgaacgtcgtaagggtaaaaataccgaagaacaggttatcgaaatgctcaaagatgtaaattacttcggaactatgctagtttacttaggcaaggcggatgccatggtatctggagcagttcatgctactggtgatacagttcgccccgctcttcaaattatcaagactaaaccaggaatgcgtcgaattagtggagcatttatcatgcaacgcgaaaatgaacgctatgtctttggggatgcagctattaatattgatcccgatgcagaaacattggctgaaattgcgattcaaagtgcagaaactgctcgcctatttgacatcgaccctaaggttgcaatgttaagcttttcaactaaaggctcagcggctggaccaatggtagataaagttcgcgaagctactaaggttgcccaagaacgtgatccaaagaccccatatgatggtgaacttcagtttgatgcagcctttgttccagctgttggagcaagtaaggctccagattcagaaattgcaggacatgcgaatgtctttatcttccctgaacttcaatctggaaacattggttataagattgctcaacgtctaggcggttttgaagcaattggcccaatcttgcaaggacttaatgcaccggtttccgatttatctcgtggagctagtgaagaagatgtctataaagtagcaattattaccgcagctcaagtttag

SEQ ID NO: 1119 - DNA, 972 bp, Parvimonas micra ATCC 33270
atgaatatttttgaagaattaacaggaaaaattaaaggaacaaacaagaaaattgtatttcctgaaggagaagataagagagttttaggtgcttgtgttagattaaaaaaagacggtttagtaactccaataattttaggaaatgttgaagaaatcaaaaaaactgcaaaagaattaaatgtttctgttgatgatattgaaatcattgatcctttaaaagcagaagattttgatgaattagttgaaaaatttgttgaacgtagaaaaggcaaaaacacaaaggaagaagctgaaagatttttaaaagatgtaaattactatggaacaatgatggtacaagttggaaaagctgacggaatggttagcggtgctgttcactcaacaggagatacagtaagacctgcacttcaaatcgtaaagactaaaccaaatgtttcaagaacaagtggagcaatggttatgcttggaaaaaatggagaaagatatgtatttgcagatattgctatcaatattactttagaagcaaaagaattagctgaaattgccgttgaaactgcaaaaacagcagaattatttggaatagatccgaaaattgcaatgcttagcttctctacaaaaggttctgcaaaacacgaactttctcaaaaaattgctgatgctacacaaatggcgaaagaattagcacccgatttgtcattagacggagaattacaatttgatgctgcaatagttccaacagtaggggaacaaaaggcaaagggctcaaaagttgcaggacacgcaaatgtatttatcttccctgatttacaatcaggaaatatcggatacaaaattgcacaaagacttggaggttttgaagcaataggaccaatcctacaaggacttaacaaacctatttcagacctttcaagaggttgtaatgaagaagatgtttacaaacttgcagtaattaccgctgcacaaagtctataa

SEQ ID NO: 1120 - DNA, 972 bp, Finegoldia magna ATCC 29328
atggatatatttgaatcattgaaatcaaaaatttcaggcaaaaacttaaagatagtatttcctgaaggagaagaattgagaattttaaaagcagtagcgagattgaacgaagaaaaaatcataactcctgtaattttaggtgacgaagacaaaataaaagaattagcaaaaaaagaaaacttgaacatcgaaggggttaaaatcatcaatccacttacagcttctgatttcgatgaaaaagtagacaaatttgttgaaagacgtaaaggcaaaaacactgaagaacaagcaagaacaatgcttaaagacgtgaactactacggaacaatgatgctttattgtgatgaagtagacggtcttgtgtcaggtgctgttcactcaactggagacactgtaaaacctgcacttcaaatcatcaaaacaaaaccaggcacaaaacttgtatcaggagcaatggttatgattggaccaaacggtgaaagatacgtattctctgacatcgcaatcaacatcgaattgtccgaagaacaattggcagaagttggcgttgtaagtgcagaaactgcgaaactatacgatatagatccaaaagttgcattcctttcattctccacaaaaggctctgcaaaacatccatttgcagaaaaagttgccaacgctactaaaatcgctcaagaaatggcaccagatcttccaattgatggcgaattgcaatttgacgcaagtatcgttgaatctgtaggaaaacaaaaagctccaggatcaaacgtagcaggtaatgcaaatgtgttcgtattcccagatttacaagcaggtaacatcggatacaaaatcgctcaaagattaggaaaattcgaagcaataggaccaatccttcaaggaatggcaaaaccagttaacgatttgtctcgtggttgcaacgaagaagacgtgtacaagctagctcttatcacagctgctcaatcattataa

SEQ ID NO: 1121 - DNA, 972 bp, Bacillus coagulans 36D1
gtgagtacattttttgacgggataaaagaaaaagtgcggggacataacaaaacgattgtttttccggaaagttcggatgaaagggttttaacagccgtctcccggtttgcagccgatgaagtactccggccggttttaatcgggaacaaggataaaattcaggcaaaagcccaggccatcggtgtttctgtcaagggcgttacagtgtatgacccggaagactatgccggttttgaagaaatggtgcaggcttttgtggaacgaagaaaaggcaaagcgacggaggaagatgcgcgccaaattttaaaagacgtcaattatttcggcaccatgctcgtctatttgaaaaaagcggacggtctggtaagcggtgccatccattcaacggcagatacagtccggccggcattgcagatcattaaaacaaaaccgggcgtgaaaaaagtttctggcgttttcattatggtgaggggcgaagagaaatttgttttcgccgattgtgcaatcaatatttcaccggacagccaagacttggcggaaacggccgtggagagcgcgaaaactgcccggacatttgatattgaaccgaggattgcgatgttgagcttttcaacaagaggttccgcccattccgatgagacggagaaagtggcgcaggcagtccgattggctaaagagcgcgatccggagcttgtcatggacggcgagatgcagtttgatgccgcgtatgtgccggctgtggcgcaaaagaaagcgccggattccgtgattcaggggaatgcaactgtgtttatttttccaaatctggatgcggggaatatcggttataaaatggcccagcgtcttggcggttttgaagcagtcggtccgattttgcaagggctgaatgcgcctgtcaacgatttgtcgcgcggctgcaatgcggaagatgtttatcatttggctttgatttccgcagcacaaagtttgtaa

SEQ ID NO: 1122 - DNA, 981 bp, Gemella haemolysans ATCC 10379
atggcaaatgatttatttgtagaacttcaacaaaaattagaagggaaaaatgtacgtatcgtactaccagaagcatatgatgagcgtgtattagaagcggctgttaaattaggcgctactagttatgttaaacctgtgttagttgggaaaaaagaaaaagtagaagagattgctaaaggattatctttagatgcttctaacttagaagttattgatcacgaaaactacgaaaaattagaagaattagttgctaagtttgtagagcgtcgtgcaggaaaagtaactgaagaaaaagctcgtgaattattaaaagatgttaactacttcggaactatgttagtatacactggtgaagttgaaggattagtatctggagcaattcactctactggagatactgttcgtccagcattacagattattaaaactaaaccaggtacaaaacgtacaagtggtgcattcattatgagtaaagaagacaaacgttatgtatttgctgactgtgcgattaacccaacattagatgcagaaggtctagctgaaatcgcaatcgaaagtgcaaaaacagctaaaagctttaacgttgatccaaaagtagcaatgttaagtttctctactttaggttcagctgttactgaagatactacaagagtagcagaagctactaaattagttaaagaaaatgcacctgaattagctgttgaaggggaattacaatttgatgctgcagttgtaccttcagttgctaaattaaaagctcctaactcaaaagtacaaggagatgctaatgtatttgtattcccaagcttagaagctggtaatattggatacaaaattgcacaacgtctaggtggatttgaagctgtaggaccaatcttacaaggattaaacgctcctgtaaacgacctatctcgtggatgtaatgcagaagatgtatacaaactttcattaattacagctgttcaagctttagaaaaatag

SEQ ID NO: 1123 - protein, 322 aa, Eubacterium saphenum ATCC 49989
MDLIDVLKEQVKAEKKSIVFPEGTDKRILGAAAKLKKENILNPILVGKEEDVKKTAADNGIDVTDLEILDPATYPEMDELVAKFVERRKGKIDEAGAREKLTNDVNYFGTMLVSTDKVGGLVSGAIHSTGDTVRPALQIVKTKPEYNKVAGCFILRKGDEVYLFADGGVNLDPSAEDLAETAIQTAETAKKFGIDPKVAMLSFSTMGSASSDEVTKVQEATKLAKEKAPDLDVDGELQFDAAFVPEVAALKAPDSKVAGKANVFIFPNLAAGNIGYKLVQRLGGFAAIGPLLQGLNAPINDLSRGCNEKDVYELAIVTAATM

SEQ ID NO: 1124 - protein, 380 aa, bacterium Ellin514
MNLEIWNLTWIPEIKPFDIAVFTFLGYLTSMRFIGSVIEKLQRHPKRVVFPEGTEPRVLQAARQFYSLRLGVPILLGDRTKVKEAAQSLNVSLEGVRIINPAESEDLDSFVRRFESLRRLKGLRSHEAREAMLLPNYYGAMMVAMHQADGMISGTNQTTGSVLRPLFQIIKVAPTTSTASSCMVMEVEDTRFGENGTLFMADCGVIPEPTVEQLADIAISTAQLARQIMGTRPRCALLSFSTKGSAKHPSIMKVQAATALAVKKAQQINLEADFDGELQVDAALVPEIALRKLPDSKVGGRATVLIFPDLNSGNIASKLIQHVARANAYGQILLGLDRPAADVSRGSNAHDILGVAAIVGLQSIEYSKLYPGAGDKLPGE

SEQ ID NO: 1125 - protein, 347 aa, Chthoniobacter flavus Ellin428
MNFIETVFQKLKRHPKRIVFPEGTEPRVLRAAARFVKLQLGAPVVLGRKDEIEKIAVAEDISLDHIGVIDPTTSSELPTFAARLEKLKRYRNLGTKQANEILANPNYFGAMMVQYNQVDGLVTGARDTASSALRPLIQLIKPLPTTTSISSCMMLDLSNKRYGERGVMFFADCAVIPEPNVEQLSDIAVQTGAICRQLTGNKPRIALLSFSTKGSANLPSPQKVAAATALARQKADAQGLEMEIDGELQADTALLPDLAARKAPSSLVAGKANVMIFPDLNSGNIGAKLVQYLAGAETYGQILLGLSRPCADLSRGATEDDILGVAAILGLQAIEYRKLYPPNPSDA

SEQ ID NO: 1126 - protein, 363 aa, Akkermansia muciniphila ATCC BAA-835
MSDWQGFSPLNDFTGPLLDNLKRHPKRIVFPEGEDVRVLRVSQRFVEEQAGAPILLGRREVITRMAEMNGISLKFVRIIEPEKSSDLQMFCDRYERAEQMFGNGLPMNTREIVSEPVHFAAMMVLYGQADAIVAGNMKRVASVFRAVNKYRQDPVPTKPLFAISIVLVPEFSKKFGGRGVYFLADTGVNPEPTVENMAYFAVETAKMARHMLGKSVRVAMLSASTSGSVPELAADRTRAAAALAKSMVQKDCLNNEISIEGEIQIDAALSSDSYSVRVHRNSMLQPSEVWVFPTLDAADISKKLLCMMPSVYNYGLILGGLLFPIAQLPRLTDEDRMFGTALVVGNEAIKFHLLYPQGVAPLY

SEQ ID NO: 1127 - protein, 338 aa, Citrobacter sp. 30_2
MIIERARQLAQRSPARVVFPDALDVRVLKAANYLHQHGLAHPILVASPFALRQFALSHRVAMDGIQVIDPQSNQPMREEFALRWLARAGDKTPADALEKLNDPLMFAAAMVSAGKADVCIAGNLSSTANVLRAGLRIIGLQPGCKTLSSIFLMLPQYLGPSLGFADCSVVPQPTAAQLADIAIASAQTWQAITGEEPRVAMLSFSSNGSARHPNVANVQQATEIVRERAPQLTVDGELQFDAAFVPDVAAQKAPASPLKGNANVMVFPSLEAGNIGYKIAQRLGGYRAVGPLIQGLAAPLHDLSRGCSVQEIIELALVAAVPRQTDVSRENASHTLVV

SEQ ID NO: 1128 - protein, 338 aa, Citrobacter koseri ATCC BAA-895
MIIERCREQALRAPARVVFPDALDVRVLKAAHYLQRHGLARPVLVTSPFALRQFALTHRIAMDGIQVIDPQSNLSMREVFAGRWLARAGEKTPPDALEKLNDPLMFAAAMVSAGHADVCIAGNLSSTANVLRAGLRLIGLQPGCKTLSSIFLMLPQYTGQALGFADCSVVPQPTAAQLADIAIASAQTWRTITGEEPRVAMLSFSSHGSARHPNVANVQQATEIVRERAPDLIVDGELQFDAAFVPDVAAQKAPASPLQGKANVMVFPSLEAGNIGYKIAQRLGGYRAVGPLIQGLAAPLHDLSRGCSVQEIIELALVAAVPRQTDVSREHDSQTLVV

SEQ ID NO: 1129 - protein, 338 aa, Salmonella enterica subsp. enterica serovar Paratyphi A str. ATCC 9150
MIIERARELAVRAPARVVFPDALDERVLKAAHYLQQYGLARPVLVASPFALRQFALSHRMAMDGIQVIDPHSNLSMRQRFAQRWLARAGEKTPPDAVEKLSDPLMFAAAMVSAGEADVCIAGNLSSTANVLRAGLRVIGLQPGCKTLSSIFLMLPQYAGPALGFADCSVVPQPTAAQLADIAIASADTWRAITGEEPRVAMLSFSSNGSARHPNVANVQQATELARERAPQLLVDGELQFDAAFVPEVAAQKAPDSPLQGRANVMIFPSLEAGNIGYKIAQRLGGYRAVGPLIQGLAAPLHDLSRGCSVQEIIELALVAAVPRQADVSRERSLHTLVE

SEQ ID NO: 1130 - protein, 338 aa, Salmonella enterica subsp. arizonae serovar 62:z4,z23:--
MIIERARELALRAPARVVFPDALDERVLKAAHYLQQHGLARPILVASPFVLRQFALSHRMALDGIQVIAPPGNLPMRESFAQRWLARAGEKTPSDAVEKLNDPLMFAAAMVSAGDADVCIAGNLSSTANVLRAGLRVIGLQPGCQTLSSIFLMLPQYAGQALGFADCSVVPQPTAAQLADIAIASADTWRAITGEEPRVAMLSFSSNGSARHPNVANVQQATEIVRERAPQLLVDGELQFDAAFVPEVAAQKAPDSPLQGRANVMIFPSLEAGNIGYKIAQRLGGYRAVGPLIQGLAAPLHDLSRGCSVQEIIELALVAAVPRQADVSSESRLQTLVE

SEQ ID NO: 1131 - protein, 338 aa, Escherichia coli str. K-12 substr. MG1655
MIIERCRELALRAPARVVFPDALDQRVLKAAQYLHQQGLATPILVANPFELRQFALSHGVAMDGLQVIDPHGNLAMREEFAHRWLARAGEKTPPDALEKLTDPLMFAAAMVSAGKADVCIAGNLSSTANVLRAGLRIIGLQPGCKTLSSIFLMLPQYSGPALGFADCSVVPQPTAAQLADIALASAETWRAITGEEPRVAMLSFSSNGSARHPCVANVQQATEIVRERAPKLVVDGELQFDAAFVPEVAAQKAPASPLQGKANVMVFPSLEAGNIGYKIAQRLGGYRAVGPLIQGLAAPMHDLSRGCSVQEIIELALVAAVPRQTEVNRESSLQTLVE

SEQ ID NO: 1132 - protein, 338 aa, Klebsiella pneumoniae NTUH-K2044
MIIDQCRKLALRAPARVVFPDALDVRVLKAAHYLQQQGLAHPILVASPFALRQFALGERLPLTGVQVIDPHSNLAMREAFAAAWQARAGDKAPADAVDKLADPLMFAAAMVSAGQAEVCIAGNLSSTASVLRAGLRLIGLQPGCKTLSSLFLMLPQYAGQPLGFADCSVVPQPTAAQLADIAIASAETWQAIAGEAPRVAMLSFSTHGSARHPCVANVQQATEIVRQRAPQLMVDGELQFDAAFVPDVAAHKAPGSPLQGRANVLVFPSLEAGNIGYKIAQRLGGYRAIGPLIQGLAAPLHDLSRGCSVEEIIELALVASVPRQTDASRIPDSSTLVE

SEQ ID NO: 1133 - protein, 332 aa, Yersinia intermedia ATCC 29909
MAQSHPRRVVFPDALDKRVLEAAHYLLHHSLAQPILLANPFALRHFALSQRLTLDGMTVIDPQNADDWHHEFCQRLTQRLGEKTPADCDEKMRQPLWFAAAMVTGGKADLCIAGNLSSTAAVLRAGLRVMGLQAGTKTLSSLFLMLPPQGDEVLGFADCSVVPQPTSAQLADIAISSAATYQMITGAESRVAMLSFSTRGSAKHSAVASVQQATEIVRQRLPTLIVDGELQFDAAFVPAVARQKAPDSLLEGRANVMVFPSLEAGNIGYKIAQRLAGYRALGPLIQGLNAPMHDLSRGCSSREIIELVLVAQTQCSLSVTPAKANGVASAVA

SEQ ID NO: 1134 - protein, 325 aa, Photobacterium profundum 3TCK
MKLLEQCRAQCLKSPKRIVFPDANDVRLLHAANDMKLAGLAEPILLGSPFQLRDLAHRSGIAVPCLTLLSPESAGCFDEMVKSYIAKQRKPITVEEATDRLKKPLDFAMMMVDQGYADICIGGNVSTTGDVIRAAIRGTGVAPGSKTVSSFFLMLSPDGEQVHAFSDAGVIPLPTAEQLADIAIDTARNYQQLTGNIPRVAMLSFSTKGSADHPAVSKVTEATEMVRQRQPDLIIDGEVQFDAAIVPAVAAQKMPDSPLGGLANVFIFPSLNAGNIAYKVAQRLGGYIALGPMLQGLASPVHDLSRGCSANDIVDISVLASSLCK

SEQ ID NO: 1135 - protein, 323 aa, Shewanella benthica KT99
MKLLDKCREACLKQPKRIVFPDANDVRLLHAANELKMAGLAEPILLGSPFELRDHAHSSGIAMPCLTILAPEFAGCFDEMVDRYIAKQRKPVEREEAISRLKQPLNFAMMMVDQGYADICIAGNMSSTGDVIRAALRGVGVAPESKTVSSFFMMLSPDGSKTFAFSDAGVIPLPTAEQLADIAIDTARNFQKLTGEEPRVAMLSFSTKGSASHPTLTSVTEATELVRQRAPNLIIDGEVQFDAAIVPAISAQKMPGSPLEGAANVFIFPSLNAGNIAYKVAQRLGGYMALGPMLQGLAGSVHDLSRGCSADDIVDISVLASNL

SEQ ID NO: 1136 - protein, 327 aa, Marinobacter aquaeolei VT8
MIRMMEQCRNACREAPKRIVFPDALDARVLHAANELQQRGLAEPIFLCNPFELRDYAHDAGVAVPCFSIVDPLRSPWMDSFISAYLDENEGVDSDEARKLLSHPLYFGAMMVKRAHADICIAGNVSTSGDVIRAAINVIGVEGGHKTVSSFFLMASADGTDFRLFADAGVIPEPTVEQLADIAIDSARSFETLTGEQARVALLSFSTKGSSQHPAAKRVKEAFDLARTRAPSLIIDGELQFDAAVVPAVALKKAPESPLKGNSNVLIFPSLDAGNIAYKVAQRLCNYMALGPMLEGLAKPMHDLSRGCTADDIVDVAIVASCLVNKA

SEQ ID NO: 1137 - protein, 326 aa, Desulfotalea psychrophila LSv54
MSILERCKDVCRKAPKTIVFPDCLDKRVFEAAGRLQAEGLAHPVFMGSPFAVRAKMREAKCSSRGVTVVDHTSPSLLEKNANEFIAIREAKGKKLSMDDAVKAMRCPLAGAAMMVRREEVNLGVSGNISSTGNVIRAGLQFLPKQQGMKTISSFFFMIAPEGGKDYIFADCGVVPVPNENTLADIAISSADKARKLLGEEPRVAMLSFSTKGSANHERAIFVRDTVEQIRKRAPDMLVDGELQLDAAIVPSVAAQKAPGSVVEGMANVLIFPSLEAGNIGYKLAQRLGGYTALGPLLQGFAAGWHDLSRGCTADDIYKVAVVGQCL

SEQ ID NO: 1138 - protein, 341 aa, Rhodococcus opacus B4
MAPGVTAAPTYTARQNDSSLIDGWVAALRGQNRIVALADGEDERAIRAAHTLHHKCVVSPRLFGRRDVIRRIAETAGVPLAEELIVDIADAAADPAIRGAVEAGFARYPDRIVPALSDPVCLAAAALRAGVVDAGVAGAGRPTSDVLRAGLRIVGLAPGSSILSSAFLMLLPDGRQLTFSDCAVVPDPTAGELADIALAAGATHFHLTGQTPIVAMLSFSTQGSARHPRVEKVREAADLVRVRDPQLHVDGDLQFDAALVAEIGASKAPDSRVAGRANVLVFPNLDAGNIGYKIAQRLGGAIALGPILQGLAAPWNDLSRGCTDSDIELIALVSAVQSLAT

SEQ ID NO: 1139 - protein, 342 aa, Rhodococcus jostii RHA1
MAPGVTAVPPTDAARLNDSSLIDHWIATLRGENRIVGLADGEDERAIRAAHHLHHKCVVSPRLFGRRDVIRRIAEAAGIPLAEELVVDLAEAAADPAIRDAVESGFARYPDRIESALSDPVCLAAAALRAGVVDACVAGASRPTSDVLRAGLRIVGLAPGSSILSSSFLMLLSDGRQLTFSDCAVVPDPTVEELVDIALAASATHFQLTEQTPIAAMLSFSTQGSASHPRVEKVREAAELVRVRDPQLHVDGDLQFDAALVAEIGASKAPGSRVAGRANVLVFPNLDAGNIGYKIAQRLGGAIALGPILQGLAAPWNDLSRGCTGSDIELMALVSAVQSLAT

SEQ ID NO: 1140 - protein, 329 aa, Streptomyces sp. AA4
MTMAPLAETWRERVGDARPRIALADGADPRAVTAAAHLVDRGVVEPVLVGSSAEIAAVAGELGVAVPPTLDTAVLAADDAVLARLATAFPDRVENVRTDPVALSAALLALGRVDACLAGATRPTSDVLRAGLRIVGLAPGVRTLSSCFLMLLQDGRSLTFADCAVVPEPDANALADIAVGAASTHRALTGTEPVVAMLSFSTQGSAKHSAVDKVREATSLVRERLPGVAVDGELQFDAAVVDAVGVAKAPRSTVAGRANVLVFPNLDAGNIAYKIAERLGGATALGPILQGVAAPLHDLSRGCSAADIETMALISAVHAVTGREVEGVR

SEQ ID NO: 1141 - protein, 340 aa, Gemmatimonas aurantiaca T-27
MNAAGQGASDAAAAFLQSLHERAAAKPRTILFPEATDIRTVQAVIALQKRKSVVPVLVRRSDASTGVTPTAGVVLDPLTDPRHERVVAHLLARRGDKGLAREDAERLARDPLYFADSLVALGEADGCVAGAVHTTADVLRAALWTIGAASGVRNVSSSFYLIVPPFRSGEGEVLTYTDCAVIPDPSARQLADIALSAAADRRRIVGDEPRVAFLSYSTMGSADGPSVSKVREAVALVRQAAPSLVVSGELQVDAALIGEIARRKAPGEAAGGVANVLVFPCLDAGNIAYKLTQRLAGGTAIGPILQGLAKPCSDLSRGATADDIVHVAAITALQAAGAAL

SEQ ID NO: 1142 - protein, 339 aa, Clostridiales bacterium 1_7_47_FAA
MGLLEQIYEKAKENPQRIAFPEAVNEKMMQAAYETGKEGYILPVLVGYADEIREALSSKGYEEDIFTIVDIREEIYKKKLIDRYVALPHTLLKEKALNRRMQDPLYYAMVMEAVGEADVTFAGIDNTTGDVLLAGQMIIGLKPGISTISSIGLCDIPGFKGSEGSLLAIGDSAVCANPDSGQLAGIAVSACDTVRDLLGWEPRCAMVSYSTLGSGQGELVDKVAEAVRIANEQRPELAIDGEFQFDAAVSPAVAAKKVQRESRVAGKANVIIWPDLNVGNVGVKLIQQFGHADAYGPMLQGFNKVVCDCSRGAPVSEIKGNIVISAVRAAGSKRQEEPV

SEQ ID NO: 1143 - protein, 333 aa, Clostridium papyrosolvens DSM 2782
MNDFLKKMTDKAKENPKIIAFPEATNVDILRTAQQVVITGIGFPMMIGNKEIIEQIADKNGVSTNGFQYFDFNDEEVRQLLAEEYTGKFSDFSAKTVARKAKDPVRCAMFLLKLNKVDCTAAGKEYSTGDVIFEAMSIVGLQEGVESVSSLGIADIPGFNGSEGTMLGLADCAITAQPDAKDLAGIAIASADTAKALLGWEPRVAMLSFSTCGSAEHESLETVRESVELVHKLRPEIKVDGEFQLDSAIIPGVAEKKVKRDSEVAGKANIVIFPNLHAGNIGVKMIQIFGHANAYGPVLQGFAKPVCDFSRSAPVEEMLGNVAMLVIRAAGGR

SEQ ID NO: 1144 - protein, 332 aa, Slackia heliotrinireducens DSM 20476
MTASLMDQLKARACESPKTVVFPEGESPRIIEAAAQAAAEGFAFPVLVGNPQVIGDIAAHRGLSLDGVAIRPLPDETEAEALAAAYLEAGGMLSRKGILRRMKSPMYFGALLVASGQGDAMVAGLEHSTAEVVLASSTIIGFAEGISTPSSICLMECPGFAGPEGELLIFADPGVCEKPDVSALADIAISSARTAKALLNWEPRVAFLSFSTKGSVESEIIDLQLKALEEVRRREPDLKVDGELQFDAAIVPDVARKKVPEGSDVAGAANVLVFPDLNAGNICYKAAQRLTGGNAYGPFLQGFAKTVSDLSRGSSVDDILGVTVMAVLNSQS

SEQ ID NO: 1145 - protein, 283 aa, Ruegeria sp. R11
MTVLENAYALARDRKARVVFPEMDDPRVAAAVDQLTREGLVEAVPLAPVSDAHVEVLVAARGMKEGIAKRMLSKPLYRAAAMVSAGEADAMVAGADVPTRRVIEAASIGIGLDAGVSTASSFFLMVFPDGRELVFADCAVNVAPDAAQLADIARASARSAEALLGVARVAMLSFSTGTSGDGDSVALVRAAAEASGFAGPVQADAALNPVIAEKKGIAPVEANVLIFPTLDAGNIGYKLCQELGGAQALGPFLQGFAKPVCDLSRGASVEDIVAATVLTVAQI

SEQ ID NO: 1146 - protein, 314 aa, Sagittula stellata E-37
MFAGAQRWPPQVDLRPPRGQSLPRIGGGGGMAVLEQAFETARARQARVVFPEAGEPRIDAARERLLAEGLAMPVSLTDTATEAQVAALTGARGMKEPIARRMLARPLFRAAAMVAAGEAEAMVAGIANPTRRVIEAASIAIGLAEGVTIPSSFFLMVFPDGREMIFADCAVNVAPDAGGLAAIARASALSATALLGEARVALLSFSTGTSGAGPSVDIVRAAAGQTGFTGPIQADAALNAAIAATKGMGAGDANTLIFPSLDAGNIAYKLAQELAGAQAIGPMLQGFRRPVCDLSRGASVDDIVAATALCIAMG

SEQ ID NO: 1147 - protein, 337 aa, Fusobacterium nucleatum subsp. nucleatum ATCC 25586
MIIMSFLGQVRKKALQANRRIVLPESSDERIIRATSQILKEGLAQVVLVGNQEAIMHSAKAYEVSLSGAKIVDPYNFERLNDYINKLVELRAKKGMTPEEAKKILLNDPTFFGAMLVRMGDADGMVSGSASPTANVLRAAIQVIGTQPGVKTVSSVFIMELSQFKDLFGSILVFGDCSVIPFPTSEQLADIATSAAETAIKIAGINPRVALMTFSTKGSAKHECVDRVIEAGHILRERKVQFRFDAELQADAALVKSIGEIKAPLSDVSGNANVLIFPTLSAGNIGYKLVQRLAGANAYGPIIQGLNAPVNDLSRGCSVEDIVVLTAITSAQACIDC

SEQ ID NO: 1148 - protein, 337 aa, Fusobacterium sp. 3_1_33
MIIMSFLGQVRKKALQAHRRIVLPETNDERVIRAASQILKEGLAQVILVGNQEAIMHSAKAYEVSLSGAKIVDPYNFERFNDYVNKLVELRAKKGMTPEEAKKLLLNNPTFFGAMLVKMGDADGMVSGSASPTANVLRAAIQVIGTQPGVKTVSSVFIMELSQFKDLFGSILVFGDCSVIPVPTSEQLADIATSAAETAVKIAGINPRVALLTFSTKGSAKHECVDRVIEAGRILRERKVQFRFDDELQADAALVKSVGEIKAPLSDVSGNANVLIFPSLSAGNIGYKLVQRLAGANAYGPIIQGLNAPVNDLSRGCSVEDIVVLTAITSAQACVDC

SEQ ID NO: 1149 - protein, 334 aa, Fusobacterium periodonticum ATCC 33693
MSFLGQVRKKALQANRRIVLPETGDERVIRAASLILKESLAQVVLVGNQEAIMNSAKAYEVSLAGAKIVDPYNFERMDDYVNKLVELRSKKGMTPEEAKKILLNDPNFFGAMLIKMGDADGMVSGSASPTANVLRAAIQVIGTQPGVKTVSSVFIMELSQFKDLFGSILVFGDCSVIPFPTSEQLADIATSAAETAVRIAGINPRVALMTFSTKGSAKHECVDRVKEAGQILRERKVSFRFDDELQADAALVKSVGEIKAPLSDVSGNANVLIFPTLSAGNIGYKLVQRLAGAHAYGPIIQGLNAPVNDLSRGCSVEDIVVLTAITSAQACTEC

SEQ ID NO: 1150 - protein, 337 aa, Fusobacterium sp. 3_1_5R
MSFLGQVRKKALQANRRIVLPESFDERVLRAVAEILKEKVAQPILVGNPDQIMNDAKAYEISLQGARIVDPENFERFEVYVDKLVELRSKKGMTREEATKILKNDINFFGAMMVKMGDADGMVSGASSPTAKVLRAGIQVIGTKPGMKTVSSVFIMELSQFKEMYGSVLVFGDCSVIPHPNAEQLADIACSSAETALSIANINPRVALLTFSTKGSANHECVDKVIEAGRILRDRHVSFRFDDELQADAALVKSIGEIKAPLSDVSGNANVLIFPNLSAGNIGYKLVQRLAGANAYGPIIQGLDAPVNDLSRGCSVNDIVVLTAITSAQACTDCTFE

SEQ ID NO: 1151 - protein, 337 aa, Fusobacterium sp. D12
MSFLGQVRKKALQANRRIVLPESFDERILRAVAEILKEKVAQPVLIGNPDRIMNDAKAYEISLQGARIVDPENFERFEVYVDKLVELRAKKGMTREEASSILKNDINFFGAMMVKMGDADGMVSGASSPTAKVLKAAIQVIGTKPGMKTVSSVFIMELSRFQETYGSTLVFGDCSVIPHPNAEQMADIACSSAETALSIANINPRVALMSFSTKGSATHECVDKVIEAGRILRERKVSFRFDDELQADAALVKSVGEIKAPLSDVSGNANVLIFPNLSAGNIGYKLVQRLAGANAYGPIIQGLAAPVNDLSRGCSMNDVVVLTAITSAQACTDCTFE

SEQ ID NO: 1152 - protein, 335 aa, Fusobacterium varium ATCC 27725
MIVLSFLVKIREKARMVGKTVVLPEGEDERVVTAAAKIVELGVAKPVVLGIKADMERVANDLGISLKGVEIIEIANSPKLDEYATKFAELRAKKGMTFEKAKEIMSTDPNFYGAMMVKMKDADAMVSGSDSPTADVLRAGLQIIGTKPGIKTVSSMFVMELTERQETYGEVLLFGDCSVIPVPTSEQLADIAEASVITAKNVVGMEGKVALMTFSTKGSASHPDIDVVKEAGNILKERGVTFPFEAEIQADAAIVKSVAMKKCPESKVAGSANILVFPNLAAGNIGYKLVQRLAGANAYGPLIQGLASPINDLSRGCSVDDIVNLVAITAVQAAE

SEQ ID NO: 1153 - protein, 335 aa, Fusobacterium mortiferum ATCC 9817
MSVLSFLVKIREKAREVQKSVVLPEGTDERVITAAAKIVELGVARPIVLGHREDMERIANDLGISLRGVEVIEAKNPPKLETYAAKLAELRAKKGMTIEQAREILLNDPNFYGAMMVKMKDADAMVSGSDSPTADVLRAGLQIIGTRPGIKTVSSVFVMELTERQDTYGDVLLFGDCSVIPVPTAEQLADIAEASVVTAHNVVGMEGKVALMTFSTKGSAHHPDIDVVIEAGKILEERNVKFHYIAEVQADAAIVKSVAMKKCPESKVAGNANILIFPNLAAGNIGYKLVQRLAGANAYGPLIQGLAAPINDLSRGCSVDDIVNLVAITAVQAAE

SEQ ID NO: 1154 - protein, 331 aa, Arcobacter butzleri RM4018
MGLIETIKEKAKLKLRTIVLPEPEDERVLKATEQVLKDKTANVVLIGNADTIKADAAKHGANIDGATIIDPKKFDNINKYIDELVELRKNKNLSRDEATEIMLNEPRFFGCMMVRLGDADGLVAGSNSPTADVLKAAIQVIKTAPGINTVSSTFIMETADGKFGDNGLILFADCAVIPEPNAEQLADIACATAATAASVVGLNPRVAMLSFSTKGSAAHPLVDKVQSACKILGERNVNFSFDGELQADAAIVESIGAKKAPGSKVAGHANILVFPDLQSGNIGYKLVQRFAGAEAHGPIVQGLNKPVNDLSRGCSVEDIANLVAITATQIK

SEQ ID NO: 1155 - protein, 334 aa, Leptotrichia buccalis DSM 1135
MNTLTEKLKEKAKKLNKTIILPESEDERILKATEKIIAEGIAKIALVGNEKTLKEKAEKIGVSLEGAIFYNPNSCATIDAMSELLKKRREKKGMTFETAKAILMSDPRYFASMLVHQGRVDGMVAGSNSPTAHVLRAAIHVIGPRPGLKTVSSSFVMITNTPEFGDNGTFIFSDGGVIPDPTAMQLADIAISAAEKAKFTAGIKEPKVAFLSFSTKGSADGVSVSKVREAIEILKVRNVDFDFDGELQLDAAIIPEVAASKAPNSKVAGQANVLIFPDLDSGNIGYKLTQRLAKAKALGPLIQGLARPVHDLSRGCSVEDIVEVVAITAVESEM

SEQ ID NO: 1156 - protein, 334 aa, Leptotrichia hofstadii F0254
MNTLANELKEKAKKLNKTIILPETEDERVLRATEKIINEGIAKIALVGDEKKLKEKAAELGVSLEGAIFYNPDSCATIDAMSELLRKRREKKGMTLETAKATLMSDPRYFAAMLVHQGRVDGMVAGSDSPTAHVLRAAIHIIGPKEGLKTVSSSFIMITNTPEFGDNGTLVYSDGGVIPSPTAMQLADIAISAAEKARFTAGIKEPKVAFLSFSTKGSADGVSVSKVREAIEILKVRNVDFDFDGELQLDAAIVPEVAAAKAPGSKVAGQANVLIFPDLDSGNIGYKLTQRLAKAKALGPLIQGLARPVHDLSRGCSVEDIVEVVAITAVESEM

SEQ ID NO: 1157 - protein, 335 aa, Leptotrichia goodfellowii F0264
MADLVASLKEKAKKLGKTVILPETEDERVLRAAEKIIAEGIAKVALVGNEQKLKEEAAKLGVSIEGAIIYDPQNCATIDDMAELLRKRREKKGMTFETAKATLLSDPRFFGAMLISQGRVDGMVAGSNSPTAHVLRAAILVIGPKAGLKTVSSSFVMITKTPEYGDNGVFIYADGGVIPNPTALQLADIAVSSAEKARFTAGIKEPKVAFLSFSTKGSADGESVTKVREAIEILKERNVDFEFDGELQLDAAIVPEVAKSKAPGSKVAGHANVLIFPDLNSGNIGYKLTQRLAGAKALGPLIQGLASPVHDLSRGCSVDDIVEVVAITAVESDQK

SEQ ID NO: 1158 - protein, 341 aa, Streptobacillus moniliformis DSM 12112
MADLIQEIKEKEKEHKKTVVLPESEDERVLRAAEQITKEGFANIILVGKDYQVREHASKIGVDLSGVQIIDPMSFEKTPEFIRQFVHLRSKKGMKEEQAREIIQNDVRFFGAMLVRNCIADGMVAGSSSPTSNVLRAAIQVIGPKKGLKTISSSFIMQTKTKEFGVDGTLIFSDCGVLPNPTAQQIADIAISAVEKSRLITKFTDPKVALLTYSTKGSAEGEQVTKMREAYKILEERGVDFEFDGELQLDAAIIPSVAEQKAKDSNVAGKANILVFPDLCSGNIGYKLVQRFAKAKALGPLIQGLARPVHDLSRGCNVEDIVDVVAITCAECAVFCEILTL

SEQ ID NO: 1159 - protein, 332 aa, Veillonella parvula DSM 2008
MDLIQKLKDQVKPLGKKIVLPEYKDERVLKATEIILKEGFVTPVLVGSPAEIAEAAKAVGVSIEGAEIIDPANYDRYQEMVDTFVELRAKKGMTPEKADATMKGDCLFFGAMLVRLGAVDGMVAGSACPTANVLRAALQVVGTKPGLKTVSSSMFMFTSKKEYGDDGMLVFSDCGVLPNPTSEQLADIAESTVEKARKVVGMADPRVSMLSFSTKGSASTPEVDKVVEAVNILKERNVDFKFDGELQLDASIVPSVAEKKAPGSNVAGKANILIFPDLQAANIGYKLVQRFSGADALGPLIQGLAKPVHDLSRGCSAQDVVDVAAIAAVESI

SEQ ID NO: 1160 - protein, 337 aa, Acidaminococcus sp. D21
MPFIDHLKSRVKPIQKRIVLPENNSDRALKAAAIVAREGFAKIILVGDPEQLNRDAKRLGVSFEGIEIINPATYERMDELCAYFAKRREKKGMTVDKAREIMTKDTTFFGAGLVAMGDADGCVSGSTRTSADVIKAGLQVIGVRPGNKTVCSGFIVLSNTNLGEGGKLVFGDCGVILDPTAEQLADIATSCAIRARYTLGIKDVRVALLTYSTKGSGTGESVDKVQQAVEILKQRNVDFAFDGELQADAALVPEVGERKAPGSSVAGHANVLIFPNLAAANIGYKLVERFSGATCLGPLVQGLAKPILDLSRGCSVSDIVDVVAVCASDAILADSLK

SEQ ID NO: 1161 - protein, 335 aa, Treponema denticola ATCC 35405
MSFVDEMKRKAKMYANRLVLPEGTEERTLKAARSIVDEKLVSELFLIGSDDAVYAAASKAGVKLGGIKIIDPKKSEWLDSFAESYYEKRKAKGMTLEQAKIEMSAELGFAAMMLVQDKADAMVAGALNTTADVLRAGLKVIGTLPGMKTASSCFLMDTKNPKLGANGVFIFSDCAVIPTPSSEQLADIACSAAISCRTFAGVEPIVAMLSFSTKGSGGDKDENILRVREAVKILQERKPDFVFDGEIQLDCAIVPSVMQKKAADSPVKGQANTLIFPDLGAGNIGYKLVQRIAGAEALGPFLQGFAKPISDLSRGCSVDDIITTSAVTLVQAGRK

SEQ ID NO: 1162 - protein, 335 aa, Treponema vincentii ATCC 35580
MRFVQIMKDKAKEYHNRLVLPEATEARTLRAARILVDQQIPAELFLIGKKAEVEDACKKVGVATDGFTIIDPEHSEWTEGFATALYEKRKAKGMTPEEAKKEMHDPLRFGAMMLAQDKADAMVAGAENTTANVLRAGLTIVGVKKGVKTASSCFIVDTKSTEWGTNGVLIFSDSAVIPNPTAEQLADIATAAAESYRAFIGHEPVVALLSYSTKGSGGDKDESILKVREAVKLLDERKVNFCYDGELQLDAALIPEVTDRKAPGSPIRDKVNTLIFPDLNAGNIGYKLVQRFAKADAYGPFMQGFAKPLSDLSRGCSVEDIVVTAVVTLVQADKK

SEQ ID NO: 1163 - protein, 336 aa, Treponema pallidum subsp. pallidum str. Nichols
MTFVESMQRRAVLAQKRLVLPEACEQRTLEAARLIVFRNIAAKVFLVGCERDIKNTADRCGIDLTDMVVIDPSVSKHRDQFAERYFQKRKHKGISLAQAAEDMRDPLRFAAMMLDQGHADAMVAGAENTTARVLRAGLTIIGTLPSVKTASSCFVMDTNNPRLGGTRGLFIFSDCAVIPTPTAEQLADIACSAAESCRTFIGEEPTVALLSYSTKGSGGDSDENILRVREAVRILHERRVDFTFDGELQLDAALVPKITEKKAPHSPITGKVNTLVFPDLSSGNIGYKLVQRLSDADAYGPFLQGFAKPLSDLSRGCSVEDIVAACAVTLVQSNGR

SEQ ID NO: 1164 - protein, 335 aa, Brachyspira murdochii DSM 12563
MASFMDNLREKVKSNPKTIILAEGYDERHVKAAVILKKEQLVKGVILVGDTSKIEALAKENALELDGNFAKIFDPNKDAKTESYIEMLFKAREKKGMTKDQAKDLIINNSVYTGAAMLASNDADGMVGGAVYATGEMLRAALFLIGLKKGIKTLSSTFFIESPDKSLFTNGIACFADCAVIPDPTSEQLADIAESTAESYRVMTGLEPKVALLSFSTKGSAKHESVDKVIEAKKILDSRNVKFDYDGEMQFDAAIVEKVGAQKAPNSPIKGNANVLVFPELNAGNIGYKIAQRVGKCTAIGPMLQGIAKPANDLSRGCSAQDIADLAVLTSLQAM

SEQ ID NO: 1165 - protein, 335 aa, Brachyspira hyodysenteriae WA1
MASFMDNLKEKVKSNPKTIILAEGYDERHVKATVILKKEQLVKGIILVGDTAKIESLAKENDLKLDDGFARIFDPKKEAKSEEYIEMLFKAREKKGMTKDHARDLITNHSIYAAAAMIADNDADGMVGGAVYSTGEMLRAALFLIGLKPGIRTLSSTFFLESPDKSLFTNGISCFADCAVIPEPTPQQLADIAKATAESYRNMTGNEPKVALLSFSTKGSAEHESIERVREAKKILDSQEVDFVYDGEMQLDAAMIEKVAAQKAPGSPIKGDANVFIFPELNSGNIGHKIAQRVGKCTAIGPMLQGIAKPANDLSRGCSAQDIADLAVITSLQAK

SEQ ID NO: 1166 - protein, 334 aa, Candidatus Cloacamonas acidaminovorans
MFIIDDLINKAKGNSGSIVLPESTDPRVLTAVAKIVAMDLAKVTLLGESEIINQEAKALNIELNNVTIINPETSEDIPAFAEAYYQRRKEKGVTMAQAIETVKNPLYFGASMVKEGKVEGMVAGAVNITADVLRAALQVIGVMPGLKTVSSAFIMPVPDFRGEKRIFLFADCAVVPNPSSEQLADIAMSSALTRKAIIGDEPKVALLSFSTLGSAKHELVDKVTMAKEILTERKVDFDFDGELQVDAAIIPEVAKRKAPQSSVAGNANILIFPDLQAGNIGYKLAQYIGKVEAIGPIIQGLAAPVSDLSRGCSAEDIVNTVAIVLLLADQQKKK

SEQ ID NO: 1167 - protein, 353 aa, Perkinsus marinus ATCC 50983
MLSRSTARCAPAALAGIRQRAMQTGLEKFIAFPEVTDERVIPAVAKVLKEKIAQPVLVGDREAAYKCAKANNVSLEGVRIIDPSLHPEVVEQTATVLFQKRQKKGMTLDAALDTVKNSPLMMADLMLTTGHVQGCVAGASHTSADVARAALQTVGVKKGLKTASSFFIIAKDDKTFLFSDCGFCIAPSISQLAEIAITTAQTCEDVLATTPRVAMLSFSTFGSAKHEYVTRVEEALALARKEKPDLAIDGEMQVDAAIVPEVAAKKAPGSKVAGHANVLIFPDLNAGNIAYKVAERFGGYQAVGPIFQGLAYPTNDLSRGCHAEDVVDAAAVTVLQGSSIPIPTGPAPGDILN

SEQ ID NO: 1168 - protein, 348 aa, Borrelia turicatae 91E135
MGSFNFKNYVCDRAKKIVREKGDKASIVFPESTDVRILEATIDLLKKKLAGLVVLIGRRDEVFRRLKEQSGSRDDILEMVKVVDPSSFKDFNRYLDEYFSLQHNRKLTLKQAREELLDEIAFSMMMVRLGEVKTCVCGALVSSAKVLRSVFKILPKLKETNFISSFMIMDTGNDLGRAETCFGYEGILMFADCAVIINPNALQLAEIAIQSANSFKNIFNAEPKIALLSFSTKGSANSIEVDKVKGALELVKSKCSDLLIDGELQIDAALVKGVAEKKCGDSLVAGAANVLIFPSLESGNIGYKLVERLAFANAYGPFLQGLKNPVSDLSRGCSLDDIVLTSALMIGS

SEQ ID NO: 1169 - protein, 352 aa, Borrelia hermsii DAH
MESIMGSFNFKDYVCGRAKRIVMEKGDRASIVFPESMDDRILKATIYILKEKLAGLVVLIGCKDKVFRRLKEFVGFSGDILEMIRVIEPNSFKDFNRYLDEYLSLRYSKTLTLSKAREELLDEIVFSMMMVRLGEVKTCVCGALASSAKVLRSVFGILPKLKETKCISSFMIMDTGNDFGRFETCFGYEGILMFADCAVIINPDSMQLAEIAIQSANSFKNIFSAEPKVALLSFSTKGSAHSVEVEKVRCALDIVKKKCINLLIDGELQIDAALVKSVAEKKCSDSLVAGAANVLIFPNLEAGNIGYKLVERLAFAKAYGPFLQGLKNPVSDLSRGCSVDDIVLTSALMIGS

SEQ ID NO: 1170 - protein, 356 aa, Borrelia duttonii Ly
MLEGLVEYMGFFNFKDYVYARARKNVIDHGDKASIVFPESTDIRILKATINILREGLAGFVVLIGVRDTILGKLRELMGFGDDILDMIKIINPSSFKDFNRYLDEYLSLCHDKKLDVSKAKEELLDDIVFSMMMVRLGDVKTCVCGALASSAKVLKSVFKILPRLRETKFVSSFMIMDTRNVFAQSETCFGYEGILMFADCAVIINPDSIQLAEIAMHSANSFRNIFDQEPKVALLSFSTKGSADSLEVRKVRDALDIVRSKCSDLLIDGELQVDAALVKSIAEKKCSDSLVAGISNILIFPNLESGNIGYKLVERLAFARAYGPFLQGLKNPVSDLSRGCSVNDIVLTSALMICS

SEQ ID NO: 1171 - protein, 345 aa, Borrelia spielmanii A14S
MFCLKDYVFKKAEIFTKENKLKGSIVFPESSDSRVLRAAVIVLQKNLANSIILIGKKDPVMNSLKEFSSCNNILERIEVVDPNSFPDIEMYLDEYWSLLKSKGATKQSLKTQVLDEITFAMLMVRLGYVKSCVCGAISTSAKVLSNALRIIPKLDGVKIISSFMIMDTLNVARNVDFCFGHDGILFFADCSVVVNPNSLELAEIALQSAKSFKDILNAKPKVALLSFSTKGSSNARETEKVKNALNIVKNKEGDLLIDGELQLDSAIIKSVAEKKCRESLVAGSANVLIFPNLDAGNIGYKLVERFAFAKAYGPFLQGFAKPVSDLSRGCSVDEIVFASALMISS

SEQ ID NO: 1172 - protein, 345 aa, Borrelia afzelii ACA-1
MFCLKDYVFKKARIFSKENKLKASIVFPESSDSRVLKAAVVVLQKNLANSIILIGKKDPVINSLKEFSSCNNILERIEIVDPSSFPDIGMYLDEYWSLLKSKGATKQSLKTQVLDEITFAMLMVRFGYVKSCVCGAISTSAKVLSNALRIIPKLDGVKIISSFMIMDTLNVARNVDFCFGHNGILFFADCSVVVNPNYLELAEIALQSAKSFQDILNAKPKVALLSFSTKGSSNARETEKIKDALNIVKNKKADLLIDGELQLDSAIIKNVAEKKCRESLVAGSANVLIFPNLDAGNIGYKLVERFAFAKAYGPFLQGFSKPISDLSRGCSVDEIVFASALMISS

SEQ ID NO: 1173 - protein, 345 aa, Borrelia garinii Far04
MFCLKDYVFNKARIFVKENKFKASVVFPESSDSRVLKAAVIVLQKNLANSVILIGKKDPVVNSLKEFSNCNNILEKIEVIDPHSFPDIEMYLDEYWSLLKPKGATKQSLKTQVLDEITFAMLMVRFGHVKSCVCGAISTSAKVLSNALRIIPKLDGVKTVSSFMIMDTLNIARNLDFCFGHNGILFFADCSLVVNPNSLELAEIALQSAKSFKDILNAKPKVALLSFSTKGSSNARETEKVKNALNIVKNKESDLLVDGELQLDSAIIKDVAEKKCSESLVAGSANVLIFPNLDAGNIGYKLVERFAFAKAYGPFLQGLSKPISDLSRGCSVDEIVFASALMMGS

SEQ ID NO: 1174 - protein, 345 aa, Borrelia valaisiana VS116
MFCLKDYIFKRAKIFVKENKFNASVVYPESSDSRVLKAAVIVLQKNLASSIILIGKKDPVINSLKEFSNCNSILERIEVVDPNSFPDIEMYLDEYWSLLKLKGVTRKSLKTQVLDEITFAMLMVRLGYVKSCVCGAISTSAKVLSNALRIIPKSNGVKIISSFMIMDTLNIARNVDFCFGHNGILFFADCSVVVNPNSLELAEIALQSAKSFKDILNVNPKVALLSFSTKGSSNARETEKVKSALNIVKNKESDLLVDGELQLDSAIIKNVAEKKCRESLVAGSANVLIFPNLDAGNIGYKLVERFAFAKAYGPFLQGFSKPISDLSRGCSVDEIVFASALMISS

SEQ ID NO: 1175 - protein, 352 aa, Borrelia burgdorferi B31
MLYSFYKVFCLKDYVFKKARIFVKENKLKANIVFPESSDSRVLKAAIVILQKNLADSIILIGKKDTVINSLKEFSNCNDILGRIEVVDPNSFPDIEMYLDEYWSLQKLKGVTKQSLKTQVLDEITFAMLMVRFGYAKSCVCGAVSTSAKVLSNALRIIPKLEGVKIISSFMIMDTLCTARNVDFCFGHNGILFFADCSVVVNPNSLELAEIALQSAKSFKDILNAKPKVALLSFSTKGSSSAKETEKVKNALNIVRNKESDLLIDGELQLDSAIIKDVAEKKCRESLVAGSANVLIFPNLDAGNIGYKLVERFAFAKAYGPFLQGFSKPISDLSRGCSVDEIVFASALMISI

SEQ ID NO: 1176 - protein, 333 aa, uncultured Termite group 1 bacterium phylotype Rs-D17
MNIRERILELAKKTKSKIILPESFDIRILKAAQILTKDGIASVILLAEDIKEVEKIASAVGVDLNAVEIIKIDINLLNKKKVEEFVDARMKKGMTLQDASDLLKKPLYFSMMYLKSGKCDACVAGAVYDTSDVLRASIQVAGFTECTKLVSSYFLMIPPDGHNIAKEPVLFADCGVNPDPQVLGLKDIAVATVENFKKLFPGRQVNVAMLSFSTKGSANSKVLSKVIEATELVKSHFAGYSDINVDGEFQFDAAVVQSVGKKKASGSSVAGNANILIFPDLNAGNIGYKIAERYGGFQALGPIIQGLALPISDLSRGSSVDDICLICAIMLLK

SEQ ID NO: 1177 - protein, 322 aa, Mycoplasma mycoides subsp. mycoides SC str. PG1
MYTLEEIKNQLVLKSEKKSIVFPEGESEIIQSVAKTLVDEKLGLPILLFKSSKEVPSEIKNNSSIKTICLDEFDTKEFSEEFVKLRKGKATIEVAHQVMQLPNYVGAMLVKLNQADCMLSGLNNTTADTIRPALQIIGTKPGYNIASSIFIMSKGDENYIFTDCALNIRPTSEQLVEITQMAVDFAKTLNVKNVEAALLSYSTKGSGKGEDVDRVHKAVEILKSSQNDYVCEGEIQFDAAFDKKTRDKKFKNCLLTKQTPDIFVFPDINAGNIGYKIAQRMGGFEAIGPFVLGLNQPINDLSRGATFIDVLNTAIMTLHLSY

SEQ ID NO: 1178 - protein, 322 aa, Mycoplasma capricolum subsp. capricolum ATCC 27343
MYTLEEIKNQLGLKSEKKSIVFPEAESEIIQSVAKTLVDEKLGLPILLFKSSKEVPSEIKNNSSIKTICLDEFDTKEFEEEFVKLRKGKATIEVAHQVMQLPNYIGAMLVKLNQADCMLSGLNNTTADTIRPALQIIGTKPGYNIASSIFVMSKGNENYIFTDCALNIKPTSEQLVEITQMAVDFAKALNVKNVEAALLSYSTNGSGKGEDVDRVHQAVEILKSKEKDYVCEGEIQFDAAFDKKTRDKKFKNCSLLKQTPDIFVFPDINAGNIGYKIAQRMGGFEAIGPFVLGLNQPVNDLSRGATFVDVLNTAIMTLYLSY

SEQ ID NO: 1179 - protein, 322 aa, Mesoplasma florum L1
MYSVEQIKKILVDSDHKKTIVLPEGEEPKIQEVANTLVKENISKVIMLFQKSESIPSSLDSKIEVIAIDKLDKQPLIEKFMDLRKDKTNLEQATKLMGQANYIGAMLVKMEKADCMLCGITYTTADTIRPALQIIKTSPNVALAASVFIMNKGEENYFFTDCALNLKPTSQQLADISKMTAKFAQSFDVKNPEVALLSYSTAGSGAGEDVVRVKEAVELLDSQTVDFNYAGEIQFDAAWDKEIRDKKFKDCKLTKQTPDVFVFPDINAGNIGYKIAQRMGGYEAIGPFILGFNKPVNDLSRGATLTDIMNTAIITIYQALEA

SEQ ID NO: 1180 - protein, 325 aa, Spiroplasma citri
MNILENIIEKINTFSQKIKIIFPEGNYERIQTVAKQLIGTNITPILVFATRAEVPSTIDELQSEVLVAEEQNEIELAEYLVELRKGKVSLSEAKQLVRECNYLAILWVKKGLADGMVGGITYDTKDIIGPALRIIKTKPNVKLVSSFFLMVRNTERYIFTDCALNIDPTAEELADIAYLGYEASQVFAFQNPNMALLSFSTKGSGRGASVDKVRTAYDLVRAKNLKNCYVDGEFQFDAAWDDTIRNKKAPSSPLKAPVDIFVFPNLDAGNIGYKIAQRLGGFEAIGPILIGLDRPVNDLSRGATINDIYNTVLVTAYLCIHKSND

SEQ ID NO: 1181 - protein, 320 aa, Mycoplasma genitalium G37
MSVIDIFKKRLQAVSKKPVIIFPEGWSASVLKAVEMLNESKLIQPAVIFHNRQEIPANFDKKITHYVIDEMDLTSYANFVYEKRKHKGMDLKEAQKFVRDPSSLAATLVALKVVDGEVCGKEYATKDTLRPALQLLATGNFVSSVFIMEKGEERLYFTDCAFAVYPNSQELATIAENTFNFAKSLNEDEIKMAFLSYSTLGSGKGEMVDKVVLATKLFLEKHPELHQSVCGELQFDAAFVEKVRLQKAPQLTWKNSANIYVFPNLDAGNIAYKIAQRLGGYDAIGPIVLGLSSPVNDLSRGASVSDIFNVGIITAAQAIK

SEQ ID NO: 1182 - protein, 320 aa, Mycoplasma pneumoniae M129
MSVIDLLKQRVQSAGKKPVIIFPEGWSPTVMEAVNQLQQAGILTPPVIFRTRSEVPAGFNTAIKHYVIEEMDLTKYANFVYEKRKHKGMEMREAQKFVRDASSLAATLVALNEVDGEVCGKEYATKDTLRPALQLLGTGNFVSSVFIMEKNEERLYFTDCAFAVYPSPQELAVVAENTFKFAQSMGEPELKMVFLSYSTLGSGKGEAVDKVVSATQIFLEKHPELKANVCGELQFDSAFVEKVRKQKAPNLTWNGSANIYVFPNLDAGNIGYKIAQRLGGYEAIGPIVLGLARPFNDLSRGASVSDVFNVGIITAAQTLK

SEQ ID NO: 1183 - protein, 330 aa, Mycoplasma gallisepticum R
MNGENMSTLIEELKNKIKNSKKVPQILLVEGWNACVQEAAKQLVAEKLVKPVLMFRTMDEIPADFDPRIKRYVIEKMDLSKYATYLFKLREKKGMTLEVAQQEVQKPNVLASLLVKLDEVDGEVCGKEYTTKETLKPALQIIKTSETAKIVSSVMVLEKNQERLVFADCAINVYPTAEELAEIAKSTIKFAKDVLQIEKINLAMLSYSTLNSGVGESVDKVKAATKLVEESDVGKLASICGPMQFDAAYVEEVRKQKAPKLDWEKGANVFIFPNIDAGNIGYKIAQRLGGYDAIGPVLTGLAKPVNDLSRGANAHEIYSVAIITACQAVA

SEQ ID NO: 1184 - protein, 324 aa, Mycoplasma penetrans HF-2
MKIIQNIKKDVSSLGYKPTIVYAEGWNKTIQEAATQVKNENLVDVVVIFRTQEELNGFNNTANVKTIVIENSDLSQYANLLFDLRKEKGLSYEDAVKLSKEPNYLACLMVKSNENWGAICGIEYTTKDTLRAALQVIKAKKGSIVNSIMILEREDKSIFASDIGLVINPSAEELSKIVYNCVDFIVNTLKIVNNNVAMLSYSTNGSGAGESVDKVKQAFELYKTLPQNPHANVYGEIQFDAAVDSKIRSKKSPDCTWSGDANVFVFPNLDAGNISYKILQRYAGFEPTGPIIIGLDKPVNDLSRGAGLFEVVSLSYVTALQTKN

SEQ ID NO: 1185 - protein, 317 aa, Mycoplasma hyopneumoniae 232
MTYQEYLQARLEQQNETKSLRSVLIIDGADPRAIAAAKLLKEKNLVKPVLLVDEEIPNLDVDQHIVNFQEKMEFIKEFLKFRKGKETPESAEIQFQSNAFYGTMLLRKKKVDAVVGGLNYPTAEILRAAFKIIGPKPNIKTISSVMIMHKDQEKYLFSDISVNIAPNENQLVDIAKNALDFAIQLGFDPKPAFLSFSTKGSAKSPQSELVAKATQMFNATSPIEAYGEIQLDAALDIEVRRQKYEVNVGKNANILIFPNLDAGNIGYKIAQRLGNFGAIGPIITGINAPINDLSRGSTTQDVFNTVLISALQVEEGK

SEQ ID NO: 1186 - protein, 323 aa, Mycoplasma conjunctivae
MKGKNMNYQKELEKSVIDNQKDSGLKTILIIDGEDKRAIKAAELLSKNKLVEPILLTKNKIENTSVKQHIFNETEYQEFVEKFVELRKGKETLEAAQKQMSSLPFYGTMLLKLNKVDGVIGGLNYPTADILRAAFKIIGPTPGIKTISSVMIVHKEEQKFLFSDISVNIAPTVEQLVDIAKNANDFALQLGFDPQLAFLSFSTSRSAVAPQSELVEKASQIYNESATKKALGEIQFDAALDEAVRSQKYKGELPKSNANVLIFPNLDAGNIGYKIAQRLGGYGAIGPIITGIASPINDLSRGATVEDIYNTALITALQAKGDK

SEQ ID NO: 1187 - protein, 318 aa, Mycoplasma agalactiae PG2
MDFEKRLKGIVNTLPKTKILLIDGSDNRSIEAANKLAEFSNLEITLLVENDEKIETKANVVNMNKDANKLELLAQKYVELRKGKEDIEAARKALSTRPFYAMMLLATGEIDGVVGGLNYSTADILRAAFKAIGPKPGIKTISSVMIMHKEEKLYFFSDISVNPKPDLNGLVDIASNAAEFAKTFIDEPKVAFLSFSTSWSAVTPETKLVADATVEFNKVYQGTKAIGEVQLDAAVNEGVRKSKYKGETFAGEANVLVFPDLGAGNIGYKIAQRFGGFGAVGPIITGVKKPVNDLSRGSLTDDVVNTVLITAIQANNKE

SEQ ID NO: 1188 - protein, 317 aa, Mycoplasma fermentans PG18
MKFTSLIEKRIKAMKTKKRIAFIDGDDSRALDTIKQLEQFPNVELTLLVETDVKSKTNVKFININKDKQKQNDLAQKYFELRKGKETIEQAQRNLKTRPFYAMMLLATGEVDGVVGGLNYATADILRAAFKAIGAREGVKTISSVMVVHNEKNTYFFSDISVNVKPDQKALVEIGLNAAQFAQSMGIEPKIAFLSFSTNYSAKTPESELVHNAVEEFNTIYQGTKAIGEIQLDAALDLEVRKAKYKLDYYKEPANTLIFPDLDAGNIGYKLAQRLGNYGAIGPIVVGTKKPVNDLSRGSSVKDVINTILITALQAEK

SEQ ID NO: 1189 - protein, 319 aa, Mycoplasma synoviae 53
MNYELNLKSQVDALKSVKKIVLIDGDDQRALDAVRELKAQKNIEVLLLTEKQENSSEFEFVNIFADEAKTKKYVEQYLELRKNKETLEQAEKAMASRPFHAMMMLHNNEVDGVVGGLKFTTADILRAAFKVIGPKPGIKTISSIMVMHKEEQQMVFSDISVNVSPNAQQLSEIATNAAEAAELLGFPNPKVAFLSFSTSGSAVTEESKLVKEATDLFNASYAKTKAIGEVQLDAAIDLSVRKSKYKQDSYDEKANLLVFPNLSAGNIGYKLVQRYGNFGAIGPIIVGTKKPVNDLSRGSSVNDVVNTVLITALQSEGSK

SEQ ID NO: 1190 - protein, 318 aa, Mycoplasma pulmonis UAB CTIP
MNFNDYIISRVKKLKEKKRILLVDGNDPRSLEAAKELQKYPNIEVSLLVESKSDVKDGFNFVVLDQDQKQYESFCQDLFESRKGKDSLESVQKALKTRPFYAMMLLKKGFFDGVVGGLLYTTADILKAAFKVVGPKAGVKTISSLMIMSKGEDTKIFADISINVNPSADQLVDIAKNSVEFLEQMGIEAFPSFLSFSTQGSAVSDETKKVVEAKEKFNALALKAKALGEIQFDAAVDLKTRSSKYKNPEFSQESNLLIFPDLEAGNIGYKIAQRMGKYGAFGPIVTGTKLPINDLSRGASVEDVANTVLITALQSEGK

SEQ ID NO: 1191 - protein, 322 aa, Mycoplasma mobile 163K
MLFTEKIKTSVKNLAKKYKVLLVDGDDSRAQEAARMLQDSDLVEVSLLVENPTNAKGLKFINMNDNKNLKTEFITKILEFRKGKETEESAKSAVETRPFYAAMLLKENYFDAVVGGLLYKTSDILRAAFKIIGSKKGQKTISSSMIMHKNDEAFLFSDISVQIKPDATQLAEIGLNASEFAKALGLKDTVAFLSFSTAKSAVSPESETVSQATEIYNSKTSGIKAIGEIQLDAAIDLKVREAKFGKSSFESKPDVFVFPDLGAGNIGYKLVQRFGNYGAIGPIVNGISKPMNDLSRGSTSEDVFYTVLISVLQAAHNEKESK

SEQ ID NO: 1192 - protein, 324 aa, Mycoplasma agalactiae PG2
MHSTSKFSGYINSLLREKSQKQILSVLFIDGDDKRAREAALYFKNNNLAKPIMLLENESQVVDDGLENIILSKESESITAYAQELVKLRAGKEDYETCFKNMQTRPYYGAMMIKLKAVDSAVGGLIYSTADILRAAFKCIGAKPGIKTISSVIVMHKDDEQLIFTDPSTVQKPNAEQLVDIAANAINFANMMNMNSLGAFLTYSTNNSGKGENPDLVREAVKIATSKSLNVINGEMQFDSAYDLNVRKSKFPSAPQKEAGVFIFPNLESCNIGCKIAQRMGNYGAVGAILQGINGAINDFSRGATVADVIDVTSITILNGYTFK

SEQ ID NO: 1193 - protein, 328 aa, Buchnera aphidicola str. Cc (Cinara cedri)
MKKYSENFKLFLQEKARSCVKTIIFPEGNNLKIIKSALICSKLKISKCILLGIYKDIQELMKKNNLSLNEDIEIINPNKIRHNYSYDLFQLRKNKDIDSELTALNLLKNNIILSLMMLHNGDVDGVIAGITCPTAAVIRPTFQIIQNNSINSFVSSVFFMLFSNKILVYGDCAINRYPNSKMLAEIAIQSANTAKSIGILPKIAMLSYSTGNSGFGKSVNRINNAIKIVKKKQPNFLIDGPLQYDAAVSKKVAKIKLSNSVVSGRANVLIFPDLNAGNITYKAVQRSSNVISIGPILQGLNKPVNDLSRGASIDDIVYTTAMTVIQSL

SEQ ID NO: 1194 - protein, 332 aa, Clostridium botulinum B str. Eklund 17B
MQLMEKMWLRAKSDKKNIVLPEGIEERNIAAARKIVDNGLANPILIGDREKVLKKADEINVNLENIQIIDPNDSDKLEIYIKNFYELRKNKGMTMAKAEKIVRDPLYFATMMVKLDDADGMVSGAIHTTGDLLRPGLQIIKTMPGVSIVSSFFIMNVPGKEFGTDGTLIFADCAVNPNPNEDELAAIAIATAETAKKLCKMEPRVAMLSFSTMGSADNELVDKVRNATAKANALRPDLMIDGELQLDAAIIEKVAAQKAPNSKVAGKANVLVFPDLQSGNIGYKLVQRFANADAIGPVCQGFAKPINDLSRGCSADDIVNVVALTAVQAQEV

SEQ ID NO: 1195 - protein, 333 aa, Clostridium beijerinckii NCIMB 8052
MDLMKKIWTAAQSNKQKIVLPEGNEERNIAAAEKIQKLGLAYPILIGNKEEINNKAKELDVNLSGIEIIDPNESDKLEKYIEAFYELRKTKGVTMEKADKIVRDPLYFGTMMVKLDDADGMVSGAIHTTGDLLRPGLQIIKTAPGVSVVSSFFIMQVPGSSYGEEGTLIFSDCAVNPNPNEDQLAAIAIATAETAKNLCNMEPKVAMLSFSTMGSADNELVDKVRNATQKAKEMRPDLDIDGELQLDAAIVGKVAAQKAPESTVAGKANVLVFPDLQAGNIGYKLVQRFANAEAIGPICQGFAKPINDLSRGCSSDDIVSVVALTAVQAQTNK

SEQ ID NO: 1196 - protein, 333 aa, Clostridium sp. 7_2_43FAA
MELMNKLWDAAKADKRRIVLPEGDEDRTLVAAQRIQELGLAYPVLVGDNSRINEKAKELGVNLEGIEIVDPNNSERLQTYINEFYELRKNKGMTLEKAEKIVKDPLYFGTMMVKLDDADGMVSGAVHTTGDLLRPGLQIIKTAPGVSVVSSFFIMMVPGSTYGEEGMLLFSDCAVNPNPNYEQLAAIAIATADTAKNLCKIEPRVAMLSFSTMGSADHEMVDKVRKATELAKELRPDLLIDGELQLDAAIVGKVAAQKAPNSNVAGKANVLIFPDLQSGNIGYKLVQRFANAEAIGPMCQGFAKPINDLSRGCSSDDIVNVVALTAVQAQAQK

SEQ ID NO: 1197 - protein, 333 aa, Clostridium butyricum 5521
MELMKKIWEAAKSNKKKIVLPEGNEERTIAAAQKIYDLGLAHPILVGDTNEILAKAKELDVDLSHVEIINPNEAENLQKYINAFYELRKAKGVTMEKAEKIVRDPLYFATMMVKLDDADGMVSGAVHTTGDLLRPGLQIIKTAPGVSCVSSFFIMEVPNSPYGDNGLLFFADCAVNPMPNEDMLASIAIATADNARLLSKIDPKVAMLSFSTMGSADHEVVDKVRNATIKAKELRPDLDIDGELQLDAAIVPKVAKQKAPESKVAGNANILVFPDLQAGNIGYKLVQRFANAEAIGPVCQGFAKPINDLSRGCSSEDIVNVVALTAVQAQGIK

SEQ ID NO: 1198 - protein, 335 aa, Clostridium perfringens str. 13
MNMELMKQIWESAKNNRKKIVLPEGDEERTLVASQRIKEEGLADVYLVGSEQVIREKAEALGVNLEGVNIVDPETSDKLDTYINEFYELRKAKGMTVEKAGKIVRDPLYFGTMMVKMGDADGMVSGAVHTTGDLLRPGLQIIKTAPGVSVVSSFFIMMVPGSQYGEGGMLLFSDCAVNPNPNADQLAAIAIATADTAKNLCKMDPKVAMLSFSTMGSADHDLVTKVRVATEKAKELRPDLDIDGELQLDAAIVGKVASQKAPNSKVAGNANVLVFPDLQAGNIGYKLVQRFANAEAIGPVCQGFAKPINDLSRGCSSEDIVNVVAITAVQAQATK

SEQ ID NO: 1199 - protein, 334 aa, Clostridium carboxidivorans P7
MKLMDEIWKKAKANKKTIVLPEGEEERTLKASAKIAEEGLANLVLVGNEKVIKEKAASLGVSLEGVKVVDPETSENTAKYANGFYELRKKKGMTPEKADKIVRDPLYYGTMMVKLGDGDGMVSGAIHTTGDLLRPGLQIIKTAPGVSVVSSTFIMNIPNCEYGKDGMLLFADCAVNPCPTAEELASIAVSTAETAKNLCGMDPKVAMLSFSTMGSASHELVDKVTKATELAKSMRPDLDIDGELQLDAAIVQKVADLKAPNSKIAGKANVLVFPDIQAGNIGYKLVQRFAKAEAVGPVCQGFAKPINDLSRGCSAEDIVNVVAITAVQAQAQEN

SEQ ID NO: 1200 - protein, 333 aa, Clostridium kluyveri DSM 555
MKLMENIFGLAKADKKKIVLAEGEEERNIRASEEIIRDGIADIILVGSESVIKENAAKFGVNLAGVEIVDPETSSKTAGYANAFYEIRKNKGVTLEKADKIVRDPIYFATMMVKLGDADGLVSGAIHTTGDLLRPGLQIVKTVPGASVVSSVFLMSVPDCEYGEDGFLLFADCAVNVCPTAEELSSIAITTAETAKNLCKIEPRVAMLSFSTMGSASHELVDKVTKATKLAKEARPDLDIDGELQLDASLVKKVADLKAPGSKVAGKANVLIFPDIQAGNIGYKLVQRFAKAEAIGPICQGFAKPINDLSRGCSVDDIVKVVAVTAVQAQAQG

SEQ ID NO: 1201 - protein, 332 aa, Clostridium sporogenes ATCC 15579
MDLMKSLWEKAKSDKKKIVLAEGEEERNIEGCSKILKNELAHMILIGNEEKINETAKKLNVSIDGAEIIDPQTSEKVSTYTKEFYELRKHKGVTMEKAEQIVKDPIYFATMMVKMKDADGLVSGAIHTTGDLLRPGLQIVKTAKGASVVSSTFIMEVPNCEYGKNGMLLFADCAVNPNPTADELASIAISTAETAKALCDMEPKVAMLSFSSKGSAKHDLVDKVAEATKIAKEKRPDLDIDGELQLDAAIVQKVADLKAPNSTVAGKANVLVFPDLQAGNIGYKLVQRFANASAIGPICQGFAKPINDLSRGCSSDDIVNVVAVTAVQAQNM

SEQ ID NO: 1202 - protein, 339 aa, Clostridium tetani E88
MKGDNTYMKLMEEIWAKAKANKKKIVLPEGEEERNIEACSKIIENAIADVVLVGNPERIKEIANKLGVNVDGAEIVDPETSDKTADYAKALYELRKHKGVTIEKAEKIIRDPLYFGTMMVQKNDVDGMVSGAIHTTGDLLRPGLQIVKTAPGTSVVSSSFIMMVPGSKFGNEGLLLFADCAVNPNPTAEDLASIAISTAETAKNLCGLDPKVALLSFSTQGSASHDLVDKVVTATKLAKEKRPDLAIDGELQLDAAIVKSVADLKAPNSEVAGKANVLVFPDLQAGNIGYKLVQRFANAEAIGPITQGFAKPINDLSRGCTSDDIVNVVAVTAVQAQNQ

SEQ ID NO: 1203 - protein, 331 aa, Clostridium botulinum D str. 1873
MGFMDEMKELAKKDLKTIVLPEGEEERNLIAAGKINDNSLANLVLIGNEEKIKAKAKELNSNIEGLKIVDPETYEKTEEYAKELYEIRKNKGMTLEKASVIIKDPLYFSTVMLKLGHVDGMVSGAIHTTGDLLRPGLQIVKTKPGIRAVSGVVMLEVPNCEYGKNGLVLVADAAVNPNPNAEELASIAIATAETAKNLCGMDPKVAMLSFSTKGSAEHELVDKVRKATEIAKEQRPDLDIDGELQLDAAIVESVANLKAPGSNVAGKANVLVLPDLQCGNIAYKLIQRFAKAEATGPICQGFAKPINDLSRGCSADDIVNVVVITAIQAQN

SEQ ID NO: 1204 - protein, 332 aa, Clostridium novyi NT
MGFMDEMKQLAKKDLKTIVLPEGEEERNLIAAGKINDSALANLVLIGNEEKIRAKAKELNSNIEGLKIVDPETYEKTAEYAKELYEIRKKKGMTEEKAAVIIKDPLYFATVMLKLGHVDGMVSGAIHTTGDLLRPGLQIVKTKPGIKAVSGVVMLEVPNCEYGKNGLVLVADAAVNPNPNAEELASIAIATAETARDLCGMDPKVAMLSFSTKGSAEHELVDKVRRATEIAQEQRPDLDIDGELQLDAALVQSVADLKAPGSKVAGKANVLVLPDLQSGNIAYKLIQRFAKAEATGPICQGFAKPINDLSRGCSADDIVNVVTITAIQAQNN

SEQ ID NO: 1205 - protein, 332 aa, Clostridium cellulovorans 743B
MEFMQKIWKQARSSKRRIVLAEGEERRNLIAAGKIIENNLADIILVGDTNAIKENAEALGVDIREATIADQHTYPHKEEMIKELYEIRKSKGMTLEKAAELVLDPLYFGTMMVKMGYGDGMVSGAIHTTGDLLRPGLQIIKTAPGVSAVSGFFVMVIPNCNYGENGTLIFADCAVNPKPTSEQLASIAITTAETAEKFDLDPKVAMLSFSTMGSASHEMVDNVRNAVDMAKSLRPDLAIDGELQLDAAIVPDVAELKAPNSPVAGKANVLIFPDLQTGNIGYKLVQRFARAEAIGPICQGFAKPINDLSRGCSPEDIVNVVAMTAVQAQKGI

SEQ ID NO: 1206 - protein, 333 aa, Clostridium acetobutylicum ATCC 824
MDLIESIWECAKQDKKRIILAEGEEKRNLIAADKIIKEGLAELVLVGDENKIKEKASELNLDISKAEIMDPETSLKTETYARDFYELRKHKGMTIEKSEKMVRDPLYFATMALKDGYVDGMVSGAVHTTGDLLRPGLQIIKTAPGVKIVSGFFVMIIPDCDYGEEGLLLFADCAVNPNPTSDELADIAITTAETARKLCNVEPKVAMLSFSTMGSAKGEMVDKVKNAVEITKKFRPDLAIDGELQLDAAIDSEVAALKAPSSNVAGNANVLVFPDLQTGNIGYKLVQRFAKAKAIGPICQGFAKPINDLSRGCSSEDIVNVVAITVVQAQRGI

SEQ ID NO: 1207 - protein, 328 aa, Thermoanaerobacterium saccharolyticum
MSIIQNIIEKAKSDKKKIVLPEGAEPRTLKAAEIVLKEGIADLVLLGNEDEIRNAAKDLDISKAEIIDPVKSEMFDRYANDFYELRKNKGITLEKARETIKDNIYFGCMMVKEGYADGLVSGAIHATADLLRPAFQIIKTAPGAKIVSSFFIMEVPNCEYGENGVFLFADCAVNPSPNAEELASIAVQSANTAKNLLGFEPKVAMLSFSTKGSASHELVDKVRKATEIAKELMPDVAIDGELQLDAALVKEVAELKAPGSKVAGCANVLIFPDLQAGNIGYKLVQRLAKANAIGPITQGMGAPVNDLSRGCSYRDIVDVIATTAVQAQ

SEQ ID NO: 1208 - protein, 328 aa, Thermoanaerobacterium thermosaccharolyticum DSM 571
MSIIQSIIEKAKSNKKKIVLPEGAEPRTLKAADIVLKEGIADLVLLGNADEIRNAAEGLDISKAEIIDPLKSEKFDKYATDFYELRKNKGITLEKAKETIKDNIYFGCMMVKEGYADGLVSGAIHATADLLRPAFQIVKTAPGAKIVSSFFIMEVPNCEFGENGVFLFADCAVNPSPNAEELASIAVQSANTAKTLLGMEPRVAMLSFSTKGSASHELVDKVRTATEIAKNLIPDVAIDGELQLDAALVKEVAELKAPGSPVAGRANVLIFPDLQAGNIGYKLVQRLAKANAIGPITQGMGAPVNDLSRGCSYKDIVDVIATTAVQAQ

SEQ ID NO: 1209 - protein, 331 aa, Thermoanaerobacter tengcongensis MB4
MSVMDNIIQKAKANKKKIVLPEGTEPRTLKAAEIVLKEGIADLVLLGKEEEIREKAKGLDISKAEIVDPEKSPNLERYAKEYYELRKNKGMTEEEAERLMRDPMYYGCMMVKLGDVDGMVSGAIHATADVFRPAFQIIKTAPNVKVVSSAFIMEVPECKYGSDGVFIFADCAINPNPTAEELAAIAIASAHTAKVLAGIEPKVAMLSFSTKGSASHELVDKVKRATEIAKELAPDLLIDGELQVDAAIVKEVGELKAPGSPVAGQANVLIFPDLQAGNIGYKLVQRLAKANAIGPISQGLAKPVNDLSRGCSVEDIVNVIAITSVQAQGIV

SEQ ID NO: 1210 - protein, 332 aa, Thermoanaerobacter sp. X514
MAVMDSIIQKAKANKKRIVLPEGSEARTLKAAEKVIKEGIADVVLLGKEEEIKEKAKGLDISKAEIIDPEKSPLLQKYAEEYYNLRKNKGVTEEQAYQIMKDPMYYGCMMVKLDDVDGMVSGAIHATADVFRPAFQIVKTAAGVKVVSSAFIMEVPNCTYGSDGVFIFADCAINPNPNEEELAAIAIASAHTAKVLAGIEPRIAMLSFSTKGSANHELVDKVKNATKIAKELAPDLLIDGELQLDAAIVKEVGELKAPGSPVAGNANVLIFPDLQAGNIGYKLVQRLAKANAIGPISQGLAKPINDLSRGCSVEDIVNVIAITCVQAQGVQK

SEQ ID NO: 1211 - protein, 332 aa, Halothermothrix orenii H 168
MGILKRFKEKAKQDTKTIVLPEGKEPRILKAAEKITEEGLAELIVLGNEDEVNEIVQQEGVNLRGVNIIDSAKSKLVNEFTDVFYELRKHKGISREDAAKTVKDPLYFGTLLVHTGHADGMVAGSINATGDVLRPAFQIIKTKPGISIVSGAFVMEVPECEYGNDGIFLFADCAVNPSPDSNQLAEIALSSARTARTLLGLDPRVAMLSFSTKGSARHELVDKVRRATEIAREKAPDLILDGELQADAALVPSVAKTKAPESNVAGQANVLVFPDLQAGNIGYKLVQRLAGAEAIGPILQGIAKPVNDLSRGCSVEDIVNLVAITSVQAQDN

SEQ ID NO: 1212 - protein, 334 aa, Desulfotomaculum acetoxidans DSM 771
MNLLDQIKARAKANPQTIVLPESEDERTIKAAEAIIKEGIAKVTLLGNVDTVKTSAASLGVSLDGIGIVDPATTDKMTEYAEKLAEIRKSKGMTADEAKALLLNPLYFGAMMVKLGEADGMVAGAINTTGDVLRPALQIIKTSPGISTVSSCFVMIMPTAEYGQEGVMIFADCAVNPNPNAEQMAEIAYASAQSAKSIANITEPKVGMLSFSTKGSAKHELVSKVQEATKIAKERYADLVVDGEFQADAAIVAKVGASKAPGSEVAGKCNVLVFPDLQAGNIGYKLVQRLAGAEAIGPVLQGIAKPVNDLSRGCSVEDIVNVTAITVCQAQATK

SEQ ID NO: 1213 - protein, 332 aa, Natranaerobius thermophilus JW/NM-WN-LF
MSELLTQIKNKASQQKKMIALPEATEPRMVKATQQILQEGFADITLIGDQDEIEKVANNEGVDLSGAEILNPKETDKNDDYAEKLFELRQHKGITMEDAQKIVEDPLYFAALMVKAGDADGYVGGAVNTTGDTFRPALQIIKTAPGISVVSSSFIMLVPDCEYGDNGVFVFSDCALNPNPDKNQMAEIAITTAETAKNLAGIDPKVGMLSFSTKGSADHELAQKVVEATKIAKDKEPDMMIDGELQLDAAIMPSVGEKKAPGSEVAGNANTLIFPDLQSGNIGYKLVQRLAGARAVGPVTQGFAMPVNDLSRGCSVQDIVDIAAITSVQAQG

SEQ ID NO: 1214 - protein, 334 aa, Carboxydothermus hydrogenoformans Z-2901
MLNFIEKVKSKAREFKRTIVLPESKDDRVIKASSEIINQQLAKIILLGNEKEIAERAKNLNVDLNGVTIIDPLKDNNRDRYANLLYELRKNKGMTLEKAYELINDPLYYATLMVKAEDADGLVAGSLSPTPNVLRPALQIIKTKPEFSVVSGAFIMVIPNPQFGEHGIMLFADCAVNPDPNSQQLAEIAIASAMTAQKLLGITPYVGLLSFSTKGSAEHELVEKVREAARIANRLRPDLKIEGELQVDAAIVPAVGAQKAPGSEVAGRANVLIFPDLQSGNIGYKLAQRMSGGEAIGPILQGMAKPVNDLSRGCSVDEIVNLVAITAVQSYYGI

SEQ ID NO: 1215 - protein, 337 aa, Bacteroides sp. 2_1_33B
MDLMQDIIARAKADKQRIVLPEGTEERTLKAADRLLADGVADIILIGNPAEIKELAAGFGLNHIGEATLVDPKNHEKKAAYADLLFQLRQKKGMTPEKAAVLVEDPLFLACLMIKAGDADGEIAGAENTTGNVLRPALQIIKTAPGMKCVSGAFLMFTKTPQYGDDGILVFADCAVMPNPNAEELASIAVATAATARNIVGVEPRVAMLSFSTKGSASHEMVDKVVEATRLAKEMAPDLKIDGELQADAALVEAVGSKKAPGSEIAGKANVLVFPTLEVGNIAYKLVQRLGGAEAVGPILQGMAAPVNDLSRGCSVDDIYKMVAIACNQSIGLKSAK

SEQ ID NO: 1216 - protein, 337 aa, Parabacteroides merdae ATCC 43184
MDLMQEIIARAKANKQRIVLPEGTEERTLKAADRLVADEVADIILIGNPAEINSLAAQYGLNHIGQTTIIDPKNHEKKAAYADLLFQLRQKKGMTPEKAAVLVEDPLFLACLMIKSGDADGEIAGAQNTTGNVLRPALQIIKTAPGMSCVSGAFLMFTKTPQYGKEGILVFADCAVMPNPTAPELASIAIATAATARDIVGMEPRVAMLSFSTKGSASHEMVDKVVEATRLAKEMAPDLKVDGELQADAALVEKVASLKAPGSDVAGQANVLVFPTLEVGNIAYKLVQRLGGAEAVGPILQGMAAPVNDLSRGCSVDDIYKMVAIACNQSIGLKANK

SEQ ID NO: 1217 - protein, 336 aa, Porphyromonas gingivalis W83
MDLIQDVIRRAQENKQRIVLPEGLEPRTLEAADRLMADKVVNIILIGNVDSVKAKVAELGLKNLAEAVIIDPNNHPKKQQYTDLLLQIRQKKGLTPEKAAELVENPLYLGCLIVKSGDADGLIAGAQNTTGDVLRPALQVIKTAPGMTSVSGTFLLFTKAKEYGKDGLLLVADCAVIPNPTADELAQIAVATARTAKAIADIEPRVAMLSFSTKGSAKHEMTDKVVEATRMAQEMAPDLLIDGEMQADAALVERVAALKAPGSNVAGKANVLVFPTLEVGNIAYKLVERLGHAEAVGPILQGMAAPVNDLSRGCSVEDIYRMVAITANQAIAAKEQ

SEQ ID NO: 1218 - protein, 335 aa, Porphyromonas uenonis 60-3
MELLQKNVQRAKANKQRIVLPEGLEPRTLQAADRILADGIAHIILLGNPAEIQAKAAELGLKHIDQAEIIDPQNHARREAYRDLLMELRKSKGMTREQADELVVNPLYLACLMIKSGDADGEVAGAHNTTGNVLRPALQLIKTRPGLKVVSGAFLIFSPLKEYGENGFFIFADCAVTPNPDSNELAQIAIASADTARSIGDMEPRVALLSYSTKGSAKSEMIDKVTEAYKIAKEMAPDLLIDGELQADAAIVSKIAELKAPESPVAGKANVLVFPNLEVGNVAYKLVERLGRATAVGPILQGMAAPVNDLSRGCSVDDVYNVITITCNQAIAAKK

SEQ ID NO: 1219 - protein, 335 aa, Porphyromonas endodontalis ATCC 35406
MDLMKEIVARAAANKQRIVLPEGTEPRTLQAADRLLADGVANLVLIGEPAAIKAKAAELGLTHIGEAELIDPNCHAKKEAYRDLLMELRKSKGMTQEEADKLVVNPLYLACLMIKAGDADGELAGAQNTTGNVLRPALQLIKTMPGLSCVSGAFLLFTQAKQYGREGLLVVADCAVTPNPNANELGQIAVASATTARAIGGMEPRVAMLSYSTKGSAKGELEDKVVEGLRVAKELAPDLAIDGELQADAALVEAVASLKAPDSPVAGKANVLVFPSLEVGNIAYKLVERLGGAMAVGPILQGMAAPVNDLSRGCSVDDIYKMVAITANQAIAAKQ

SEQ ID NO: 1220 - protein, 339 aa, Bacteroides uniformis ATCC 8492
MQRLINEIVERAKANRQRIVLPEGTEERTLKAANQILTDGVADLIILGKPAEIEACAKEWGLGNINKATIIDPEDHPKKEEYAQLLCELRKKKGMTIEEARKLVVDPLYLGCLIIKNGDADGQLAGARNTTGNVLRPALQIIKTSPGITCVSGAMLLLTHAPEYGKNGILVMGDVAVTPVPDAEQLAQIAVCTARTAQAVAGLDPKVAMLSFSTKGSAKHEVVDKVVEALKIAKEMAPDIAIDGELQADAALVPEVGASKAPGSSIAGHANVLVVPSLEVGNISYKLVQRLGHADAVGPILQGIARPVNDLSRGCSIEDVYRMIAITANQAIAAKKNAE

SEQ ID NO: 1221 - protein, 338 aa, Bacteroides eggerthii DSM 20697
MQRLINEILERAKADRQRIVLPEGTEERTLKAANQILTDGIADLILLGNPAEINACATEWGLGNISKATIIDPENNPKQEEYAQLLFELRKKKGMTIEEARKLVTNPLYLGCLIIKNGDADGQLAGARNTTGDVLRPALQIIKTAPGITCVSGAMLLLTHAPEYGKNGVLVMGDVAVTPVPDASQLAQIAVCTARTAKAVAGLDPKVALLSFSTKGSAKHEVVDKVVEALKIAKELAPDIAIDGELQADAALVPEVGASKAPGSAIAGNANVLVVPSLEVGNISYKLVQRLGHADAVGPILQGIARPVNDLSRGCSIEDVYRMIAITANQAIAAKHNK

SEQ ID NO: 1222 - protein, 338 aa, Bacteroides cellulosilyticus DSM 14838
MQRLINEIVERAKADRQRIVLPEGTEERTLKAANQILTDGVADLILLGNPDEINACATEWGLGNISKATIIDPENHPKKEEYAQLLCELRKKKGMTIEEARKLVVNPLYLGCLIIKNGDADGQLAGARNTTGDVLRPALQIIKTTPGITCVSGAMLLLTHAPEYGKNGILVMGDVAVTPVPDAEQLAQIAVCTARTAKSVVGMEPKVAMLSFSTKGSAKHEVVDKVIEAVKIAHEMDPDLALDGELQADAALVPEVGASKAPGSAIAGNANVLAVPSLEVGNISYKLVQRLGHADAVGPILQGIARPVNDLSRGCSIEDVYRMIAITANQAIAAKNQK

SEQ ID NO: 1223 - protein, 339 aa, Bacteroides fragilis YCH46
MLNLINSIVARAQANRQRIVLPEGTEERTLKAANQILTDEVADLILLGNPEEINAAAAKWGLGNINRATIIDPENHPKKEEYAQLLCELRKKKGMTIEEARKLVLDPLYLGCLIIKSGDADGQLAGARNTTGDVLRPALQIIKTSPGITCVSGAMLLLTHAPECGQNGLLVMGDVAVTPVPDASQLAQIAVCTARTAQAVAGIAEPKVAMLSFSTKGSAKHENVDKVVEALKLAKEMAPDLNIDGEMQADAALVPSVGASKAPGSPVAGEANVLIVPSLEVGNISYKLVQRLGHADAVGPILQGIARPVNDLSRGCSIEDVYRMIAITANQAIAAKNGK

SEQ ID NO: 1224 - protein, 339 aa, Bacteroides sp. D1
MLNLINQIVARAKANRQRIVLPEGTEERTLKAANMILTDEVADLILLGKPAEINELAAKWGLGNIGKATIIDPETSPKHEEYAQLLCELRKKKGMTIEEARKLTNDPLFFGCLMIKSGDADGQLAGARNTTGNVLRPALQIIKTAPGITCVSGAMLLLTHAPEYGKNGILVMGDVAVTPVPDANQLAQIAVCTAQTAKAVAGIENPKVAMLSFSTKGSAKHEVVDKVVEATKIAKEMAPTLDLDGELQADAALVPEVGASKAPGSEVAGQANVLIVPSLEVGNISYKLVQRLGHADAIGPILQGIACPVNDLSRGCSIEDVYRMIAITANQAIAAKANK

SEQ ID NO: 1225 - protein, 339 aa, Bacteroides coprophilus DSM 18228
MDLISQIVERAKSNKQRIVLPEGTEERTLKAANQVLTDGVADLILLGNPSEIMDLAREWGLGNISRATIIDPENHPKQEEYAQLLCQLRQKKGMTIEEARKLVRNPLYLGCLIIKAGDADGQLAGARNTTGDVLRPALQIIKTEPGITCVSGAMLMLTHAPECGDNGVIVMGDVAVTPVPDAGQLAQIAVCTARTAKAVAGIDPRVAMLSFSTKGSAKHEVVDKVVEALKLARELDPEMKIDGEMQADAALVPRVGQSKAPGSEIAGRANVLVVPCLEVGNISYKLVERLGHATAIGPILQGIARPVNDLSRGCSVDDVYKMIAITANQAIAAKEQENK

SEQ ID NO: 1226 - protein, 336 aa, Bacteroides plebeius DSM 17135
MDLISEIVERAKANKQRIVLPEGTEERTLKAANQILTDGVADLILLGNPDEIMNLAKEWGLGNIHKATIIDPENNPKQEEYAQLLCELRKKKGMTIEEARKLVLNPLYLGCLIIKAGDADGQLAGARNTTGDVLRPALQIIKTAPGITCVSGAMLMLTHAPECGDNGVLVMGDVAVTPVPDANQLAQIAICTAQTAKAVAGIDPRVAMLSFSTKGSAKHEVVDKVVEALKIAKELDPTLKIDGELQADAALVPRVGASKAPGSEIAGKANVLVVPCLEVGNISYKLVERLGHATAVGPILQGIARPVNDLSRGCSIDDVYKMIAITANQAIAAKAQ

SEQ ID NO: 1227 - protein, 337 aa, Bacteroides vulgatus ATCC 8482
MDLISQIVERAKANKQRIVLPEGTEERTLKAANQILTDGVADLILLGNPDEIMSLAKQWGLGNIGKATIIDPTDHPKKEEYAQLLCELRKKKGMTIEEARKLVVDPLYLGCLIIKAGDADGQLAGARNTTGNVLRPALQIIKTTPGITCVSGAMLLLTHAPEYGNNGVIVMGDVAVTPVPDANQLAQIAVCTAQTAKAVAGIDPRVAMLSFSTKGSAKHEVVDKVVEALAIAKEMAPDLKIDGELQADAALVPHIGASKAPGSEIAGKANVLVVPCLEVGNISYKLVERLGHATAIGPILQGIARPVNDLSRGCSIDDVYKMIAITANQAIAAKENK

SEQ ID NO: 1228 - protein, 338 aa, Prevotella tannerae ATCC 51259
MSITQNLIERARANKQRIVLPEALEERTLTAADKVLADGFAEIILIGNPDAIHTLAAKLNLQHIDKAEIVDPENNPKMEEYAQLLFELRKKKGMSIEMARDLVKDPLYLGCLIIKSDDADGQISGALSTTGETLRPALQIIKCAPGVSVVSGAMLLLTQAEEYGQDGIIVMGDVAVTPMPDAEQLAQIAYCTAQTAKSVAGIDEPRVAMLSFSTKGSAKHEVVDKVVEATRIAKEMYPNLQVDGELQADAALVPSVGEKKAPGSNIAGKANVLIAPNLEVGNIGYKLVQRLGKAEALGPILQGIARPVNDLSRGCSVEDIYKMVAITANQAIAAKEEK

SEQ ID NO: 1229 - protein, 349 aa, Prevotella bergensis DSM 17361
MNLLESIVARAKADKQRIVLPEAEEERTLRAADKVLADEMANLILIGNPDNIRKKAEEWGLKHIDKATLVDPSNCDKTEEYATLLAELRKKKGMTVDQARELVTKNNLYLGCMIIKTGDADGQISGALSTTGDTLRPALQIIKCAPGVTCVSGAMLLLTNEQQYGENGIVVMGDVAVTPNPTADQLAQIAYTTAQTARSVAGIEQPQVAMLSFSTKGSAKDAIDKQTGKSVYIIDKVLEATKIAKERYPDLKLDGELQADAALDPKTASTKAPGSEVAGKANVLVVPNLEVGNIGYKLVQRLGGATAIGPILQGIARPVNDLSRGCSVDDIYYMVAITACQAQEAKGNS

SEQ ID NO: 1230 - protein, 348 aa, Prevotella veroralis F0319
MDLLEQIVARAKADKQRIVLPEAEEERTLRAADRVLADDIANLILIGNPTNIHKLATEWGLKNIDKATIVDPENNPKCEEYAAKLAELRQKKGMTIDQARELVTKNNLYLGCMIIKTEGADGQISGALSTTGDTLRPALQIIKCAPGITCVSGAMLILTHEQQYGENGIVVMGDVAVTPNPTADQLAQIAYTTAETAKSVAGFQDPHVAMLSFSTKGSAKDAIDRETGKSVYIIDKVVEATKIAKEKFPTLKVDGELQADAALVPAVAAKKAPGSEIAGKANVLVVPNLEVGNIGYKLIERLGGAKAIGPILQGIARPVNDLSRGCCVDDIYYMVAITACQAQDAKKL

SEQ ID NO: 1231 - protein, 345 aa, Prevotella sp. oral taxon 472 str. F0295
MDLLHQIIERAKSDKQRIVLPEASEDRTLRAADRALADEIADIILIGNPSEIHKLAEARGLVNIDKATIIDPEDNPDSEELAQLLAELRKKKGMTLMQARELVKNNLYLGCMLIKTDRADGQISGALSTTGDTLRPALQIIKCEPGVTCISGAMLLVTDQKEYGEDGVVVMGDVAVTPMPDANQLAQIAVCTAATARCVAGFKDPRVAMLSFSTKGSASHEVVDKVVEATRLAKTMNPDLRIDGELQADAALVPSVGQKKAPGSAIAGNANVLVVPNLEVGNIGYKLVQRLGNVQAIGPILQGIARPVNDLSRGCSVDDIYYMVAITACQAQDAKAKACTLSADK

SEQ ID NO: 1232 - protein, 333 aa, Candidatus Azobacteroides pseudotrichonymphae genomovar. CFP2
MNLMHQIITKARNRRQRIVLSEGTEERTLRAADRAIADKIADIILLGNIAEIKALTIKYGLRNVLQAVIVDPIKNERKNAYAVLLMELRKNRGMTIVEAQKLVENPLYLGCLMIKNGDADGEIAGAQNTTSDVLRPALQIIKTTPGINVVSGAFLMLSQNEEYGANGVLIFADCAVVPNPNAKELAEIAVSTAITAKTLIGIEPIVALLSFSTKGSASHELVDKINEAVCIAKSISPELIIDGELQADAALVPFIGQSKAPGSLVAGKANVLVFPNLECGNIAYKLVQRLGNIQAIGPILQGIAAPVNDLSRGCSVEDIYTMIAICANQAIMK

SEQ ID NO: 1233 - protein, 330 aa, Syntrophomonas wolfei subsp. wolfei str. Goettingen
MDLIAQIKEKAAKNVKAIVLPEGTEERTIQAIKGIVDSKVARPILLGDEGAIKGIASKIGADISGAEIINPEKAPFFDDFVQAFYEMRKSKGVDLDKAKATMLDPLFFASMMVKMDKADGEVAGAENTTGNVLRPALQIIKTSPGISAVSGAFIMIVPNCSYGDNGVFVFADCAVTIDPTAAQLAEFAKASVGTAVDLCGMKDPKIGMLSFSTKGSASHEMVDKMVQATAIAKEKFPELKVDGEFQLDAAIVPSVGSSKAPGSPVAGDCNVLIFPDIQAGNIGYKLVQRTAKAEAIGPILQGIAKPVNDLSRGCSVEDIVNVVAMTAVRS

SEQ ID NO: 1234 - protein, 326 aa, Collinsella aerofaciens ATCC 25986
MSDFLNRMKSAAKADLKTIVLPEGEDPRTIVAATKIIEEGLAKIVILGNPDEINVPGATVIDPRNAEKHEEYAQKFAELRAKKGVTIEQARAQVMDATYFGTMMVKMGDADGLVSGACHSTADTLRPALQILKTAPGTKLVSAFFVMCTDTPQFGTDGTLIFADCGLNINPSSDELSEIAIASAHSWSTFMGNVEPHVAMLSYSTMGSAGGEVAKKVQEAVKFCKEKAPELAIDGDLQLDAAIVPTVAQLKAPGSSVAGKANVLVFPDLEAGNIGYKLVQRFAGADAYGPILQGIAKPVNDLSRGCSADDIVGVVAITAVQAQMAE

SEQ ID NO: 1235 - protein, 326 aa, Collinsella stercoris DSM 13279
MSDFLTRMKAAAKADKKTVVLPEGEDQRTIDAAKIIVEEDLANLVILGDPDKIDLPGVTVIDPKCGPKHEEYAQKFAELRAKKGVTIEQARAQMNDATYYGTMMVKMGDADGLVSGACHSTADTLRPALQILKTAPGTKLVSAFFIMCTSTPQFGTDGTLIFADCGLNINPTSDELSEIAIASAKSWQTFMGGAEPHVAMLSYSTMGSAGGEVAKKVQEAVAFCKEKAPEVPIDGDLQLDAAIVPTVAQLKAPGSPVAGKANVLVFPDLEAGNIGYKLVQRFAGAEAYGPILQGIAKPVNDLSRGCSAEDIVGVVAITAVQAQMAE

SEQ ID NO: 1236 - protein, 332 aa, Collinsella intestinalis DSM 13280
MTRSVCMSDFLGRMKAAAKADKKTIVLPEGEDPRTIEAAKKIVEEDLANLVILGNPDEIDVPGATVIDPRNAEKHEEYASKFAELRAKKGVTIEQARAQVMDATYFGTMMVKMGDADGLVSGACHSTADTLRPALQILKTAPGTKLVSAFMIMCTQTEQFGADGTLVFADCGLNIAPTSDELSEIAIASANSFKTFMGDVEPKVAMLSYSTMGSAGGDTAKKVQEATAFAREKAPELAIDGDLQLDAAIVPSVAELKAPESKVAGHANVLVFPNLETGNIGYKLVQRFGGAEAYGPILQGIAKPVNDLSRGCSADDIVGVVAITAVQAQMAE

SEQ ID NO: 1237 - protein, 381 aa, Atopobium rimae ATCC 49626
MHNSHVNLHEAPSFGEKRLPVTVFLVPNFITHSYNEVRMAQIIFLIGVLFMGKFLEQMKAAAQADKKTIVLPEGEDPRTIAAAKVIIAENLANLVILGNPDEIDVAGATVICSATDERHEAYAQKFAELRARKGVTIEQARETMNNNTYFATMMVKMGDADGLVSGACHSTADTLRPALQIIKTAPGTKLVSAFFIMSTDKPEFGEDGTLLFADCGLNINPNADELSEIALASAQSWRAFMDQEPRVAMLSYSTMGSAGGETAEKVQEATKLANEKAPDLALDGDLQLDAAIVPEVAKLKAPYSKVAGHANILVFPTLEAGNIGYKLVQRFSGAEAYGPLLQGIARPVNDLSRGCSADDIVGVVAITAVQAQMAVASEKSK

SEQ ID NO: 1238 - protein, 326 aa, Atopobium parvulum DSM 20469
MSKFLDRMKETAKSDVKTIVLPEGEDQRTIDAAKKIVAEGIAKVIILGNPEQINVPGATVVDPATDERHEAYAQKFAELRARKGVTIEEARKQMNDATYFATMMVKMGDADGLVSGACHSTANTLRPALQIIKTAPGTKLVSAFFIMSTSTGFGEDGTLLFADCGLNIDPSAEELSEIALASADSWRAFMSDEPRVAMLSYSTMGSAGGATAEKVQEATKLAHEKNAELALDGDLQLDAALVPEVGKLKAPFSKVAGNANILVFPNLEAGNIGYKLVQRFSGADAYGPILQGIARPVNDLSRGCSADDIVGVVAITAVQAQMADNN

SEQ ID NO: 1239 - protein, 324 aa, Atopobium vaginae DSM 15829
MSSFLQTIKQRAQAHKKTIVLPEGEDPRTQEAAQKIVAENLADLIVLGNPDEIKLDGVSVIDPHSAPKHEAYAQAFYELRKNKGMTIENARKQMDDPTYFATMMVKCNDADGLVSGACHSTANTLRPALQILKTAPGTKLVSAFFMMCTSCPEFGENGVVLFADSGLNIDPDADQLSEIALSSAKSWKSFMNDDAKVAMLCYSTKGSAGGDCAAKVIEATKLAQEKEPDLLVDGEMQLDAALVPSVAQSKAPNSKVAGQANILIFPDLASGNIGYKLVQRFAKAEAYGPLLQGIAAPVNDLSRGCSADDIVGVVAITAVQAQMM

SEQ ID NO: 1240 - protein, 350 aa, Oribacterium sinus F0268
MARKSFIMSEKGENMSFIEDVKAKAKAKQKTIVLPESEDKRVLQAAEQIQKEGFSRLILLGEKEQVEKDAKAWGVDLSGIEIVNPKTYAKLDEYVSTLVELRKSKGMTEEEARKLLTESNTYFGVMMVKKGEADGLVSGANHSTADTLRPSLQILKTKPGTKLVSAFFVMVVPDCEYGEKGTFVFSDCGLNQNPTSEELAAIAESSAESFRFLVGAEPKVAMLSYSTMGSAKHEEVTKVQDATKIVKENNPNLLVDGELQLDAALVESVAKLKAPGSKVAGHANTLIFPDLDAGNIGYKLVQRLAKAEAYGPMTQGIARPVNDLSRGCNVADIVGVVAITAVQCQLYDNN

SEQ ID NO: 1241 - protein, 353 aa, Abiotrophia defectiva ATCC 49176
MHFSIIFIIFIILYSLKGAKVMSFIDQIKAKAKTSKKVIVLPESEDMRTLEAADKVLKEEIAELVLLGKEEKILEDAKKGGFDVTGAKIIDPEKSDKLDSYVAALVELRKSKGMTEEEARKILTESNTYFGVMMIKMKDADGLVSGACHSTADTLRPSLQILKTKPGTKLVSSFFIVEVPNCDMGENGTFVFSDCGLNQNPNAEELAAIAKSSAESFRNLVQAEPRVAMLSYSTMGSAKHDDVTKVQEATKLAKAENPGLALDGELQLDAALVASVGEFKAPGSKVAGHANTLIFPNLDAGNIGYKLVQRLAKAEAYGPLTQGIAGPVNDLSRGCSASDIVGVVAITAVQAQM

SEQ ID NO: 1242 - protein, 334 aa, Oribacterium sp. oral taxon 078 str. F0262
MAFIDDVKEKARGSLKTIVLPESEDRRTLDAADRILREGFAKLILLGNEEKIRADAAALGDKLEGARIVDPKKSEKLESYVETLTELRKKKGMSEEEARKLLTESNTYFGMMMVKMGDADGLVSGACHSTADTLRPALQILKTKPGTKLVSAFFVMNVPDCPYGENGSFVFSDCGLNQNPTSEELAAIAEASADSFRFLIGKEPKVAMLSYSTKGSAKHDDVTKVQEAVRIAKEERPELALDGELQLDAALVPAVAALKAPSSEVAGHANTLIFPNLDAGNIGYKLVQRLGKAEAYGPMTQGIARPVNDLSRGCSADDIVGVVAITSVQCQLFD

SEQ ID NO: 1243 - protein, 333 aa, Clostridium sp. M62/1
MAFIDLMKAKAKQDKQTIVLPESKDKRTLIAAAKVLEEGTADLIMVGKEEKIMDGAGWLEVDLTGLKVVDPDTDPKFDHYAETLFELRKHKGMTKEKAEEILRTDYITYGVMMVKEKDADGLVAGACHATADTLRPALQILKTAPGTELVSGFFIMDVPNCEYGANGTFLFADCGLNQDPNSEELAAIADSSAKSFRALVGEKPVIAMLSHSTKGSAKHALVDKVVKAVEIAHEKYPQLDLDGELQLDAALVPEVAKSKAKGSTVAGHANVLIFPNLDCGNIGYKLVQRLAKAEAYGPMLQGISRPVNDLSRGCSAEDIVGVVALTAVQAQMS

SEQ ID NO: 1244 - protein, 343 aa, Ruminococcus sp. 5_1_39B_FAA
MKGAILIMGFIDTLKERAKANVKTIVLPETEDKRTLAATEKILKEGIAKVILVGNEEAVKKSAAEDGYDISGAQIVDPATSEKTQGYIDKLVELRQKKGMTPDQAKEILLNQYLYYGVMMVKMGDADGMVSGACHSTADTLRPCLQILKTKPGTKLVSAFFLMVVPNCEYGANGAFVFADSGLNQNPTSEELAAIAASSAESFELLVQEKPIVAMLSHSTKGSAKHADVDKVVEATKIAKEQNPELALDGEFQLDAAIVPSVGASKAPGSEVAGKANVLVFPDLDAGNIGYKLVQRLAKAEAYGPVTQGIAKPVNDLSRGCSADDIVGVVAITAVQCQADDNK

SEQ ID NO: 1245 - protein, 389 aa, Ruminococcus obeum ATCC 29174
MMKLHFKKYHSLEESDGQLLEKRQNWGYNEPSCEVIFWTLTRSDDRNNERSHLIMGFVDLLKERAKKSIKTIVLPETEDMRTIEATDKILKEGVAKIILIGNEEEINKKAAEGGFDISGATIVDPETSDRTQAYIDKFVELRAKKGMTPEKAKEILHTQYPYYGVMMVKMGDADGMVSGACHSTADTLRPCLQILKTKPGTKLVSAFFLIVVPDCEYGANGAFVFADSGLNQNPTPEELSAIAASSAESFQLLVQEEPVVAMLSHSTKGSAKHPDVDKMVEATRIAKEEHPELKLDGEFQLDAAIVPSVGASKAPGSEVAGKANVLVFPDLDAGNIGYKLAQRLGKAEAYGPVTQGIAKPVNDLSRGCSADDIVGVVAITAVQCQAEDK

SEQ ID NO: 1246 - protein, 332 aa, Bryantella formatexigens DSM 14469
MGFIDVIKERARSNKKTIVLPETEDRRTFEAAEKILKEGIADIILVGSEEAVKKGGEGLDLTGAVVIDPATSDKTQGYIDKLVELRSKKGMTPEQAKEILLNQYLYYGVMMVKMGDADGMVSGACHSTADTLRPCLQILKTKPGTKLVSAFFLIVVPDCEYGANGAFVFGDSGLVQDPNPEELAAIAASSADSFRLLVQEEPVVAMLSHSTMGSAKHALVDKVVEATKIAKEQNPGLKLDGELQLDAAIVPSVGSSKAPNSDVAGKANVLIFPNLDAGNIGYKLAQRLAKAEAYGPITQGIAKPVNDLSRGCSADDIVGVVAITAVQCQAED

SEQ ID NO: 1247 - protein, 344 aa, Blautia hydrogenotrophica DSM 10507
MRKVNKYERGQLIMGFIDVIKEKARADKKTIVLPESEDRRVLEATATILKEGLANVVLIGNEEQIKKDAADLDIAGAIIVDPATSDKTQAYIDKLVELRQKKGMTQEQAREIMLNQRTYYGVMMVKMGDADGMVSGACHSTADTLRPSLQILKTKPGTKLVSAFFLMEVPNCEYGENGTFVFGDCGLNQNPTSEELAAIAVSSAESFKMLVGKEPKVAMLSHSSMGSAKHADVDKVVEAVKIAKETAPELMLDGELQLDAAIVPSVGASKAPNSQVAGQANVLIFPDLDAGNIGYKLVQRLAKAEAYGPMTQGIAAPVNDLSRGCSASDIVGVTAITAVQCQNQ

SEQ ID NO: 1248 - protein, 331 aa, Clostridium nexile DSM 1787
MGFIDVIKEKAKADKKTIVLPETEDKRTYEAAEAVLKEGTANLVLVGSKEEIEKNGAGFDISGATIVDPATYEKTEAYIAKLVELRQKKGMTEEQARELLLTNYLYYGVMMVKMGDADGMVSGACHSTADTLRPCLQILKTKPGTKLVSAFFVMVVPDCDMGANGTFIFGDSGLEQNPDPEKLAAIALSSAESFKLLVGEEPKVAMLSHSTKGSAKHADVDKVVEATRLAKEMAPELQLDGELQLDAAIVPEIGESKAPGSKVAGHANVLIFPDLDAGNIGYKLVQRLGKAEAYGPLTQGIAKPVNDLSRGCSAADIEGVVAITAVQAQAQ

SEQ ID NO: 1249 - protein, 331 aa, Ruminococcus gnavus ATCC 29149
MAFIDEIKARAKADKKTIVLPETEDVRTYQAAEAVLREGTADLILVGSKEEIEKNGAGFDLTGAVIVDPATSDKTEGYIAKLVELRQKKGMTEEQAREILLTNYLYYGVMMVKMGDADGMVSGACHSTADTLRPCLQILKTKPGTKLVSAFFVMVVPDCDMGADGTFIFGDSGLEQNPDPEKLANIALSSAESFRTLTGKEPVVAMLSHSTKGSAKHADVDKVVEATRLAKEMAPELKLDGELQLDAAIVPAVGESKAPGSPVAGHANVLIFPDLDAGNIGYKLVQRLAKAEAYGPLTQGIAAPVNDLSRGCSAEDIEGVVAITAVQAQAQ

SEQ ID NO: 1250 - protein, 331 aa, Ruminococcus lactaris ATCC 29176
MGFIDEIKARAKACKKTIVLPETEDERTYKAAEAVLKEGIADLVLVGSKEEIEKNKGTYDISGAAIVDPATDARTEGYIAKLVELRQKKGMTPEQAKELLLNNYLYYGVMMVKMGDADGMVSGACHSTADTLRPCLQILKTKPGTKLVSAFFLMVVPDCDMGADGTFVFADAGLEQNPDPEKLANIAISSADSFTLLVGKEPVVAMLSHSTKGSAKHADVDKVVEATKIAQGLAPELALDGELQLDAAIVPEVGASKAPGSKVAGHANVLVFPDLDAGNIGYKLVQRLGKAEAYGPLTQGIAAPVNDLSRGCSAEDIVGVVAITAVQAQAE

SEQ ID NO: 1251 - protein, 331 aa, Ruminococcus torques ATCC 27756
MGFIDEIKARAKADKKVIVLPETEDERTYKAAQTVLREGIADLILVGNEEEIEKNKGAYDITGAVIVDPAKNDKTEEYIAKLVELRQKKGMTEEQARELLLNNYLYYGVMMVKMGDADGMVSGACHSTADTLRPCLQILKTKPGTKLVSAFFLMVVPDCDMGADGTFIFGDAGLEQNPDPEKLANIALSSAESFETLTGKEPIVAMLSHSTKGSAKHADVDKVVEATKIAHELAPELKLDGELQLDAAIVPEVGASKAPGSEVAGKANVLIFPDLDAGNIGYKLVQRLGKAEAYGPLTQGIAAPVNDLSRGCSAEDIVGVVAITAVQAQAE

SEQ ID NO: 1252 - protein, 340 aa, Clostridium scindens ATCC 35704
MERSLSIMGFIDEIKAKAKTNKKTIVLPETEDIRTYEAAEAVLKEGTANLILVGSEEEIAKNKGSFDITGATIVDPATYEKTDAYIAKLVELRQKKGMTEEQARELLLTNYLYYGVMMVKMKDADGMVSGACHSTADTLRPCLQILKTKPGTKLVSAFFVMVVPDCDMGADGTFVFADAGLEQNPDPEKLAAIALSSAESFGLLTEKEPIVALLSHSTKGSAKHADVDKVVEATRIAKENAPEGLLLDGEFQLDAAIVPSVGASKAPGSPVAGKANVLVFPDLDAGNIGYKLVQRLAKAEAYGPLTQGIAAPVNDLSRGCSAKDIEGVVAITAVQAMAEE

SEQ ID NO: 1253 - protein, 340 aa, Clostridium hylemonae DSM 15053
MERSLLIMGFIDEIKAKAKTSRKTIVLPETEDIRTYEAAEAVIKEGTANVVLVGSKEEIEKNRGSFDVSGATVVDPATSEKTDGYIAKLVELRQKKGMTEEQARELLLTNYLYYGVMMVKMKDADGMVSGACHSTADTLRPCLQILKTKPGTKLVSAFFVMVVPDCDMGADGTFVFADAGLEQNPDPEKLAAIALSSADSFRLLTGEEPVVALLSHSTKGSAKHADVDKVVEAARIAKEAAPEGLMIDGEFQLDAAIVPEIGASKAPGSPVAGKANVLVFPDLDAGNIGYKLVQRLAKAEAYGPLTQGIAAPVNDLSRGCSAKDIEGVVAITAVQCMAEN

SEQ ID NO: 1254 - protein, 334 aa, Dorea formicigenerans ATCC 27755
MGFIDDIKARAKTSKKTIVLPETEDIRTYEAAEAVLKEGTANLILVGSEEEIAKNKGSFDISGATIVDPAKSEKTDAYIAKLVELREKKGMTEEKARELLLTNYLYYGVMMVKMKDADGMVSGACHSTADTLRPSLQILKTKPGTKLVSAFFIMVVPDCEMGANGTFLFGDSGLEQNPDPEKLAAIALSSAGSFRLLTEKEPVVALLSHSTKGSAKHADVDKVVEATKIAKENAPEGLLIDGEFQLDAAIVPSVGASKAPGSPVAGKANVLIFPDLDAGNIGYKLVQRLAKAEAYGPLTQGIAAPVNDLSRGCSAKDIEGVIAITAVQAMAEDK

SEQ ID NO: 1255 - protein, 331 aa, Dorea longicatena DSM 13814
MGFIDEIKAKAKSCKKTIVLPESEDIRTYEAAEAILKEGTANLILIGSEEEIAKNKGDFDITGATIVDPATYEKTDEYVATLVELRKKKGMTEEQAREILLTNYLYYGVMMVKMKDADGMVSGACHSTADTLRPCLQILKTKPGTKLVSAFFVMVVPDCDMGENGTFVFADCGLNQNPTSEELAAIAQSSAESFKQLVGADPRVAMLSYSTMGSAKHDDVTKVQEAVKIAKAENPDLMLDGEMQLDAALVPSVGAAKAPGSQVAGKANTLIFPNLDAGNIGYKLVQRLAKAEAYGPMTQGIAAPVNDLSRGCSAKDIEGVVAITAVQCQNQ

SEQ ID NO: 1256 - protein, 331 aa, Clostridium phytofermentans ISDg
MGFIDDIKARAKQSIKTIVLPESMDRRTIEAAAKTLEEGNANVIIIGSEEEVKKNSEGLDISGATIVDPKTSDKLPAYINKLVELRQAKGMTPEKAKELLTTDYITYGVMMVKMGDADGLVSGACHSTADTLRPCLQILKTAPNTKLVSAFFVMVVPNCDMGANGTFLFSDAGLNQNPNAEELAAIAGSTAKSFEQLVGSEPIVAMLSHSTKGSAKHADVDKVVEATKIANELYPEYKIDGEFQLDAAIVPSVGASKAPGSDIAGKANVLIFPDLDAGNIGYKLTQRLAKAEAYGPLTQGIAAPVNDLSRGCSSDDIVGVVAITAVQAQSK

SEQ ID NO: 1257 - protein, 331 aa, Clostridiales bacterium 1_7_47_FAA
MGFIDVIKEKARADKKTIVLPESMDRRTWVAAEKILKEDLANLVIIGTPEDIGEHSKGLDVSGATIINPQTYEKTQEYIDLFVELRKAKGMTEEKARETILNDYAYYGCLIIKKGDADGMVSGACHSTANTLRPCLQVIKTKPGTKLVSAFFLMEVPDCQFGDNGTFVFADCGLNQNPNPEELAAIAVSSAESFKLLTGRDAKVAMLSHSSKGSASHADVDKVVEATRLAKEMAPELELDGELQLDAAIVPEIGESKAPGSKVAGHANVLVFPDLDAGNIGYKLVQRLGKAEAYGPMCQGIAKPVNDLSRGCSADDIVGVVAITAVQCQNN

SEQ ID NO: 1258 - protein, 331 aa, Clostridium bolteae ATCC BAA-613
MGFIDLVKARARADKKTIVLPESMDRRTWEAAETILKEDIANLIIIGTPEDIADHSKGLDVSGATVINPQTYEKTQEYIDLFVELRKSKGMTPEKAKEIIMSDYAYYGCLMIKNGDADGLVSGACHSTADTLRPCLQIVKTKPGTKLVSAFFLMVVPDCEYGAEGTFIFADSGLNQNPNPEELAAIAKSSADSFELLVQKEARVAMLSHSTKGSAKHPDVDKVVEATRIAKELYPELKLDGELQLDAALVPEVASSKAPGSEVAGKANVLMFPDLDAGNIGYKLVQRLAKAEAYGPVTQGIAKPVNDLSRGCCADDIVGVVAITAVQAQAE

SEQ ID NO: 1259 - protein, 331 aa, Butyrivibrio crossotus DSM 2876
MAFIDEIKERARAEKKRIILPEGMDRRVWEAAVTVIKENVADVTVIATEEEVKEFSEGLDIEGIHIINPFTYPDLDRFINDLVELRRMKGMTPGEARELLTSDYIYFACMMLRENQADGIVSGACHSTANTLRPALQLVKAKPGSRLVSAFFIMVVPDCEYGYNGTFLFGDCGLEQNPEPEKLAGIAIASAESFRYLVGGEPYVAMLSYSTKGSARHADVDKVYNAYKIARDNAPYLKIDGELQPDAALVPEIAAYKAPGSKVAGKANVLIFPDLDAGNIGYKLVQRLAKAEAYGPITQGMNKPVNDLSRGCSAKDIVGVVAITAVQAQKE

SEQ ID NO: 1260 - protein, 343 aa, Eubacterium ventriosum ATCC 27560
MIGEYKDLRRIEMGFIEQLKIKAKSNKKTIVLPEGMDRRTYEAAQQIVEEDFANIIILASPEEAEKYGKGYDIENVTIIDPKDCVKTKEYAEEFYMLRKAKGMTETQAYAMLVSDYMYFACMMVRAGDADGVVSGACHSSANTLRPSLQIIKTKPGSKLVSAFFVMCVQNKELGADGVFVMGDCGLNQNPNPVQLADIAASSAESFEYLVGEKARVAMLSHSTHGSAAHPDVDKVVEATKIAQKEYPQFLIDGELQTDAAVVPEVAALKAPDSPVAGKANVLIFPDLDAGNIGYKLIQRLGNAEAYGPLCQGIAKPVNDLSRGCSAKDIVGVVAITAVQAQIN

SEQ ID NO: 1261 - protein, 331 aa, Eubacterium eligens ATCC 27750
MAFIDTIKERAKADKKTIVLPESMDKRTYEAAEKILKEGIANLVIIGTPEEIEKYGKGYDISGATIVDPFNDPNKQKYIDKFVELRSKKGVTPEMAKEQMEKDYMYYACLMCKCGDADGAVSGACHSTGNTIRPALQLLKTKPGISSVSGFFLMEVPDCEFGENGLFVFADCAVSPDYDSEKLAEVAKLSSDSFKSFVGKDAKVAMLSFSSYGSAKHDRVTMVADAVKIAKEKYPDITVDGELQLDAALVPEVAALKAPESPVAGKANTLVFPNLEAGNIGYKLVQRLAKAGAYGPVLQGLSMPVNDLSRGCFADDIVGVVAMTAVQAQNA

SEQ ID NO: 1262 - protein, 339 aa, Helicobacter pullorum MIT 98-5489
MSLIENIKEKAKSFLQTIVLPETNDMQTLEAAHTILKEGIANLILIGDELSIQKQAKKANLDLQKATFINPASCDELEDYVELFVKLRAHKGLSEKSARTLLLENPLYFGVALVKSKKADGMVAGAINSTADVLRSSLQILGTKQDSKLVSAFFLMVVPNCEYGENGTFIFADSGLVQNPNAQELASIAIDSAKSFQTLVGKEPIVAMLSHSTKGSAKHPDVDKVIEATKIAQSLAPQIAIDGEFQLDAAIVPSVGKSKAPDSKIAGYANVLVFPDLDSGNIGYKLTQRLAKAEAYGPITQGIAAPINDLSRGCSSEDIVGVVAITALQAQQQKETKGA

SEQ ID NO: 1263 - protein, 333 aa, Helicobacter canadensis MIT 98-5491
MGFIETIKEKAKANLKTIVLPETNDIRTLEAAHKVLEEKIANLILLGDEATLKAEAAKSNLNLDGATFINPTSCDELESYVELFVKLRGHKGLSEKSARALLLENPLYFGVALVKSQKADGMVAGAINSTADVLRASLQILRTKKDSKLVSAFFLMVVPNCDYGEKGIFIFADSGLVQNPNAQELASIAIDSAKSFQSLVGKDPIVAMLSHSTKGSAKHPDVDKVIEATKLAQSLAPQIAIDGEFQLDAAIVPSVGKSKAPESKIAGYANVLVFPDLDSGNIGYKLTQRLAKAEAYGPITQGIAAPVNDLSRGCSSDDIVGVVAITALQAQQK

SEQ ID NO: 1264 - protein, 331 aa, Helicobacter winghamensis ATCC BAA-430
MGFIQSIKDKAKANPKTIVLPETGDLRTLEAAHTALKEGIAKIILIGDEKEIKARGNGLDLNKATFIDPRSCDSLDSYVELFVKLRGHKGLSESSARALLLENPLYFGVALVKTGVANGMVAGAVNSTADVLRASLQILGTKKDSKLVSAFFLMVVPNCNYGENGIFIFADSGLVQNPNPQELASIAIDSAKSFESLVGKEAVVAMLSHSTKGNAKHPDVDKVIEATQIAKAQAPNIAIDGEFQLDAAIVPSVGKSKAPDSTIAGRANVLVFPDLDAGNIGYKLVQRLANAEAYGPITQGIAGAVNDLSRGCSSEDIVGVIAITALQAHQN

SEQ ID NO: 1265 - protein, 331 aa, Helicobacter hepaticus ATCC 51449
MSFIDTIKTQARKNKKTIVLPETSDSRTIEAAVKILNEDFAELILIGEQEQILSTYQDNAQVLKKATFLHSSDTALLDELIELLVKLRAHKGMDKSKAREILVNDNLYFGAALVKAGRADGMVAGAIHATSDVLRAALQIVGTAPDSKLVSSFFVMVVPQCDYGLNGTFVFSDCGLCQNPSAEELAHIALSSAKSFASIMHEEPMVAMLSHSTYGSAKHPDVDKVVEATKIAKSLDKNLKVDGELQLDAAIVPSVGASKAKGSNVAGKANVLVFPDLDAGNIGYKLVQRFAKAEAYGPITQGMGAPINDLSRGCSADDIVGVVALTALQAK

SEQ ID NO: 1266 - protein, 338 aa, Helicobacter cinaedi CCUG 18818
MGFIDTIKAQARANKKKIVLPEVTDLRTIEAAVKILSEGFADIVLVGQKDEILTQAKGLSQAHLPLIEALNNATFLNAKDSALLDDLTALLVKLRAHKGMDSTQARELLVNDNLYFGAALVKSGRADGMVAGAIHATADVLRAALQIVGTAADSKLVSSFFIMDIPHCDYGLNGTFVFSDCGLCQNPTAEELAHIAISSAKSFESVMHSEAMVAMLSHSTYGSAKHADVDKVVEATKIAKSLAPNLKIDGELQLDAAIVPSVGESKAKGSSVAGKANVLVFPDLDAGNIGYKLVQRFARAEAYGPITQGMGAPINDLSRGCSADDIVGVVALTALQAK

SEQ ID NO: 1267 - protein, 334 aa, Anaerostipes caccae DSM 14662
MSFIDVIKERAKSEKKKIVLPETGDPRTLEAADTVLREGIADIILVGNEEEILSRAEGLDLSKACFVDPNNCERLNTYIESLCEARKSKGLLPEDAKEILLSNPLFFGATMVRAGDADGMVAGAVNSSANVLRSALQVVKTAPGTRIVSAFFLMVVPDCELGANGTFVFADCGLNQNPNSEQLAAIAGSSAQTFKQLVGEEPRVAMLSHSTVGSAKHDDVTKVVEATAIAKRDYPDTLICGELQLDAAIVPEVAASKAPRSEVAGKANVLVFPDLDAGNIGYKLVQRLAKAEAYGPVTQGIAKPVNDLSRGCKAEDIVGVVAITAVQAQLTENN

SEQ ID NO: 1268 - protein, 337 aa, Clostridium sp. SS2/1
MSVIDEIKNKAKANKKTVVLPETTDMRTLTAAAEVISEGIADIILVGKEDEIKAKAEAEGLDLAKASFVDPENCDHLNTYIESLCEARKSKGLLPEDAKEILLSNPLFFGATMVRVGDADGMVAGAINSSANVLRAALQVVKTAPGTEIVSAFMLMDTQAKDMGENGCFVFADCGLNQNPNPEQLAAIASSSAKTFEQLIGATPRVAMLSHSTCGSAKHDDVTKVVEATNIAKEKYPQYLICGELQLDAAIVPEVAASKAPRSEVAGKANVLVFPDLDAGNIGYKLVQRLGGAQAFGPITQGIAKPVNDLSRGCVASDIVGAVAITCVQAAALEADK

SEQ ID NO: 1269 - protein, 355 aa, Coprococcus eutactus ATCC 27759
MCVFIILKGDINMKFIEQLKERAKQNKKKIVLPETSDMRTIEAAGKVLAEGIADIILVGDKEDIISRAGDIDLSRASFVDPENYDKFDEYVDAFVEMRRKKGMTPARAKELLLTNPLYFGCMMVKQDDADGMVAGAINASADVLRAALQTLKTAPGTRIVSAFFLVVVPDCEYGANGAFVFSDAGLNQSPSASELADIAEQSAKSFQLLVQEEPVVAMLSHSTKGSAKHPDVDKVIEATEIVNAEFPDLLCDGELQSDAALVPEVASSKAPGSKVAGHANVLVFPDLDAANIGYKLVQRLAKADAYGPVTQGIAKPVNDLSRGCVADDIVGVVAITAIQAQAQEAGLMKVTPKER

SEQ ID NO: 1270 - protein, 332 aa, Epulopiscium sp. 'N.t. morphotype B'
  misc_feature (74)..(74): Xaa can be any naturally occurring amino acid
  misc_feature (76)..(76): Xaa can be any naturally occurring amino acid
  misc_feature (279)..(279): Xaa can be any naturally occurring amino acid
MSFLNSIKQIAKGLQKTIVLPESHDMRTLQAADTILKEGLAKLILIGDPKKIAADAVGLDLSKATIIDPKHFSXMXEYINELYNLRKSKGLTLEQATELLTTKDLFLGVMMVKMGLADGMVAGAANSSANVLRPALQILKTAPGTKIVSAFFIVVVPDCEYGDNGVFLFGDCGLNENPTAEQLAEIAKSSAESFQQLTQHEPRVAMLSYSTHGSAHNPLVDKMQDATKLAKELCPNTLIAGELQLDAAIVPEICSLKAPTCELQGKANVLIFPNLDAGXIGYKLVQRLAKAEAYGPVTQGIAKPVNDLSRGCSADDIVGTVAITALQTQHVK

SEQ ID NO: 1271 - protein, 332 aa, Eggerthella lenta DSM 2243
MSSFLETMLARAKADRQTIVLPEGDDERTLAAAERILADDIADLVILGDAHAIAASPYKLSGARIIDPRTSELREGFAEALYELRKAKGMTPEQAMGLMDDVLYFGVMMVKTGGADGMVAGACHATGDVLRPCLQILKTAPGVKLVSSFFVMVVPDCDLGQEGTFLFSDCGLEVQPDAEKLAHIAVNSAKSWKTLMGTEPAVALLSHSTYGSAKNDDAAKVVEATAIAKELAPGLALDGELQLDAAIVESVGSSKAPDSPVAGKANVLIFPDLDAGNIGYKLVQRLAKAEAYGPITQGIAAPVNDLSRGCTADDIVGVIAITCVQAQAKQAE

SEQ ID NO: 1272 - protein, 333 aa, Cryptobacterium curtum DSM 15641
MSAFIESMITRAQTSRQTIVLPEGNDQRTLQAAKAVMERGIADVIVLGNATEITSTAGDLAGARIVDPATSNAASSYAETFFELRKHKGITLEDAIAQMADPIYFGAMMVKQGDADGMVCGACHATADVLRAALQILKTAPGASAVSSFFIMALPDTTYGDDGVLMFADCGLTIQPDAAALAQIAVSCSESWHALFESEPRVALLSHSTHTSAVANPDRDKVIEATRLAHEMAPNLALDGELQADAALVPAVAATKAADSSVAGSANILVFPDLDSGNIAYKLVQRLAHAEAYGPITQGIAAPVNDLSRGASVEDIIGVIAITAVQCQATERV

SEQ ID NO: 1273 - protein, 331 aa, Slackia heliotrinireducens DSM 20476
MAKFNDFMIERAKADVKTIVLPEGADPRTLEAAEIILAEKIADLIIIGNEADIVASGRNLEGATIIDNTTSELRAELAEQLYEIRKNKGMTPEDAMALMDDVNYFGTMLLKTRRADGLVSGAAHSTADVLKPALRIIRTAPGTKTVSSFFMIEVPDCPYGEDGLFMFSDCGVVIQPSAEELSEIAIAAAHSFEDLVQKPARVAMLSHSTKGSAKDADADKVIEATRLAQEKAPDLAIDGELQGDAAIVPHVGESKAPGSKIAGHANVLIFPDLDAGNIAYKMAQRLAKADAFGPITQGLAMPMNDLSRGCVAYDIVGAVAITSVQAHCAGV

SEQ ID NO: 1274 - protein, 331 aa, Clostridium papyrosolvens DSM 2782
MNFLEQIVSRAKKDIKTIVLPESNDIRTLKAAAMIQEQGIANVVLVGNKDDIKKLGGDLDISKAKIVDPANFERFDEYVNTLYELRKAKGMTQEQAKKILSENPLYFGIMMVKMGEADGMVAGAINSTANTLRPALQILKTAPGAKLVSAFFVMVVPDCEYGENGVFIYGDSGLVENPNAEELSEIAIASSKSFKSLVQAEPVVAMLSYSTYGSAKSVLTEKVIEATKLAKEKAPELQLDGELQADAAIVPSVGASKAPGSNVAGKANVLIFPDLNCGNISYKLTQRLAKAEAYGPIIQGIAKPVNDLSRGCSAEDIVGVVAITCVQAQNS

SEQ ID NO: 1275 - protein, 358 aa, Clostridium thermocellum DSM 4150
MIIYSYKYYKYSFYDNSFGIMKGEEFMSFLEQIIERAKSDVKTIVLPESTDLRVIKAASMIVKKGIAKVVLIGNEKEIKSLAGDIDLEGVMIEDSLNSEKLEDYANTLYELRKSKGMTIEAARETIKDPLYYGVMMVKKGEADGMVAGAVNSTANTLRPALQILKTAPGTKLVSSFFVMVVPNCEYGHNGTFVYADCGLVENPDADQLSEIAISASKSFEMLVGAKPQVAMLSYSSYGSAKSELTEKVIKATQLAKEKAPHLAIDGELQVDAAIVPEVAKSKAKGSSVAGKANVLIFPDLDAGNIAYKLTQRLAKAEAYGPITQGLARPVNDLSRGCSAEDIVGVAAITAVQAQYVKA

SEQ ID NO: 1276 - protein, 343 aa, Caldicellulosiruptor saccharolyticus DSM 8903
MLNNKRKGLLKMAFIDTIIEKAKSNIKTIVLPESYEERNLKAASVVLKEKIAKIVLIGKEDEIKKEAAKFGANVDEAIFIDPDNFERFDEFVNDFYELRKNKGVTLEDAKKIMKDPMYFGVMLVYKGLADGMVSGAIHSTADTLRPALQILKTAPGVKLVSSFFIMVVPNCEYGENGVFLYADAGLNPNPTAEELADIAITSAKSFEALVGKTPKIAMLSYSTKGSAKSEMVDKVVEATRIAKEKAPDLLIDGELQADAALVPSVAKLKAPGSPVAGQANVLIFPDLNAGNIAYKLTERLAKAEAYGPITQGIAKPVNDLSRGCKAEDIVGVVAITAVQAMMK

SEQ ID NO: 1277 - protein, 333 aa, Methanosarcina thermophila
MVTFLEKISERAKKLNKTIALPETEDIRTLQAAAKILERGIADIVLVGNEADIKALAGDLDLSKAKIVDPKTYEKKDEYINAFYELRKHKGITLENAAEIMSDYVYFAVMMAKLGEVDGVVSGAAHSSSDTLRPAVQIVKTAKGAALASAFFIISVPDCEYGSDGTFLFADSGMVEMPSVEDVANIAVISAKTFELLVQDVPKVAMLSYSTKGSAKSKLTEATIASTKLAQELAPDIAIDGELQVDAAIVPKVAASKAPGSPVAGKANVFIFPDLNCGNIAYKIAQRLAKAEAYGPITQGLAKPINDLSRGCSDEDIVGAVAITCVQAAAQDK

SEQ ID NO: 1278 - protein, 333 aa, Methanosarcina acetivorans C2A
MVTFLEKISERAKKLNKTIALPETEDIRTLQAAAKILERGIANVVLVGDEADIKALAGDLDLSKAKIVNPKTYEKKDEYINTFYELRKHKGITPETAAEVMSDYVYFAVMMAKLGEVDGVVSGAAHSSSDTLRPAVQIVKTAPGAALASAFFIIAVPDCEYGSDGTFLFADSGMVEIPSVEDVANIAVISAKTFELLVQDTPYVAMLSYSTKGSAHSKLTEATVAATKLAQELAPDVAIDGELQVDAAVVPKVAASKAPGSPVAGKANVFIFPDLNAGNIAYKIAQRLAKAEAYGPITQGLAKPINDLSRGCSDEDIVGAVAITCVQAAAQDK

SEQ ID NO: 1279 - protein, 333 aa, Methanosarcina barkeri str. Fusaro
MVTFLEKISERAKKLNKTIALPETTDIRTLQAAAKALERGVANIVLIGDEANIKELAGDLDLSKAKIVNPETYEKKDEYIQAFYELRKHKGITLESAAEIMKDYVYFAVMAAKLNEVDGVVSGAVHSSSDTLRPAVQIVKTAPDAALASAFFIIAVPDCEYGSEGTFLFADSGMVEMPSPEDVANIAIISAKTFELLVQDDPYVAMLSYSTKGSAHSKLTEATIAATKLAQELAPDIPIDGELQVDAAIVPKVAASKAPGSPVAGKANVFIFPDLNAGNIAYKIAQRLAKAEAYGPITQGLAKPINDLSRGCSDEDIVGAIAITCVQAAAQDK

SEQ ID NO: 1280 - protein, 325 aa, Roseobacter litoralis Och 149
MDNAVRLNRKIVLSEGEDPRVIEAAIRARQQQIARIVLVGDSDRIVSALTQAGADDLDGIEIQDPANSAHLAEMTNTYYTLRQHKGVTPEIAAQTVQNPHVFAALMVRLGHADGTLGGAVTATAEIVRTAIQVIGTAPDAKMVSSFFLMLLNQDHHPKQGVLVFSDAGLVIEPNASEMAQIAAASAVSFSKLMGETAKVAMLSFSTKGSAGGEKVSKVVEATALLRDMAPDLIVDGELQFDAAFVPEVAAAKAPGSAVEGEANVFIFPNLDAGNIAYKVAQRIGRARAVGPVLQGLAQPANDLSRGCTADDIFDMTAVTAVQSGR

SEQ ID NO: 1281 - protein, 332 aa, Roseobacter denitrificans OCh 114
MTPLEQMMDKAVRLNRKIVLSEGEDPRVITAAIQARRRRIAQVALIGNRDRIASLLNQAGGSDLDGIEIHEPATSPHLPEMTETYFKLRQHKGVTQETASQAVLNPHVFAALMVKLGHAHGTLGGASTATAEIVRTAIQVIGTAPNAKMISSFFLMLLSEDHHPKQGIVVFSDAGLVIEPNAEEMAQIAVASANSYGQLTGETPKVAMLSFSTKGSAGGEKVSKVVEATALLRSMDPDLIVDGELQFDAAFVPDVAATKAPDSELKGDANVFIFPNLDAGNIAYKVAQRIGRARALGPILQGLAQPANDLSRGCTAEDIVDMIAVTAVQGGA

SEQ ID NO: 1282 - protein, 341 aa, Dinoroseobacter shibae DFL 12
MKPLQMILANAARSDRKIALSEGEDPRVVAAAVQARKQRVARVVLVGDRATIVARLAEAGGAELDGIDVHDPREDLHRAEMAATYHQLRKHKGVTEADAEAAILNPHVYAALLVRLGHADGTLGGATATTAEIVRTAIQVIGTAPGAKMVSSFFLMLLCKDHHEKKGGLVFADAGLVIDPTAAEMAEIGRASAASLVQLTGETPRVAMLSFSTRGSASGDKVSKVVEATEIFRQLAPEVTVDGELQFDAAFVPEVATAKAPDSAIGGSANVFVFPNLDTGNIAYKIAQRIGGAVAIGPILQGLALPANDLSRGCSAEDVLHMIATTAAQCQDVAPHHAAAR

SEQ ID NO: 1283 - protein, 344 aa, Rhodobacteraceae bacterium KLH11
MFGALKGYGMKPLEMLLGNIAGSQQKIVLSEGADPRVVQATIAARQHGIARIALVGPEQDILEQFARANATLDDGVEIHDPATSPLIGELAQAYHDRRKHKGVSLEQATAEARKPHVYAALLVKTGYADGTVGGAVVTTAEIVRTAIQVIGAKPESNLISSFFLMLFCQPHHGKKGAHIFADCALVVDPDAGEMAQIALDSANSFSALTGETPRVAMLSFSTRGSATHERVSKVAAATEISREAAPTLLIDGELQFDAAYVPEVAARKAEDSPLQGDANVFVFPNLESGNIAYKIAQRIGGASAIGPILQGLAKPANDLSRGCSADDILNLIAVTAAQAGGLEG

SEQ ID NO: 1284 - protein, 340 aa, Silicibacter lacuscaerulensis ITI-1157
MKPLRAILGAASCSDKIIALAEGDDPRVLEGALRARAERVARIILVGDRERIGTLLSDLGGAQTDGIEIHDPADSDLSEPFAEALWALRRHKGMTKEAAQEQVRNRLVFAAMLVRLGIADGTVGGAVETTSDTVRTALQIIGKAPEAAMVSSFFLMLYCREHHDFKGAHLFADCGMVVDPSAQEMAEIARASAASYKALTNKTPRVAMLSFSTSGSANHPKVSKVVEATRIAKAADPDLLIDGELQFDAAFVPEVAAQKAANSPLQGRANVFVFPSLNAGNLGYKIAQRIGGAEAIGPVLQGLAKPANDLSRGCSAEDVLHMIAVTAVQAQVSGPGTKKP

SEQ ID NO: 1285 - protein, 344 aa, Sinorhizobium medicae WSM419
MKPLDRIIETARKAPRHIVLSEGEDPRIVAGAVRARRECLAEITLVGNREVVMHRLAALDANPREFRVEDPSSSSLTDGFAASFLDLRRSKGVDEAAARVAVLTPLNFAAMMVREGLADGTVGGAVATTADTVRAALQVIGRAPGVGLVSSFFLMMLCEPHHARKGAFVFADCGLVVDPDAGGLADIALMSAKSYEQLAGERAKVAMLSFSTGGSAAHERVSKVVEATRMARCAEPDLVIDGELQFDSAFVEAVSLTKAPQSALRGEANVFVFPNLDAANIGYKIAQRIGGATAIGPILQGLARPANDLSRGCSADDVFHMIAVTVVQGREDNSTVSERRQNVT

SEQ ID NO: 1286 - protein, 330 aa, Sinorhizobium meliloti 1021
MKPLDRIIDAARKAPRHVVLPEGEDPRIVAGAVQARREGLAAITLVGNREVITQRLAALDAIPQEFRIEDPACSPLTDDFATAYLERRRSKGVDAAAARAAVLSPLTFAAMMVREGIADGTVGGAVATTADTVRAALQVIGRAPGVGLVSSFFLMMLCEPHHARKGAFVFADCGLVVDPDAAGLADIARMSAKSYEMLAGERAKVAMLSFSTGGSAAHERVSKVVEATGMARRAEPDLIIDGELQFDSAFVEAVCLTKAPHSALRGEANVFVFPNLDAANIGYKIAQRIGGATAIGPILQGLSRPANDLSRGCTAADVFHMIAVTVVQAA

SEQ ID NO: 1287 - protein, 322 aa, Ochrobactrum intermedium LMG 3301
MLPLEKIFEKARSRPRHIVLAEGEDPRIIDAALRAEREGIARITLLGSENVVGNGSSIAVIDPKTSDRSADYAHKLYQLRQAKGMTEEQAEAMVKTPLGFAAMMVREGDADGTVAGAVATTADVVRHALQIIGKGEGASLVSSFFLMLLCQTYHQKKGAFVFADCGLVVEPDAAQLADIAIQSADSYRQLTEKDAAVAMLSFSTGGSAAHERVSKVVQATRTVRDREPDLCIDGELQFDTAFVEAISHAKSPDSPLKGNANVFVFPNLEAANIGYKIAQRIGGAQAIGPVLQGLAKPANDLSRGCSADDVLHMIAITVNQAK

SEQ ID NO: 1288 - protein, 325 aa, Ochrobactrum anthropi ATCC 49188
MLPLEKIFEKARSKPRHIVLAEGEDPRIIDAALRAEREAIARITLLGSESVISRQIDGSKIAIINPETSDKSADYAQKLYRLRQAKGMTEGQAEAMAKTPLGFAAMMVREGDADGTVAGAVATTADVVRHALQIIGKAEGASLVSSFFLMLLCQSHHQKKGAFVFADCGLVVEPDSAQLADIAIQSADSYRQLTEKDAAVAMLSFSTGGSAAHERVSKVVQATRTVQERKPDLCIDGELQFDTAFVEAISHAKSPDSPLKGNANVFVFPNLEAANIGYKIAQRIGGAQAIGPVLQGLAKPANDLSRGCSADDVLHMIAITVNQAK

SEQ ID NO: 1289 - protein, 344 aa, Burkholderia phytofirmans PsJN
MKAINRIIEQARRSPMRIVLSEAEDPRVLQAAQRATREGIARILLVGDATRIREAAAGFDVDLSGMELVDPATSALASSYADELFALRSKKGMTLEQARKEILNPLCFANLMVRLGHADGSVSGAVNTTADVVRTAIQIIGIAPSFKLVSSFFLMMLCEPFHTLKGGLIFSDCALVVEPDAAQLAEIAMAAADSARSLLMDEPRVAMLSFSTSGSAHHAAVDKVVNATHIVQERRPHLAIDGDVQLDAAIVSEIALRKVKHSQVEGHANVLVFPSLEAGNIGYKLAERIGGAKAIGPLLQGLRKPANDLSRGCSADDIYYVTAVTAVQAQAALTHPDALTPSHT

SEQ ID NO: 1290 - protein, 345 aa, Burkholderia xenovorans LB400
MKAINRIIEQARRSPMRIVLSEAEDPRVLQAAQRASHEGIARILLAGDAARIREAAARFDVDLSGMELVDPAASALAASYADELFALRGNKGMTPEQAQREILNPLCFANLMVRLGHADGSVSGAVNTTAEVVRTALQIIGIAPSFKLVSSFFLMMLCEPFHTLKGGLIFSDCALVVEPDAGQLAEIAIAAADSAKSLLMDEPRVAMLSFSTSGSAHHAAVDKVVNATHMVQERRPHLAIDGDVQLDAAIVSEIALRKVKHSQVEGHANVLVFPSLEAGNIGYKLAERIGGAKAIGPLLQGLRKPANDLSRGCSADDIYYVIAVTAVQAQAALTHPDALLTPSHS

SEQ ID NO: 1291 - protein, 343 aa, Burkholderia phymatum STM815
MKPIYRIIESARQSPMRIVLCESEDARVLRAAQRATKEGIARIVLVGDSVPTRQFAAKEGIDLTGIDLVTPATSPLSREFADELFALRSKKGMTREQAQREVLNPLCFANLMVRLGHADGSVAGAVNTTADVVRNAIQIIGIRPSFKLVSSFFLMMLCEPFHTMKGGLIFSDCALVVEPDAVQLSEIAMAAADSTRALLMQEPKVAMLSFSTSHSAHHAAVDKVIEATRLVKEARPDLAIDGDVQLDAAIVAEIAMRKVHHSQVEGHANTLIFPSLEAGNIGYKLAERIGGAKAIGPLLQGLTKPANDLSRGCSEDDIYYVIAVTCVQAHAALGVLPANEHAS

SEQ ID NO: 1292 - protein, 345 aa, Ralstonia eutropha JMP134
MKPILRIIDRARAAPRRIVLCEGEDPRILQAAERAAREGIAQVILVGNAARITDAAANQGIDLPRMTIVDPATSALTPSFAQALYAMRQKKGMTLDQARQAVLDPLCFANLMVRQGHADGSVAGAVHTTANVVRNAIQLIGLAPGFRLVSSFFLMMLCEPFHALKGGLIFSDCGLVVDPDAEELSEIAMAASDSARSLLNEDPRVAMLTFSTCGSAKHAAVDKVVAATERVRAQRPGLAIDGDVQLDAAIVAEIAERKIPHSQVGGHANVLVFPNLEAGNIGYKLAERLGGAKAIGPMLQGLRRPANDLSRGCSAEDVFHVIAVTVVQAQAASAQQPSSGEQAAA

SEQ ID NO: 1293 - protein, 344 aa, Cupriavidus taiwanensis
MKPILRIIDRARAAPRRIVLCEADDPRILQAAQRAVQEGIARIVLVGDPRQINAAAAIHGIALEGMTLVDPATSALTPSFAQQLFALRQKKGMTLDEAKRAVLDPLSFANLMVRLGHADGSVAGAAHTTADVVRNAIQLIGLAPGFRLVSSFFLMMLCEPFHTLKGGLIFSDCGLVVDPDAEALADIAMAAADSARALLNDEPRVAMLSFSTSGSAHHAAVDKVVAATERVRAQRPGLAIDGDVQLDAAIVAEIAARKVAHSQVNGHANVLVFPSLEAGNIGYKLAERVGGAKAIGPMLQGLNKPANDLSRGCSADDVFHVIAVTVVQAQATAAQAPKGEQAAA

SEQ ID NO: 1294 - protein, 363 aa, Burkholderia multivorans ATCC 17616
MPCPVRAAASGRFFFCEFPMKALDRILESARRRPMRIALSEADDPRVLAAAARATRDGIAHIVLVGPRATILAAAARDGVSLDGMTLVDPAASASRDMYADTLHALRKNKGMTADVARDAVLDPLCHANLMVRLGDADGSVAGAVHATADVVRAAIQLIGVDPAFRLVSSFFLMMLCEPFHTIKGGLIFSDCALVVDPDAEQLAEIAMAAADSAQALLGETPRVAMLSFSTSGSAHHAAVDKVTAATERVRAQRPTLAIDGDVQLDAAVVAEIAERKIVHSQVGGHANVLVFPSLEAGNIGYKLAERIGRAKAVGPLLQGLRRPANDLSRGCSADDVYHVIAATTVQAQAAAQRVAASEAAPA

SEQ ID NO: 1295 - protein, 344 aa, Burkholderia cenocepacia J2315
MKALDRILESARRQPMRIALCEADDPRVLHAAARATRDGIARIVLVGDRAAIHAAAARDALDLDGMTLVDPATAPQRDAYADALHALRKAKGMTADAARDAVLDPLCHANLMVRLGDADGSVAGAVHATADVVRAAIQLIGVDPAFRIVSSFFLMMLCEPFHTIKGGLIFSDCALVVDPDAGQLAEIAMAAADSAHALLGEAPRVAMLSFSTSGSAHHAAVDKVTAATARVRELRPALAIDGDVQLDAAIVAEIAERKIAHSQVGGHANVLVFPSLEAGNIGYKLAERIGRAKAVGPLLQGLRRPANDLSRGCGADDVYHVIAATTVQAQAAMQRAATGEVAPA

SEQ ID NO: 1296 - protein, 345 aa, Photobacterium profundum 3TCK
MKAIIRIVEQAKKKPACIVLCEAEDPRVLQAAYRVTQEGIASIILVGNKSNVLRIAAEQFISLESMVVIDPKTSPLRESFSQCLFNLRSEKGMTLETAKQEVLKPLCFSNLMVRKGMADGSVSGAVHTTGDVVKNAIQIIGTKPDCKLVSSFFLMMLCQPFHHLKGGMIFSDCGLVVDPNAKQLADIALSASDSARGLLMEEPKVAMLSFSTNGSAKHTAVDKVVAASQIVQAKSPNLAIDDDVQLDAAIVAEIADKKVPGSKVKGQSNVLIFPNLEAGNIGYKLAERVGGAVAIGPLLQGLAKPANDLSRGCNTDDIYHVIAVTVVQAQQSEIVKKRAPELTIT

SEQ ID NO: 1297 - protein, 339 aa, Lutiella nitroferrum 2002
MRALTRIIEQARHAPARIALSEGEDPRVLDAAVRATREGIARIVLVGDRAAIAALAQQRGLDLSGIDFHDPADAPLQAELAQTLFELRQHKGMTREQADSAARDPLVCANLLVKTGRADGTVSGAVRTTADVVRTAIQVIGVQPSFKLVSSFFLMMLCEPFHSLKGGLIFSDCGLVVDPSASELADIALAAADSARQLLMEEPRVAMLSFSTNGSAKHAAVDKVAQAAAQVKAQRPELAIDGDVQLDAAIVAEIANRKLPDSQVKGKANVLIFPNLEAGNIGYKLAERVGGAVAIGPLLQGLAKPANDLSRGCSADDVFHVIAVTVVQAHAARETATAG

SEQ ID NO: 1298 - protein, 357 aa, Vibrionales bacterium SWAT-3
MKAIERIIDKAHLDRKRVVLSEAEDPRVLAAARLAIDKQLAHITLVGDEKAIIEAAQLHHINLAGIHIVSPQTSALKVVLAERLYELRKAKGMTYEDAFEKVKDPLIFANLMVREGLVDGTVNGAVYTTSDVVRAALQIIGPAPDSELVSSFFLMMLCEPFHNLKGGLIFSDCGLVINPNETELASIAVAASQSAEALLMEEPKLAMLSFSTNGSAKHESVDKVRSAAQIVKQRCPGIAVDQDVQLDAAIVTEIAAKKLPDSEVKGQSNVLIFPNLEAGNIGYKLAERLGGAVAIGPLLQGLNQPANDLSRGCCAEDIFNVIAVTAVQAQQGKVSGSMADTEANVEERQEPTFDFRY

SEQ ID NO: 1299 - protein, 357 aa, Vibrio splendidus 12B01
MKAIERIIDKAHLDRKRVVLSEAEDPRVLAAARMAIDKQLAYITLVGDEPAIIAAAELHQIDLVGIHIVSPQASSLKEVLAERLYTLRKAKGMTYDDALELVLDPLVFASLMVREGLVDGTVNGAVYTTSDVVRAALQIIGPAPDSELVSSFFLMMLCEPFHNLKGGMIFSDCGLVINPNETELASIAVAASNSAQTLLMEEPKVAMLSFSTNGSAKHESVDKVRNAAQLVKQRCPGIAVDQDVQLDAAIVTEIAAKKLPDSEVKGQSNVLIFPNLEAGNIGYKLAERLGGAVAIGPLLQGLNQPANDLSRGCNAQDIFNVIAVTAVQAQQGKTANSKTDLAADSEKRDESTFDFRY

SEQ ID NO: 1300 - protein, 349 aa, Vibrio shilonii AK1
MKAIERIVNKAHLDRKRVLLSEAEDPRVLTAARMAVDKQLAYVTLVGDEQTIAEAAERYHVSLAGIHIVSPQSSPLKEVLAERLYLLRKAKGMSYNDALEQVQNPLIFANLMVREGLGDGTVNGAVYTTSDVVRAALQIIGPAPDSELVSSFFLMMLCEPFHNLKGGLIFSDCGLVIDPNEAELASIAISASASAKSLLMEEPKVAMLSFSTNGSAKHESVDKVRNAAQLVKQRCPDIAVDQDVQLDAAIVTEIAAKKLPDSQVKGKSNVLIFPNLEAGNIGYKLAERLGGAVAIGPLLQGLNQPANDLSRGCSAEDILHVIAVTAVQAQQDRNIKHTPPASIKEGITN

SEQ ID NO: 1301 - protein, 349 aa, Vibrio coralliilyticus ATCC BAA-450
MKAIKRIINKAQQNRKRIILSEAQDPRVLAAARMAVDRKIAHITLVGDKQVIRDAAKLHQVSLAGVHIVSPDSSPLKEVLAERYYLLRKAKGLSYDQALQQVQDPLIFANLMVLEGLSDGTVNGAQYTTSDVVRAALQIIGPAPDSELVSSFFLMMLCEPFHNLKGGLIFSDCGLVIEPNESELASIAVAASQSARNLLMEKPKVAMLSFSTNGSAKHESVDKVRHAAQLVKQRCPDIAVDQDVQLDAAIVTEIAAKKLPDSQVKGQSNVLIFPNLEAGNIGYKLAERLGGAVAIGPLLQGLNQPANDLSRGCTADDIVNVIAVTVVQAQEENNTQPGPVDPALTSSVN

SEQ ID NO: 1302 - protein, 318 aa, Paracoccus denitrificans
MKPLDRIHEAAKALDRHIILPEGEDPRVAKAARRLLAGGLARVTLMGGPEIPGAGRIDPAGAPDLAELADHWHRMRAARGMTAERALTEMRDPIRQAAMRVRLGQADGTVGGAVATTADTVRAALQIIGKAPGAGIVSSFFLMLSCGPGAPVRGGMIFADCGLVIQPDARELAAIALSAADSCRRILAEEPRVALLSFSTAGSAEHPSLGRIREALALIRAAAPGLEVDGEMQFDAALDDAIRARKAPESPLTGRPNVFVFPDLAAGNIGYKIAERLAGLTAIGPILQGLAKPANDLSRACSVQDIVNATAITAMQTK

SEQ ID NO: 1303 - protein, 332 aa, Rhodobacter sphaeroides 2.4.1
MKPLERILATARAHPRHILLPEGEDPRVAQAARRLTEEGLARVSLMNGPEIAGVTRICPAEASDLPELADRWHLMRAAKGMTGAQALIEMRDPIRQAAMRVRMGLADGTVAGAVATTADTVRAALQIIGRAEGAPLVSSFFLMLACEGGAPIRGGMIFADCGLVVDPDAEGLAAIARASAESSRTLLGEEPRVALLSFSTAGSADHPSLGKIREALRLIRATDPTLEVDGEIQFDAALDEAIRARKAPGSRLTGRPNVFIFPDLASGNIGYKIAQRLGGLGAVGPILQGLARPANDLSRGCTVEDIVHAAAITAVQAAPDPAAAPEGLAAAR

SEQ ID NO: 1304 - protein, 322 aa, Alcaligenes defragrans
MRAQDMLLDAARRDPKRIVLCEGDDPRVKAAARRAAADGIAQVLLLGSSEDVPGVHGIRPADSGWLDAFAEELLSLRRARGMTPEQAREAVRQPLVFAALMVRLGHADGSVAGAVHTTADVVRTAIQVIGKRPGVRTVSSFFMMMRDEPFPTGEHAMVFSDCGLVIEPDSRELAEIALASARSARTLLGIEPRVAMLSFSTHGSAAHQQIDKIREAMALARRQAPDLLIDGEMQLDTAIVPEVARRKWPQSSVAGQANVLVFPSLDAGNIGYKLVERLGHATALGPILQGLDKPANDLSRGCSADDIHQVIAVTAVQAAWTD

SEQ ID NO: 1305 - protein, 328 aa, Roseovarius nubinhibens ISM
MLLAAPPANRATIALSEGEDPRIVEGALAAQAAGAADIILVGQGDAVRAELTRQGAEEGPGIAVHDPETSDLTDSFAKSFHALRQHKGVDEAAAARAVRAPLTYAAMLVREGHATGTVGGAVATTSDVVRTALQVIGKAPDAAMVSSFFLMYPPEGTETGRTMLYSDCGLVIDPAADELAEIAAMSARSCRALMREEPKIAMLSFSTMGSAKHDRVTKVTDALATLRARHPDLEADGELQFDAAFVPSVGTAKAPGSAVAGQANVMIFPNLDAGNIGYKLTQRLGGYAAIGPILQGLAHPANDLSRGCVAEDVTQMIAVTVLQSMAAG

SEQ ID NO: 1306 - protein, 337 aa, Ruegeria pomeroyi DSS-3
MMTQTPIDLLLSDPPARRATVALSEGSDPRVVAGALAAHSAGIADVILVGQAAEIRAALKAQGAPADSLTIHDPDSSPLTAEFAAAYYGLRRHKGVSEAAALAAVRTPLVYAAMLVRGDHAVGTVGGAVATTSDVVRTAIQVIGAAPGAAMVSSFFLMYPPEAATAHARAMLYSDSGLVIDPSVAELAAIAAASAASCRALLRAEPKIAMLSFSTKGSARHPHVSKVTDALARLRADHPDLDADGELQFDAAFVPSVGASKAPGSDVAGQANVMIFPNLDAGNIGYKITQRLGGYTAIGPVLQGLAKPANDLSRGCVAGDVTQMIAVTVLQAMAQTQ

SEQ ID NO: 1307 - protein, 329 aa, Roseobacter sp. AzwK-3b
MLLSQALATRCKIALSEGSDPRIVAGALAAQRQGLADVILVGDAAAVRKELEAQGAKEGDGVSVEDPATSPLTNGFVAVFEDLRRHKGIDAEAARKAVLSPLVFAAMLVREGHADGTVGGAVATTSDVVRAALQVIGKAPDAALVSSFFLMYPPSNATPHARAMVYSDSGLVIDPNPIELASIAAASARSCRTLLREDPKVAMLSFSTKGSARHPRVSKVTEALDHLRTKHPDLDADGELQFDAAFVPSVAATKAPGSTIAGQANVMIFPDLDAGNIGYKMTQRLGGYSAIGPVLQGLVKPANDLSRGCVAEDVTQMIAVTVLQALDRS

SEQ ID NO: 1308 - protein, 339 aa, Roseobacter sp. SK209-2-6
MTQALSPSALLGQTPASSRAVIALSEGSDPRIVAGAIKARSLGLADIVLVGATAEVEAELSAQGTSSGPGLTIQDPAKSPFTSDFSKSFHALRKHKGMTPEKAAEMVQDPLVFAAMLVREGHATGTVGGAVATTSDVVRTALQVIGKAPDAAMVSSFFLMYPPKNATAHSRAMLYSDCGLVIDPSAEDLVAIASASALSCQNLLRQEPKIAMLSFSTKGSARHPAVTKVSEATAALHQTRPELQVDGELQFDAAFAPEVGEKKSPGSSVAGQANVMIFPNLDAGNIGYKISQRLGGYSAIGPILQGLAQPANDLSRGCSAEDVVEMIAVTVLQAQNAGS

SEQ ID NO: 1309 - protein, 313 aa, Roseobacter litoralis Och 149
MSEGTDPRVVEGAVTAVKSGIARITLIGPEDAVQAALVRAGLPNAPAIAIEDPENSALTDEVATALHDIRKHKGMTPQVAARRAQDPLVFAAMMVRLGYADGTVGGAVHTTSDTVRAALQVIGKAKDAPLVSGFFLMALPENHPSGRDAMIFSDCGLVIDPTCEELAAIAVASAASCRHLLGKEPRVALLSFSTKGSAHHEKVSKVTDALDLLKQNHPTLKADGELQFDAAFVPAVAASKAKDSEVAGTANVMIFPNLDAGNIGYKIAQRIGGCDAIGPVLQGLAKPANDLSRGCVASDVTNMIAVTVLQARA

SEQ ID NO: 1310 - protein, 335 aa, Jannaschia sp. CCS1
MGGGPDDPLAAIAARAAADIKHIVLSEGSDPRVQDAARVAAETGLARVTIVGPSALAGQIGGAVAVEDPDTSPHLPAFAKAFHALRAHKGVTEEQAAEIVRQPLVFAAMMVRESLADGTVGGAVHTTSDTVRAALQVIGNAKGAALVSSFFLMALPKGHPTGEQGMIFSDCGLVIDPSTEELAAIAQQAAASAQTLLGTPPRVAMLSFSSKGSARHPSVDKVVQATALVQAAAPDLDIDGELQFDAAIVPSVGASKASGSAVAGHANVLVFPNLDAGNIGYKIAQRLGGATAIGPVLQGLAKPANDLSRGCTADDIVQIIAVTAVQAQAQAQASS

SEQ ID NO: 1311 - protein, 350 aa, Rhodobacterales bacterium HTCC2083
MSSKTNPSALLDEANTLPPLASLLTRAAAAPKSIAFAEGSDPRIVEAAVAALNAGVIKQAHLVGSQADVETTLATFELLDTSRIEIHDPENSRIFDALAERFVELRAHKGLTIELAQKATLDPLVFAALLVETGRADGSIGGAIATTSDTVRAALQVIGKAKSEPLVSSFFLMILPESHPLDRPAMVFSDCGMVIDPNATELAGIASQAADSFAALVGDAPKLGMLSFSTHGSAKHDRVTKVQEATKALKVARPDLTVDGELQLDAALVPSVAASKAPSGAVQGEANVLIFPNLDAGNIGYKLAQRFGGAVAIGPVLQGLAKPANDLSRGCVAGDVLAMIAVTALQAQTS

SEQ ID NO: 1312 - protein, 331 aa, Solibacter usitatus Ellin6076
MAAIPESAKLFMSGLIERARKLKKTIVFPEGADPRVLEAAARLAREGVVKPVLIGPRPANAPEGVEFTDPAHSPLLKKYADLYYERRRAKGTTQVEAAAVAKKPLYFASLMVGAGDADGSVGGAVNSTAETVRAALHAVGVHPRARLVSSVFIMALQDLSQGHNGLMAFADCAVVIEPNAMQMADIAIATAESTRVLIDAEPAVALLSFSTRGSGRGPMVSKVVEAMQILKARAPELNADGELQADAAVDLMVGKSKAPGSKVAGRANTLVFPSLESANIGYKLVERLGGAMAIGPFLQGLAKPANDLSRGCSAEDIFNVAVVTALQSEIH

SEQ ID NO: 1313 - protein, 333 aa, Desulfuromonas acetoxidans DSM 684
MHLVDQIKAKARTNQQTVVLPEGYDDRMVQAAGKIVADGLANIVLLGNEATLQAKAAELGVTLDGVTILEPAAAPQLEDYVAELVELRKKKGLTPEQARELLTAEDNLYFASMMVRKNDAGGAVAGAFNTTGDVLRAAFQVIGTAPGMKTVSSVFLMVTKNPDFGENGILLFADCAVNPNPDAKALAEIAVSTASSCKSFLGVDARVAMLSFSTKGSAKHEDADKVLEAMAMAKELNPQLQIDGELQADAALLPKVGEKKAPGSVVAGKANTLIFPDLDAGNIGYKLVERVAGAEAVGPIIQGLAKPVNDLSRGCSVDDIISVSAITAVQAQG

SEQ ID NO: 1314 - protein, 333 aa, Pelobacter carbinolicus DSM 2380
MHLADQIKAKARENRQVVVLPEGYDDRMIQAAGPIVKDNLADVVLLGEPAALQAKATELGVSLEGVTLLDPKSAPQLDTYADELVEIRKKKGLSKDDALKLLTADDNLFFATMMVRQGDAGGCVAGAYNTTGNVLRAAFQVIGPAPGMKTVSSCFIMVTKTPEFGENGALIFADCGVNPNPDAAALAEIAVSSAQSCKSFLGAEARVAMLSFSTKGSAKHEDPDKVIAALAIAKEKAPELQIDGELQADAALVPAVGNSKAPGSNVAGKANTLVFPDLDAGNIAYKLVQRLAKAEAFGPIIQGLAKPVNDLSRGCSVDDIISVTAITAVQAQG

SEQ ID NO: 1315 - protein, 333 aa, Geobacter sp. FRC-32
MHLMEQIKAKAKKNLQTVVLPESYDERMLFAAQKIVEQGLAKIIILGNQTEVSAAAQNKGVNLAGVEILDPATSPKLEAYIDALVELRKSKGLTREEARNLLTAKDYLYYAGMMVRLGDAGGEVAGATGTTGNVLKAAFQTVGTAPGIKTVSSFFLMVTKNTDFGENGIVLFADCAVNPNPDAQALAEIAVATARNCKSFLDVPARVAMLSFSTKGSAAHADVDKVLKALEIARGIDPSLQIDGELQADAALLPKVGEKKAPGSPVAGKANVLVFPDLDAGNIAYKLVERVAGAEAIGPVIQGLAKPVNDLSRGCSVDDIVNVAAITAVQAQG

SEQ ID NO: 1316 - protein, 333 aa, Geobacter uraniireducens Rf4
MHLMEQIKAKAKKNLQTVVLPESYDERMLFAAQKIVEQGLAKIILLGNPAEVSATAQAKGVNLAGVEILDPTASPKLNAYVDELVELRKSKGLSKEEATKLLTDKDNLYYAGMMVRMGDAGGEVAGATGTTGNVLKAAFQTVGTAPGIKTVSSFFLMVTQNPDFGENGILLFADCAVNPNPDAQALAEIAVATARNCTSFLDVPARVAMLSFSTKGSAAHADIDKVLKALEIAKGIDPALQIDGELQADAALLPKVGEKKAPGSTVAGKANVLIFPDLDAGNIAYKLVERVAGAEAIGPVIQGLAKPVNDLSRGCSVDDIVNVAAITAVQAQG

SEQ ID NO: 1317 - protein, 333 aa, Geobacter sulfurreducens PCA
MGLMDQIRAKARNNLQTIVLPESYDDRMYAAAQQIVEQGLAKVVMLGNADTIARKAADLGATISGVELIDPATSPKLNEYADAFVELRKSKGLSKDDALKLLTAADNLYYAGMMVRQGDAGGEVAGATGTTGDVLRAAFQTVGPAKGIKTVSSFFFMVTKTPSFGENGIIFFADCAVNPNPDAQALADIAVATARNCKAFLDVDARVAMLSFSTKGSASHADVDKVLKAMELAKAIDPALQIDGELQADAALLPKVGERKAPGSTVAGKANVLIFPDLDAGNIAYKLVERVAGAEAIGPIIQGLAKPVNDLSRGCSVEDIVNVAAITAVQAQG

SEQ ID NO: 1318 - protein, 333 aa, Geobacter metallireducens GS-15
MGLMDQIKAKARNKLQTIVLPESYDDRMYAAAQQIVEQGLARVVMLGNADAIAKKAADLGADISKVELIDPASSPKLSDYADALVELRKSKGLTKEEALKLLTAADNLYYAGMMVRQGDAGGEVAGATGTTGDVLRAAFQTVGPAPGIKTVSSFFFMVTKTPSFGENGIIFFADCAVNPNPDAQALADIAVATARNCKAFLDVDARVAMLSFSTKGSATHADVDKVLKAMELAKGIDPALQIDGELQADAALLPKVGERKAPGSAVAGKANVLVFPDLDAGNIAYKLVERVAGAEAIGPIIQGLAKPVNDLSRGCSVDDIVNVAAITAVQAQG

SEQ ID NO: 1319 - protein, 334 aa, Pelobacter propionicus DSM 2379
MHLVDQIKAKAKKNLQSVVLPESYDERTLYAAEKIIKEGLAKPIVLGDPAKIQAEAKAKGIDLSGVELLDPATSPKLDQYVADLVELRKSKGLTAEDAKKLLTAPDYLYYAGMMVRNGDAGGEVAGATGTTGNVLKAAFQTVGPAKGIKTVSSFFLMITKTPSFGENGIVLFADCAVNPDPDSQALAEIAIATAGNCKAFLDVDARVALLSFSTKGSANHPNVDKVAKALEIAKQLKPDLQIDGELQADAALIPKIGEKKAPGSSVAGKANVIVFPDLGAGNIGYKLVERIAGAEAVGPVIQGLAKPVNDLSRGCSVDDIVNVTAITAVQAAQS

SEQ ID NO: 1320 - protein, 333 aa, Geobacter lovleyi SZ
MHLVDQIKQKAQKNLQTVVLPESYDERMLYAAEKIVAEGLAKLVILGDPAKIQAEAAAKGINLAGVELLNPADSPKLDQYIADFVELRKSKGMTAEEAKKLLTADDNLYYAGMMVRNGDAGGEVAGATGTTGNVLKAAFQTVGPAAGIKTVSSFFLMITKTPSFGENGIILFADCAVNPNPDAQALAEIAVATAGNCKAFLDVEARVGMLSFSTKGSAAHADVDKVTKAAEIAKTIKPDIQIDGELQADAALLPKVGEKKAPGSPVAGKANVLIFPDLDAGNIAYKLVERVAGAEAVGPIIQGLAKPVNDLSRGCSVDDIVNVVAITAVQAGA

SEQ ID NO: 1321 - protein, 333 aa, Geobacter sp. M18
MPLVKQIHEKAKSKLKTVVLPESYDERMLFAAQQIVEQGLAKIILLGKPEALQATAAEKGISLSGVEVVDPATSPKLDGYVGKLVELRKSKGLTPEQAQQLLTASDNLYFAGMMVREGDADGEVAGATGTTGDVLRAAFQTVGPAPGIKTVSSFFLMATQTPNYGENGVILFADCAVNPNPDAQALAEIAIATARNCKSFLDVPARVAMLSFSTKGSASHPDADKVLKALEIAKGMDPELSIDGELQADAALIPAVGAKKAPGSGVAGKANVLVFPTLDAGNIAYKLVERLAGAKAIGPVIQGLAKPVNDLSRGCSVQDIVDVTAITAVQAQG

SEQ ID NO: 1322 - protein, 333 aa, Geobacter sp. M21
MPLVKQIHDKARGNKKTVVLPESYDERMLYAAQAIVEQGLAHIILLGKPEAIKAAASEKGINLAGVEIIEPAASDKLAGYVAKLVELRKSKGLTADQARELLCGADNLYFAGMMVREGDADGEVAGATGTTGDVLRAAFQTVGPAPGIKTVSSFFLMATKSPEFGENGVILFADCAVNPNPDAQALAEIAIATARNCKSFLDVPARVAMLSFSTKGSASHPDADKVLKALELAKGMDPNLSIDGELQADAALIPAVGGKKAPGSNVAGKANVLVFPDLDAGNIAYKLVERIAGAKAIGPVIQGLAKPVNDLSRGCSVQDIVDVTAITAVQAQG

SEQ ID NO: 1323 - protein, 333 aa, Pelobacter carbinolicus DSM 2380
MDVISQIKQKARGCMQTIVLPESYDDRMLLAADQATREGLARIVLLGDPESVASRAASVGADLNGVELVAPAASSCLRDYVEQLVELRRHKGLTEDAACKQLLALDNLFFAAMMVRKGDADGAVAGAFNSTGDVLRAALQVVGTAEGIRTVSSVMLMVTTNPDLGVNGTLLFADCVVNPRPDARALAEIAVTTARSCRSLLGVEARVAMLSFSTQGSADHEEVDKVRQAVEIARSLAPDELIDGEMQLDAAIAPSVAGKKAPDSLVAGHANTLVFPDLNAGNIGYKLTERIAGARAAGLMVQGLARPVNDMSRGCTVEDIVSTVAMTAVQACG

SEQ ID NO: 1324 - protein, 329 aa, Denitrovibrio acetiphilus DSM 12809
MSLMEKFWNIAKSRNKTIVLPEGEDERTVDAANAIAENGLCKIILLGNDVQIRKAFESKGYEVRCEIIDPEKSEYLEDFTNTYYESRKAKGLTKEEALESMKDVLYFGAMLVQKGIADGAVTGACHTTGDVLRAAIRIIGTKPGMKTVSSCFIMVLPKPEFGEDGAVVFADCAVNPNPDAKTLGEIAVAAAASCKSFLEVEPKVAMLSFSTKGSAEHDDVEKVREAVKAAKELAPELSVDGELQADAALLEAVGAKKAPGSDVAGKANVLVFPTLDAGNIGYKLVERLAGAEAIGPVIQGLAKPVNDLSRGCKYMDIVNVAAITAVQAD

SEQ ID NO: 1325 - protein, 335 aa, Chloroherpeton thalassium ATCC 35110
MEVIRKIRERAKSKKATIVLPEADDDRTLIAASELAEMELVKPVLIGNSDDIIERFSALGLTYNSTKIRIVDIQKSGKLSDFTNEYFNFRKHKGISYEEAKSVMSSPLFFGAMMVHHQEADGCVAGAVSTTADVLRAGIQIIGIEKEKARLISSFFLMVFPDDHRAAPGRALTYADCAVLPDPDAEALADIAILTAESHQQLTGEEPKVAMLSFSTKGSAAHENVTKVQKATEIAKQKQPDLKIDGEMQFDAAFIEAIGKRKAPQSDVAGKANVFIFPNLDAGNIGYKLTERLASATAIGPIIQGLVKPMNDLSRGAKPSDIVDVCCICALKKQS

SEQ ID NO: 1326 - protein, 336 aa, Victivallis vadensis ATCC BAA-548
MSILNTLVERARKGAKVIVLPEGQDARVVAAANKAVDEKVVTKAIVLGSEAEIAEACAKAGVTERKFECVDYLNSPLYNDFVAEFTEMRKAKGMTPEKAAKTMQSRIYFGAMMCRRGLADGLVAGSIASTADMLRAAFHCIGTAPGMKIASSTFVMDLKTPAPAGDDVLLFADCGVNPNPDANQLVDIALATSNTYRALLGKTPKVAFLSFSTKGSADHEILNKVKEAAAMMQQKIADEKLDILCDGELQADAALVPSVAAAKAPGSPVAGAANVLIFPDLNAGNIGYKLVQRLAHADAYGPVLQGLAKPLNDLSRGCNSDDIFGQIVITVCQTMK

SEQ ID NO: 1327 - protein, 532 aa, Helicobacter pylori 98-10
MLQLNKNDNFREIGVQGLWIYPEDTEVLGVACKSLLKVLKSHYQKIALFSPVDGGCEDLEECESLNSLEFHSAINKQKALELVSTAQEELLFETILKRYDELQTTHDFVISLGYAPKFFLNALLDLNTILAKHLNAPVVAVAQTSLEYLKAMHSHVLKKEAPFAVGLFAGEMLEKPNFLSASFCKQQCELEADLIESVLQTKSKITTPLAFQMGLEKKAKKQIKKVVLPESEDERILKAAHRLNAMGAVGLILLGDKEAINSQAKNLNLNLENVEIIDPNTSHYREEFASNLYELRKSKDLSEQEAKQLVLDKTYFATMLVHSGYAHAMVSGVNHTTADTIRPALQIIKTKPGVSLVSSVFLMCLDTQVLVFGDCAIIPNPSPKELAEIAITSAQSAKQFNIAPKVALLSYATGNSAQGEMIDKINEAREIAQRLDPQLEIDGPLQFDASIDKSVAKKKMPNSQVAGQASVFIFPDLNAGNIAYKAVQRSAKAVAIGPILQGLNKPINDLSRGALVEDIINTVLISAIQAQD

SEQ ID NO: 1328 - protein, 518 aa, Helicobacter pylori B38
MQGLWIYPEDTEVLGVACKILLKALKPRYQKIALFSPINGGCEGFWECESLNSLEFHSAIDKQKALELASTAQEELLFETILKRYDELQTTHDFVISLGYVPKFFLNALLDLNTILAKHLNAPMVAVAQTSLDHLKAMHSHILKKEAPFAVGLFAGEMLEKPDFLSASLCKQQCELEADLIESVLQTKSKIITPLAFQMSLEKKAKKQIKKVVLPESEDERILKAAHRLNAMGAVGLILLGDKEIINSQAKNLNLNLENAEIIDPNTSHYREEFAKSLYELRKSKGLSEQEAKQLVLDKTYFATMPVHSGYAHAMVSGVNHTTAETIRPALQVIKTKPGVSLVSSVFLMCLDTQVLVFGDCAIIPNPSPKELAEIATTSAQSAKQFNIAPKVAMLSYATGNSAQGEMIDKINEALTIAQRLDPQLEIDGPLQFDASIDKSVAKKKMPNSQVAGQASVFIFPDLNAGNIAYKAVQRSAKAVAIGPILQGLNKPINDLSRGALVEDIINTVLISAIQAQD

SEQ ID NO: 1329 - protein, 518 aa, Helicobacter pylori Shi470
MQGLWIYPENTEVLGIACKSLLKALKPRYQKIALFSPIDGGCEGFLGCDGLSPLEFHSAIDKQKALELASAAQEELLFETILKRYDELQTTHDFVIGLGYAPKFFLNALLDLNTTLAKHLNAPIVAVAQTSLERLKAMHSHAIKKEAPFAVGLFAGEMLEKPNFLSASLCKQRCELEADLIESVLQTKSEITTPLAFQMGLEKKAKKQIKKVVLPESEDERILKAAHRLNAMGAVGLILLGDKEAINSQAKNLNLNLENAEIIDPNTSHYKEEFANNLYKLRKSKGLSEQEAKQLVLNKTYFATMLVHLGYAHAMVSGVNHTTADTIRPALQIIKTKPGVSLVSSVFLMCLDTQVLVFGDCAIIPNPSPKELAEIAITSAQSAKQFNIAPKVALLSYATGDSAQGEMIDKINEAVTIAQHLDPQLEIDGPLQFDASIDKSVAKKKMPNSQVAGQASVFIFPDLNAGNIAYKAVQRSAKAVAIGPILQGLNKPINDLSRGALVEDIINTVLISALQAQD

SEQ ID NO: 1330 - protein, 519 aa, Helicobacter pylori J99
MQSLWIYPEDTEVLGAACKSLLKALKPRYQKIALFSPISGGCEGFGECESLSSLEVHSAIDKQKALELVSTAQEELLFETILKRYDELQSTHDFVINLGYAPKFFLNALLDLNTILAKHLNAPVVAVAQTSLDHLKAMHSHILKKEAPFAIGLFVGETLEKPHFLSASLCKQQCELEASAIENLLQTKSEIITPLAFQRSLEKKAKKQIKKVVLPESEDERILKAAHRLNLMGAVGLILLGDKEAINSQAKNLNLNLENVEIINPNTSHYREEFAKSLYELRKSKGLSEQEAERLALDKTYFATMLVHLGYAHAMVSGVNHTTAETIRPALQIIKTKPGVSLVSSVFLMCLDTQVFVFGDCAIIPNPSPKELAEIATTSAQTAKQFNIAPKVALLSYATGNSAQGEMIDKINEALTIVQKLDPQLEIDGPLQFDASIDKGVAKKKMPNSQVAGQASVFIFPDLNAGNIAYKAVQRSAKAVAIGPILQGLNKPINDLSRGALVEDIVNTVLISAIQAQDY

SEQ ID NO: 1331 - protein, 507 aa, Helicobacter acinonychis str. Sheeba
MQSLWIYPENTEALKIACESLLKALKPRYRSMALFAPIMDKEIFSKMHSAMDKDKALELVSASRETLLFENILKKYDEIQSMHDFVICLGYVPDFFLNALLDLNTTLAKHLNAPIVAVAQTSLEYLKAMHFHAIKKEAPFALGLLTGEMLEKPDFLSASLCKGVLEADLIEKLLHTKSALITPLAFQRSLEKKAKKQIKKVVLPESEDERILKAAHHLNAMGVVELVLLGDKETIHSQAKNLNLNLENIEIIDPSASHHREAFAQKLHELRKSKGLSEQEAQKLILDKNYFATMLVYLGYAHAMVSGAIHTTADTIRPALQIIKTKPGVSLVSSVFLMCLDTQVLVFGDCAINPNPSAQELAEIAITSAQSAKQFNIAPKVAMLSYATGNSAQGEMIDKINEAVKIAHKLDPQLEMDGPLQFDASMDKSVAKKKMPNSQVAGQASVFIFPDLNAGNIGYKAVQRSAKAVAIGPILQGLNKPVNDLSRGALVEDIINTILISAIQAQD

SEQ ID NO: 1332 - protein, 511 aa, Campylobacter jejuni subsp. jejuni CG8486
MFHIYKFKEKMMANLYLMRSRSDELNTIISTNLLKNYSKIYKNIAIYCPVIYIHRVPVLQGWLEEFNINQTVKSAYGFTFREAMEEFSKDPHNFFNVILEEYEELKRKYDFVLVNSFCEFGILDGFDLSIKLAKNLNTPIAAIINDEDKLIAQKYFDHALDGRNYVLINENFNFEEVQKLEEYDFITPHRFKYELIKQSVKNKKTVVLPESNDERILKAAEILLKSKVVDLILLGDEEKIKQDATRLSLDLSAMQIMNPLNSEYNQEFTSILYETRKSKGMSLEEAKMLVQDKTYFGTLLIHTGKADAMVSGASTTTAETIRPALQLIKTKEGISSVSGIFFMGLEDQVLAFADCAVNPSPSAEQLATSAYVSAMTAKSFGLEPRIALLSYSSGDSGKGESVDLVKEALKIAKEKYPELNIDGPMQFDCAYDPKTAAKKMPNSKIAGHANVYIFPDLNAANICYKAVQRTANALAIGPILQGLKKPVNDLSRGCLVDDIVDTVILSAIQAQ

SEQ ID NO: 1333 - protein, 500 aa, Campylobacter coli RM2228
MANLYLMRSRSDELNTLATTKLLKNYSKIYKNIAIYCPVIYVHRIPVLQGWLEEFDIKQTLKNAYSFTFREAMEEFSKDPHSFFNTILEEYEELNRKYDFVLVNSFCEFGILDGFDLSIKLAKNLNTPIAAIINNEDKLIAQKYFDEALDGRDYALINENFNFEEMHKLQAYDFMTPHRFKYELIKKSVKNKKTVVLPESNDERILKAVEILLKSSVVDLILLGDEQDIKQKADELALDLTAVKILNPLHSEYNEEFATLLYEARKSKGMSLEEAKELVKDRTYFGTLLIHSGKADAMVSGASTTTAETIRPALQIIKTQEGVDSVSGIFFMGLDDKVLAFADCAVNPNPNAEQLAASAYVSAMTAKSFGIEPRIALLSYSSGDSGKGESVDLVKEALRIAKEKYPELNIDGPMQFDCAYDPKTAAKKMPNSKIAGNVNVYIFPDLDAANICYKAVQRTANALAIGPILQGLKKPVNDLSRGCLVDDIVDTVILSAIQAQ

SEQ ID NO: 1334 - protein, 500 aa, Campylobacter upsaliensis RM3195
MANLYLMRSKSDDLNTLITKKLLANYTKHYKNVAIYCPVIYVHRIAAVQEWLEEFNIKQSSKESYGFTLRDAMNTFSHDSHYFFNKILEEYENLKAKYDFVLVTSFSEFGILDGFELSVKLAKNLNTPIAAIIDQKDQNIAKKIFDESLKGEKYALIDANFDFNELINLKEYEFITPNRFKFELIKKSVKNKKIVVLPESDDERILRASEILLRSNVVHLILLGNETKIKEDALKLGLDLNGIEVLDPANSPLCEEFSAMLYEARKAKGMSLEEAAKLVKDRTYFGTLLVHSQKADAMVSGASTTTAETIRPALQIIKTKEGINSVSGIFFMGLEDKVLAFADCAVNPNPTAEQLAQSAYVSALSARAFGLEPRIAMLSYSSGDSGKGESVDLVNEALKIAKEKYPDLQIDGPMQFDCAYDSKTAAKKMPNSTIAGKANVYIFPNLDAANICYKAVQRTANALAIGPILQGLKKPVNDLSRGCLVEDIVDTVILSAIQAQ

SEQ ID NO: 1335 - protein, 489 aa, Campylobacter lari RM2100
MKSMFLINCVDEKFLTQSLEKVQGKIAFYFPVFCEKNKEKIALICSKTNFKLDFFSSFEKNNYQSKFTQNSNDFFKKIIQDYEKLKKENDFVIVVGVDDFGLMGDLSLNIALAKELNAPLYAKSQDENHTMLNFLLSQKLSDFVLLKESEDFTQDLLQEYTYKTQARFSYELFEKAKADKKIVVLPESFDERVLKASEFLMQNEIVDLILLGDSNEICAKANSLNINIDGVRIINPKNSQYNEEFEELLYEARKSKGMSKEEAKKLVQDKTYFATLLVHTQKAHAMVSGASTTTAETIRPALQIIKTKPDVSLVSGMFFMSLEDKVLVFADCAVMPNPSPEQLAEIAYVSANSAKAFGLEPKVALLSYSSGDSGSGASVDAIKEASKIAKEKYPQLELEGPIQFDAAYDMLTAKSKMPNSKVAGRANVYVFPDLNAANICYKAVQRTANSLAIGPILQGLKKPINDLSRGCLVEDIVNTVILSAIQAQE

SEQ ID NO: 1336 - protein, 478 aa, Campylobacter hominis ATCC BAA-381
MNGIFVLAQNEVAKNLAFLPKVLTSNFVKITKLQIKEGEQNSAVLKKYIKDFNELSAKNDFVVVIGADFIDKIGFNAKIANVLNLPIISVCDSENSAKTVGEILKENKSNDFAKVYNEICDFGNFKFKIQQIEQNPEIFINELNSNSVNIVTPLKFETKLYEMAAKNVKRVVLPESDDDRILKAADIVLKSNAVEITLLGKKDEISKRAKELDLNLSNAQIIDPENNEFLNEFANTLYELRKAKGMDLKKAQKLVRDRTYFGTMLVYCGKCDAMVSGASTTTAETIRPALQTIKMKPGVSTVSGAFLICLDTNVLLFADCAITPNPTVDQLAAITISSANTAKAFGIDPKVAMLSYSTGTSGSGEDVDFVVNATAKVRELAPNLNVEGPLQFDAAIDKTVAKKKMPDSKVAGKANVFIFPNLNCGNICYKAVQRTSGALAIGPILQGLKKPVNDLSRGCLVKDVINTILISAIQAGDN

SEQ ID NO: 1337 - protein, 532 aa, Campylobacter gracilis RM3268
MNGILLLCDEPAAYQSELKKLDKILSMSFHNVLQLCIAGDNALFSRSELEKALADGQDERVRKAAIERFTQILEQCNFVLVHGVAGADLRELNLQIAKDLNIPVCGFYPNEIAARIGTRLIAAAKAISFASVYEDKISFSALRSAQEGANSKKSELCGKNSACEKGAKFHDENSACQSGAIELDKVIADKSYFTDAANSTRCEILTPLKFESKLYAKARANVKTVVLPESDDERILRAAAIIKQSGAANLILLGRQDEVQKSANKLGLDLSGVKILDPQTDASLEKFARDLYELRKAKGMSEAQARDLVRDRTYFGTMLVYEGLSDAMVSGAGTTTAETIRPALQIIKTKPGIATVSGAFIMCLDTQALLFADCAVAPSPSAEYLAGIAISSAATAKAFGLEPRVAMLSYSSGDSGSGESVEFIKTATQKAREKAPDLTIDGPLQFDAAVDAAVAKKKMPGSAVAGRANVFIFPDLNCGNICYKAVQRTAGAVAIGPILQGLKKPVNDLSRGCKVADIVNTILISAIQAGEN

SEQ ID NO: 1338 - protein, 464 aa, Campylobacter fetus subsp. fetus 82-40
MLKAIYILESDYQNDKFRQNLLKELSEISNKNTIFFPISDINEKNCNTFLTKSEAKEILKNGKKNQLIKSIISKFDSIDANFIVIVGSSIESLDADIAKNLNAPFYLSPESEFKKDILGFTYINDINEIKTANSSCITPLKFEKMLFDRAKSNLKTVVLPESNDDRVLKATQILLENEAVNIILLGEKINIEERAKFLNLNLEKAVIINTKDNAYKDDFTNTLYELRKSKGMELEKAKSLMEDRTYFGTMLVYKGVADAMVSGASTTTAQTIRPALQFIKMKPGISNVSGSFIVCLDTKTQIYADCAITPNPTTDQLANIAISTAKTAKNFGLDPKVAMLSYSTGDSGCGEDVNFIIEATKKAKELDPNLKIEGPIQFDAAVDKAVAAKKLPNSAVAGNANTFIFPNLNCGNICYKAVQRTANAIAIGPILQGLNKPVNDLSRGCLVEDIVNTVLISAIQSQGE

SEQ ID NO: 1339 - protein, 455 aa, Campylobacter concisus 13826
MKSCYIFSDKNLAYLQEIIATKFKKVEIFKITPDENDKKNLINLNEKEFFLKFIDKFEELKAKSDFVIVVGCEGFSVFGKSELNLKLARNLNAPIFDENANELRALNLNSKLLITGNFYEILSYNAEIITPFKFQSLLLKRAKTANKTVVLPESDDERILKAAHIVLEKGVANIILLGRESEISKKAATLGLNLSKAKVIEPVQNELTSEFAKKIYELRKHKGVDKAKANALAKDKIYFATMLIHEGIADALVSGATMSTADTIRPALQIIKTKPNVSVVSGAFFMALEEEILLFADCAVTPNPSADELASITLSSAQTASAFGLSPKIAMLSYSTADSGSGADVEFVKEAAKKAHELDVNLKIAAPIQFDAAVDLSVASKKMPNSDVAGQANVFIFPNLDCGNICYKAVQRSANALAVGPILQGLKKPVNDLSRGCLVEDVVNTILISAIQAGE

SEQ ID NO: 1340 - protein, 456 aa, Campylobacter curvus 525.92
MNSCYIFSDENLAYLKGIISTKFKKVAVLQIKISNEEQEKFINGKEKDFFIALIDKFEKQKEQNDFVIVVGCENFSVFGACELNLKIAKNLNCPVFEPRNFKALKALNPNSKLIISGDIDEILSCTQEIITPYKFENILLNRARNAHSSVVLPESDDERVLRAAEILLAQGAVDIVLLGEEAAIRQKQSELGLNLSKARIIDPQNNDYTQAFAAKIYELRKAKGVSEKDAERMARDKVYFATMLVNEGMVGAMVSGASMSTADTIRPALQIIKTKPQTKIVSGLFFMALEEEILLYADCAITPNPSAEELAGIAVITAQTAASFGLQPRVAMLSYSTADSGSGPDVEFVKLAAKKALEIEPDLSLAAPIQYDAAVDVKVGAKKMPNSSVAGRANVFIFPNLNCANICYKAVQRSANALAVGPVLQGLKKPVNDLSRGCLVEDIVNTVLISAIQAGE

SEQ ID NO: 1341 - protein, 461 aa, Campylobacter showae RM3277
MANSILALGANFQEIYEIISTKFKNVAVFDPVNDFYGLENAKKAFENGSEREFFKSAINEFDRLAGSADFVLVKPAKSIANIGEIELNLQIARNLNIPIFCRENLSFFTRNSKLIVSGNLDEILNAKQDIITPLRFENSLFKLAAKDKKTVVLPESEDERILRASEILLKSGAVNLILLSDENEIKFEAEKLGINLNGARFINLEKNEYADRLTAALFEARKSKGVSLEQARELVRDRTYFATMLVQEGLADAMVSGANTTTAHTIRPALQIIKTRPDSPLVSSSFIMCFDEEILIYADCAINPNPDARQLAQIALASANTARAFGLEPLVAMLSYSSGDSGSGADIDLVRSAGEIARGLDPALKIEAPVQYDAAIDIAVARKKLPNSDVAGRANVFVFPNLNAGNIGYKIAQRSANCVAVGPILQGLKKPVNDLSRGCGVGDVVNTVLISAIQAANEGEK

SEQ ID NO: 1342 - protein, 556 aa, Bifidobacterium pseudocatenulatum DSM 20438
MSLTSVTIISPEAANGRNVVALGVTKAFAAAKKTAVFRPAVCRKETFTDVLLEASNSGLSREQSVGVCPKRARTDKEGSRADIVAAYTEAIETAQPEAVVVVGTDKSAINDPSIFAFNADVAADLKSVVLLAVCTINRTPEQVLGTVEASKTIIENAGSKVAGVFITGCKDEQVEPLKEEFAAYEVPVWTLPAVDFDEEDAVTKATEAFEANVNAEELIAAVEAPFEAPTTPYAFQYSLLGKAKADKKTIVLPEGSEDRIIKAADYLLERDIVDLIIVGDREGILARGEELGLKSLEKAQFQAKDDEEVLAPMVAKLCELRAKKGMTEEQARKQLADDSYFGTMLVVLGKADGLVSGSINSTANTVRPALQVIKTKPGTSLVSGAFLMCFKDHVAVFSDCAINLNPSAEQLAEIAIQSAETAKAFGLDPKVGMLSYSTLGSGKGPDVDLVEEATALVKEKAPDLAVVGSIQFDAAWSPTVAATKAKGNDVAGHVNVFVFPDLCAGNIGYKAVQRSSGAVAVGPVLQGLNRPVNDLSRGATVQDIINTVALTAIEAQ

SEQ ID NO: 1343 - protein, 566 aa, Bifidobacterium dentium ATCC 27678
MHMNEGIGDTVSLTSVTIISPEAANGRNVVALGVVTALASIKKTAVFRPAVCRKDTFTDILLEASNTGLTREQSVGVCPRRAREDKAGSRADIVAAYTEAIEAAQPEAVVIVGTDKSPVNDPALFAFNADIAADLKAPVLLAVCTIKRTPEQVRFTVEASTATIEAAGTKVVGVFITGCKDDQPEALHAEFADYPVPVWTLPAVDFSEEGAVAKASEAFSFNVDTADLLAAIDAPFEVPTTPYAFQYSLLGKAKADRKTIVLPEGEEDRIIKAADYLLERDVVDLIIVGDENAILARGEELGLKSLSKAKFQAMDDEEVLTPMVAKLCELRAKKGMTEDQARKQLTDASYFGTMLVVLGLADGLVSGSVNSTANTVRPALQVIKTKPGTSLVSGAFLMCFKDHVAVFSDCAINLNPNAEQLAEIAIQSAETAKAFGLEPKVGMLSYSTLGSGKGPDVDLVEAATAIVKDKAPELAVVGSIQFDAAWSPTVAATKAKGDPVAGHVNVFVFPDLCAGNIGYKAVQRSSGAVAVGPVLQGLNRPVNDLSRGATVQDIINTVALTAIEAQ

SEQ ID NO: 1344 - protein, 563 aa, Bifidobacterium adolescentis L2-32
MKYIGDTVSFTSVTIISPEAANGRNVVALGVTKALAAAGKTGVFRPAVCRKDTFTDVLIEASNAGLSREQSVGVCPKRARNDKEGSRADIVAAYTQAVETARPDAMVIVGTDRSAVNDPAMFSFNADFAADLQSPVLLAVCTIERTPEQVKSTVEASTKVIEDAGSKVVGVFITGCDDTQPDPLKACFVDYPVPVWTLPAVDFNDDDAISKADEAFATNVDAAELTAALESPFDAPTTPYAFQYGLLGKAKADKKTIVLPEGNEDRIIKAADYLLERDIVDLIIVGDENAILARGQELGLKSLGKAKFQAKDDETVLEPMVAKLCELRAKKGMTEEQARKQLADDSYFGTMLVVMGMADGLVSGSVNSTANTVRPALQVIKTKPGTSLVSGAFLMCFKDHVAVFADCAINLNPNAEQLAEIAIQSAETAKAFGLEPKVGMLSYSTLGSGKGPDVDLVEEATTIVKDKAPDLAVVGSIQFDAAWSPTVAATKAKGDPVAGHVNVFVFPDLCAGNIAYKAVQRSSGAAAVGPVLQGLNRPVNDLSRGATVQDIINTIALTAIEAQ

SEQ ID NO: 1345 - protein, 568 aa, Bifidobacterium angulatum DSM 20098
MPKPIQCIGDNVSLTTVTIISPEAANGRNVAALGVVRALASTQKTGVFRPAVCKKETFTQTLLDAANVGETIEQARGVCPKRARHDKNGSRADIVAAYETTVAAIDTEAMVIVGTDHSCVNDPETFAFNADVAADLQSPVFLAVCTINRTPEQVRETIKACTATVEEHGSAVLGVFVTGADEEQIPDLKAFFADADVPTWVLPKVDFEEDDAAEKAAEAFARNVPASEVHAALEAPFKAPVTPYAFQYGLLGKAKAVRKTIVLPEGAEDRIIAAADYLLERDIVDLIIVGDKEAILARGEELGLNSLGKAKFQAMDDETVLAPMVAKLCELRAKKGMTEEQARKQLTDASYFGTMLVVLGKADGLVSGSVNSTANTVRPALQVIKTKPGASLVSGSFLMCFKDHIAVFADCAINLNPNAEQLADIAIQSAETAAAFGLEPKVGMLSYSTLGSGRGPDVDLVEEATDLVRQKAPDLQVVGSVQFDAAWSPTVAATKAKGNDVAGHVNVFVFPDLCAGNIAYKAVQRSSGAVAIGPVLQGLNKPVNDLSRGATVQDIINTVALTAVEAQR

SEQ ID NO: 1346 - protein, 580 aa, Bifidobacterium breve DSM 20213
MNDNNDHYNEIWFHICCTSKETDTVTVTRVYIASPEGANGRNVVAYGVLNALTSKYKTMVFRPAVSNHDDFTPILLAASNAGLGVALSTGLDVHKVRTDKGTARGDIVGAFNDAMDVSRADAALIVGTDKSHVNDPTSYEFNANVAADLKAGVFLAVCTIDRWPHELDETVHLSIEGMEAAGNKVLGIFVTGCEPRHAFSVKETLAKYGLPVWTLPQIPFTDESTKDLALATFRKNAPTDEVLAALDVENTAPITPYAFQFDLLGKAKSNKKTIVLPEGEEDRIIKAADYLLEREIVNLIIVGDKNAILARGEELGLKFLDRARFQAMDDENVLKPMVAKLCELRAKKGMTEEQARKQLADASYFGTMLVVLGYADGLVSGSINSTANTVRPALQVIKTKPGQKLVSGAFLMCFKDHVAVFADCAINLNPDAEQLSEIALQSAETARAFGIDPKVGMLSYSTLGSGKGPDVDIVEEATKLLKEKAPDLPVVGSIQFDAAWSPDVAATKAKGNDVAGHVNVFVFPDLCAGNIGYKAVQRSSGALAIGPVLQGLNKPVNDLSRGALVQDIINTIALTAIEAQ

SEQ ID NO: 1347 - protein, 570 aa, Bifidobacterium longum subsp. infantis ATCC 55813
MVPIVLIIKGDKNIVTVTRVYIASPEGANGRNVVAYGMLNALTSKYKTMVFRPAVSNHDEFTPILLAASNAGLGVALSTGLDVHKVREDKDTARGDIVGAFNDAMDVSRADAALIVGTDKSHVNDPTNYEFDANVAADLKAGVFLAVCTIDRWPHELDETVKLSIEGMEAAGNKVLGIFVTGCEPRHAFSVKETLAKYGLPVWTLPQVPFTDESTKDLALETFRKNAPTDEVLAALDVDVTAPITPYAFQFGLLGKAKSNKKTIVLPEGEEDRIIKAADYLLEREIVNLIIVGNKDAILARGKELGLNYLERARFQAMDDENVLKPMVAKLCELRAKKGMTEEQARKQLADASYFGTMLVVLGYADGLVSGSVNSTANTVRPALQVIKTKPGQKLVSGAFLMCFKDHVAVFSDCAINLNPDAEQLSEIALQSAETARAFGIDPKVGMLSYSTLGSGKGPDVDMVEEATKLLKEKAPDLPVVGSIQFDAAWSPTVAATKAKGNDVAGHVNVFVFPDLCAGNIGYKAVQRSSGALAIGPVLQGLNKPVNDLSRGALVQDIINTIALTAIEAQ

SEQ ID NO: 1348 - protein, 570 aa, Bifidobacterium longum subsp. infantis ATCC 15697
MNDGPYHADIKGDIVTVTRVYIASPEGANGRNVVAYGVLNALTSKYKTMVFRPAVSNHDEFTPILLAASNAGLGVSLSTGLDVHKVRADKDTARGDIVGEFNYAMEVSRANAALIVGTDKSHVNDPTTYEFNADVAADLKAGVFLAVCTMDRWPHELDETVQLSIEGMRAAGNTVLGIFVTGCEPRHAFSVKETLAKYGLPVWTLPQVPFTDESTKDLALETFRKHAPIDEVLAALDVDVTAPVTPYAFQFDLLGKAKSNKKTIVLPEGEEDRIIKAADYLLERETVNLIIVGDKDAILARGRELGLNSLGRARFQAMDDENVLKPMVAKLCELRAKKGMTEEQARKQLTDAGYFGTMLVVLGYADGLVSGSVHSTANTVRPALQVIKTKPGQKLVSGAFLMCFKDHVAVFADCAINLNPDAEQLSEIALQSAETARAFGIDPKVGMLSYSTLGSGKGPDVDLVEEATKLLKEKAPDLPVVGPIQFDAAWSPTVAATKAKGNDVAGHVNVFVFPDLCAGNIGYKAVQRSSGALAIGPVLQGLNKPVNDLSRGALVQDIINTIALTAIEAQ

SEQ ID NO: 1349 - protein, 556 aa, Bifidobacterium bifidum NCIMB 41171
MTTTNIYIASPEGANGRNVVAYGVLKALTTKFKTTVFRPAVSNHDHFTPILLNASNAGLGVALSTGLDIHQVRKDKEGSRGDIVAAFNDAMNVSRADAALIVGTDKSHVNDPTAYEFNANIAADLQAGVFLAVCTIDRWPDELKDTVRLSIEGMEAAGNKVLGIFVTGCEPRHSVSVKDTLADFGLPVWTIPQIPFTEASQADAALAAFQANVPTEEVLRAINVEIDFPITSYAFQYSLLGRAKANKKTIVLPEGEEDRIIKAADYLLEREIANLIIVGDKGAILARGAELGLTHLGKARFQAMDDENILKPMVAKLCELRAKKGMTEEQARKQLTDASYFGTMLVVLGYADGLVSGAVNSTANTVRPALQVIKTKPGQRLVSGAFLMCFKDHVTVFSDCAINLNPDAEQLAEIALQSAVTAKAFGIEPKVGMLSYSTLGSGKGPDVDIVEEATRIVKEKAPDLPVVGSIQFDAAWSPDVAATKAKGNDVAGHVNVFVFPDLCSGNIGYKAVQRSSGALAIGPVLQGLNKPVNDLSRGATVQDIINTIALTAIEAQ

SEQ ID NO: 1350 - protein, 554 aa, Gardnerella vaginalis ATCC 14019
MSLVNVTIISADCAQSRNVVALGVTKALSSHYPTTVFRPSAKHDDAFTSELIASSNTKPTLEQVIAACPCAVRKNKDTLRGDIVAHFNELISVTNAQGCVIVASDSTSVFDPDLFRFDASVAADLASPVFLSICAEGRDSKQILQTIEAQCASVSKEYTKVLGVFVTDCKEDLAKEVKENYAQNNNGTPLWTLPSISESESESDKFNDYVADEEIISALKQPFNAPTTPYAFQYSLLGKAKANKKTIVLPEGEEDRILKAADYLLERDIVNIIIVGERESILARGQELGLKSLSKASFQSMSDEEVLSKMISKLCELRAKKGMTEEQAREQLKDASYFGTMLVVLGLADGLVSGSVNSTANTVRPALQVIKTKPGSKLVSGAFIMCFKDHVAVFADCAINLNPDAEQLANIALQSAQTAKAFGLDPKVGMLSYSTLGSGKGPDVDLVEEATRLVKEKDPDLKVVGSIQFDAAWSETVAASKAKGNDVAGHVNVFVFPDLCAGNIGYKAVQRSSGALAVGPILQGLNKPVNDLSRGALVQDIINTVALTALEAQF

SEQ ID NO: 1351 - protein, 560 aa, Bifidobacterium animalis subsp. lactis HN019
MSLKNVSIISPEPGDGRNVVALGVVDMLAHTAKTSIFRPAVQADENLTDALLSVVSVLQTREQAVGVTLHDARLDKDNARQQIVSKFIDTNAEINPQIRVIVGSDRTNVGDPERFTFNADVSADLQSPVLLSVSSMGRTPDEIRETIDACREVVANAGTQVIGVFITDCTNSALPTLTDEFVSYDLPTWPLPLVELGSADTNVKAALDAFDEHVDKESLLNVLDTPFVPPTTPFAFQYDLLARAKKDKKTIVLPEGEDDRIITAANYLLQSNVVDLVIIGDRNEILARGEKLGLKALDQAKFVSIDDKHLLDTMVPKLCELRAKKGMTPDVALKTLRDTNYFGTMLIVLGMADGLVSGAISSTANTVRPALQLIKTKPGVSSVSGAFLMCLKDHVSVFADCAINLDPDPQQLADIAIQSAETAKAFSIDPKIGLLSYSTLGSGKGPDVDLVVEATSIAQNKRPDLPIVGPIQFDAAWSKTVARVKAFGNPIAGNVTVFVFPDLDAGNICYKAVQRTSGAVAIGPVLQGLNRPVNDLSRGALVQDIINTIALTAIEAQSNE

SEQ ID NO: 1352 - protein, 557 aa, Bifidobacterium gallicum DSM 20093
MSHLNVSIISPEPGNGRNVVALGVVQALSQELGRVGVFRPAITKTETYTGALLDAANIGQTRGQATGVTPRDARMDPELSRATIVARFTETEAQLEPAAMVIVGSDKSNVGDPARFAFNAEVSADLRARILLTVCTIGRTPDEVQQTIETCTQVCTNAGTAVVGVFVTGCRDDQADRIAEHFRDYAVPVWPVAFVDMDEPDALRKAQDAFSASVDMSSLMDAVHTPFTPPMTPFAFQYSLLGRAKDHKKTIVLPESSDDRILKSADYLLKRDVVDIILLGERDAILERGRQMDLDSLDKARFQSMNDESMLATMVDKLCQLRAKKGMTPEQARATLRDMSYFGTMMIVLGHADGMVSGAINSTANTVRPALQLIKTKPDAACVSGAFLMCFKDHVAVFADCAINTNPDAATLADIAIQSCDTARAFGLEPRLGMLSYSTLGSGKGPDVDLVEQATQLVVQREPQQPVVGPVQFDAAVSPTVASIKAKGNDVAGHVNVFVFPDLTAGNIGYKAVQRTSGAVAIGPILQGLNKPVNDLSRGAEVQDIINTIALTAIEAQ

SEQ ID NO: 1353 - protein, 492 aa, Actinomyces odontolyticus ATCC 17982
MSRFIVVAPGSSEAAALATDELARVLGVATVDALAGTTATDAALRPASALPAAVEAVRAVGDDALIAPAREASNRAFDHVAWNLNLAASTRAGVILAFDAEGASAELLAEEIAAARLRAEAAAASVVAVVLTGGAPAVEADVPVLTLPLGDEAAATLRTTAAPTAVTPLAFQADLIERARAERKRIVLPEPDDDRVLQAAAQVLAAGIADITFVGDADYVAKRAGELGLDLSAAQVISVNDPAYLERYAEEFARLRAKKGVTLEQAREKVTDVSYFGTMMVHMGDADGMVSGAAHTTAHTIVPSFQIIKTAPGVSVVSSIFLMAMKDRVWAFGDCAVNPNPTAEQLADIAVTSARTAAQFGVTPRVAMLSYSTGTSGSGPDVDVVVEATRLAREKAPELAIEGPIQFDAAVDAAVAATKLPGSEVAGKATVFVFPSLEAGNIGYKAVQRSSGAVAVGPVLQGLNKPVNDLSRGALVEDIVNTVALTAVQAQG

SEQ ID NO: 1354 - protein, 531 aa, Actinomyces coleocanis DSM 15436
MLGKETPPMTELLFLTASENISGGVETVRQALETLRANYGKVGVFRPFINAHPEQDPILTEFGGDWGTTRSHIVANETAAMNQVISKFTAFNHDFDAVLIVGLIDGDLINPGELTRAGRTAINLGATVALLVDSAVRTPERLADYCKLAVNELNSVHAPVSALIVLNPTEGARVAISKHLGDMRVITELNDYALIEATAEKTHVVTPLMFENALKDRARAQKRRIVLPESEDDRVLKAAAIILEADVADIILLGETGEVFARAEALGLDLSKATVVSVNDPAYRERYVAEFVRLREKKGVTVEQAEAKMSDVSYFGTMMVHLGDADGMVSGASHTTAETIVPSFQIIKTKPGTSIVSSVFLMLMEDRVLVFGDCAVNPNPTPEQLADIAISSAETAVAFGVDPRIALISYSTGASGSGPDVEAVIEATRIAREKRPDLALEGPIQFDASVDAAVAKAKLPDSEVAGRATVFVFPDLNTGNTTYKAVQRSAGAVAVGPVLQGLNKPVNDLSRGALVEDIVNTIAITAVQAQN

SEQ ID NO: 1355 - protein, 461 aa, Corynebacterium glutamicum ATCC 13032
MSDTPTSALITTVNRSFDGFDLEEVAADLGVRLTYLPDEELEVSKVLAADLLAEGPALIIGVGNTFFDAQVAAALGVPVLLLVDKQGKHVALARTQVNNAGAVVAAAFTAEQEPMPDKLRKAVRNHSNLEPVMSAELFENWLLKRARAEHSHIVLPEGDDDRILMAAHQLLDQDICDITILGDPVKIKERATELGLHLNTAYLVNPLTDPRLEEFAEQFAELRKSKSVTIDEAREIMKDISYFGTMMVHNGDADGMVSGAANTTAHTIKPSFQIIKTVPEASVVSSIFLMVLRGRLWAFGDCAVNPNPTAEQLGEIAVVSAKTAAQFGIDPRVAILSYSTGNSGGGSDVDRAIDALAEARRLNPELCVDGPLQFDAAVDPGVARKKMPDSDVAGQANVFIFPDLEAGNIGYKTAQRTGHALAVGPILQGLNKPVNDLSRGATVPDIVNTVAITAIQAGGRS

SEQ ID NO: 1356 - protein, 504 aa, Corynebacterium efficiens YS-314
MRYRASNDAKLCEESQHLPRVPSGTHLVERITPISSGLREERRCMSDTPTSALITTVNRSFDGFDLEALARDLEVNLVPIRGDDFDMSKVLAADLLADGPALIVGAGNAHFDAQVAAALGVPMLMLVDKRGSHVTLARTQAKNVGAVVVAAFTAEEEAKPDKLKKAVRNHGNLEPVMSAALFENWLLKRARKEQAHIVLPEGEDDRILMAAHQLLEKDICELTILGDPEQIHSRATELGLHLEKADVINPLTDPKLDEFAEQFAELRKSKGITLEQARETMKDISYFGTMMVHNGDADGMVSGAANTTAHTIKPSFQIIKTVPEASVVSSIFLMVLRGRLWAFGDCAVNPNPTAEQLGEIAVVSAKTASQFGIDPRVAILSYSTGNSGTGPDVDRAIDALAEARRIDPDLKVDGPLQFDAAVDPGVAKKKMPDSDVAGHANVFIFPDLEAGNIGYKTAQRTGHALAVGPILQGLNKPVNDLSRGATVPDIVNTVAITAIQAGGK

SEQ ID NO: 1357 - protein, 483 aa, Corynebacterium diphtheriae NCTC 13129
MLWHRSHCGHVGAAHYFFATERIHVTDHMQPSFLLTRAGRNFNGFDVDGFADHLGLPVRQLVDSTPDLAAILAAHPAATPSLFIGSGNVNFDAKAASALGVPLLLLIDAPGMHIDLAKQECEELGAVVASVFTADEAVSAEGIARIKASAVEAPVVMSAPVFESWLLEQAKSKNAHIVLPEGDDDRILQAAHQLLAQEICELTILGDPEAITARAQELGLDLSAAHLQNPETDPNAEKFAEDFAELRKSKGMTLEQARETMKDISYYATMMIHEGLADGMVSGAAHTTAHTIKPSFQIIKTKPGTSVVSSIFLMVMRGRLWAFGDCAVNPNPTADQLGEIAAVSAKTAEQFGIDPRVAILSYSTGTSGSGPDVDRAVAATKKAQELAPEYKIDGPLQFDAACDPTVAAKKAPESEVAGQANVFIFPDLEAGNIGYKTAQRTGHALAVGPILQGLNKPVNDLSRGATVADIVNTVAITAIQGGK

SEQ ID NO: 1358 - protein, 466 aa, Corynebacterium matruchotii ATCC 14266
MTQTTHSVLLTAIRRRLDQAEVAEFAAALGLDITPLVPAGHDEPTIADVLKHAPAGPVLYTGTGNLNFDARAAAALGVPLVLQTPSESLSTALARVEARDLGASIAAIIMGDQPLTAAVTAAQETPAEIVMTADVFENWLLGMAKKHRAHIVLPEGDDDRILTAAGILLAEDACDLTILGVPEEVAARAAELGVTLDGATLVNPWADDDPHREEFAQQFYELRKTKGVSLEQARETMTDISYYATMMIHNGLADGMVSGASHTTAHTIKPSFQIIKTKPGVSVVSSVFLMVMRGRLWAFGDCAVNPNPTAEQLAEIAVVSAETASQFGIDPRVAILSYSTGTSGSGPDVDRAMAATRMAQAKAPELLVDGPLQFDAAVDPVVAAKKLPESRVAGQANVFIFPDLEAGNIGYKTAQRTGHALAVGPILQGLNKPVNDLSRGATVADIVNTVAITAIQAASSKEAGEE

SEQ ID NO: 1359 - protein, 466 aa, Corynebacterium glucuronolyticum ATCC 51867
MNSPRSALLTTVGRTSADFDASAIAADLGLRHLDLVSIVPATGDDEPTPIRRLIVEDPLAAGPALIEGTGNVSYDSEAAAALGIPVIFIVDKRGLTEKLAVREAGGYLATVGGVFTEGELTADAIAEALTGVDTKPVMSPDYLQTWLQKKAQEKTTRIVLPEGDDDRILQAAHEVLAEGICELMILGDKETVTSRASALGLDISRAEIIDHLTDPRAEEFAAQFAELRKKKGVTLEQARETMKDVSYFGTMLVHTGQADGMVSGASHTTAHTIRPSFQIIKTKPGTSVVSSIFLMAMRGRLWAFGDCAVNPNPTAEQIGEIAAVSAQTAAAFDIDPKVAILSYSTGTSGAGPDVDRAVAATAKAKELAPETIIDGPLQFDAAVDPGVAAKKAPESPVAGKATVMIFPDLEAGNIGYKTAQRTGGALAIGPILQGLNKPVNDLSRGATVPDIINTIAITAIQAGETK

SEQ ID NO: 1360 - protein, 453 aa, Corynebacterium genitalium ATCC 33030
MANRSVLITTVGRTLDGIDVDALAQESNLTAVRLSEHEADVSAVVSADLLSAGDSLIVGTGDYNYDADAASALGVPVLVVAAAEEVAELAKKRIDELGATVAAVVADVDAAAINTALTTETEQVMSAAVFENWLLNRAKEKRSHIVLPEGEDDRILEAADQLLAQDVADITILGDSDDIARRADSKGLNLSKANIIDHLNSELLEEFAADFAELRKKKGISIEEARETMKDISYFATMMVHKGLADGMVSGAAHTTAHTIKPSFQIIKTAPGATVVSSIFLMVMRGRLWAFGDCAVNPNPTAEQIGEIAAVSAQTAAQFGIDPKVAVLSYSTGTSGSGPDVDRAVEATAKAKELAPDVAIDGPLQFDAACDPGVGKKKAPDSPVAGEANVFIFPDLEAGNAGYKIAQRTAGALAVGPILQGLNKPVNDLSRGATVPDIVNTVAITAIQAQGAH

SEQ ID NO: 1361 - protein, 452 aa, Corynebacterium lipophiloflavum DSM 44291
MADQSLLITLANRNYDGIDVEGFASKRGLRVVRLDSYGTDLQEMYDANLLAEGPALVVGTGDVSFDGELAATLGIPVVLVTGEQANVELSERRLEELGAVVAGAFTAAELADADLVAVDTRQVMSPVVFESWLISRAKEKRAHIVLPEGEDDRILQAAAQLLEDEVAELTILGDKADIDRRAQDLGIDLSAAQILNHLESDLLEEFAADFAELRKAKGVSLDDARETMKDISYFGTMMVHKGIADGMVSGAAHTTAHTIKPSFQIIKTMPGTSVVSSIFLMVMRDRLWAFGDCAVNPNPTAEQLGEIAAVSAKTAAQFGIDPKVAILSYSTGTSGSGPDVDRAVEAVAAAKKADPELIVDGPLQFDAACDPGVGKKKAPESPVAGEATVFIFPDLEAGNAGYKIAQRTGDALAIGPVLQGLNKPVNDLSRGATVPDIVNTVAITAIQAGALK

SEQ ID NO: 1362 - protein, 455 aa, Corynebacterium accolens ATCC 49725
MSASQSTVLSSIGRGFDGLDIPALADSLGAELLRLEDFDPTVADVLAHAPTATADALLVQGTGEISFDAEVAAALGLPLVIISGAPERAAELAQRKAESLGATVAGVFTDLEAVPGALQAAEETAPVMSADLFQKQLIDQARSTGSHIVLPEGDDDRILEAADALLRDEVARLTILGKESDIQARAKELGLDISGADIIDHLESPLAEEFAADFAELRKKKGVTLEQARETMQDISYFGTMMVHKGLADGMVSGAAHTTAHTIKPSFQIIKTKPNASVVSSIFLMVMRGRLWAFGDCAVNPNPTAEQLGEIAVVSAQTASQFGIDPRVAMLSYSTGASGTGPDVERAIAAVEAAKKLDSSVKVDGPLQFDAACDPGVAAKKMSDSDVAGKANVFVFPDLDAGNIGYKTAQRTGGALAVGPILQGLNKPVNDLSRGATVPDIINTVAITAIQAGEK

SEQ ID NO: 1363 - protein, 453 aa, Corynebacterium tuberculostearicum SK141
MSASHSAVISAIGRGFDGLDVPALAKDLGAELIRLEDFDATVAAVLAEAPAAENIVAQGTGDIAFDAEVAAALGLPLAIISGAPQRTGELAQHNAESLGATVAGIFTDLEAVPGALAALGDVSPVMSADLFQKQLIDQARAAGSHIVLPEGDDDRILEAAHVVLRDKVAKLTILGNEADIKARAEELKLDLAGAEIINHLESPLAEEFAADFAELRKKKGVTLEQARETMKDISYFATMMVHKGLADGMVSGAAHTTAHTIKPSFQIIKTKPNASVVSSIFLMVMRGRLWAFGDCAVNPNPTAEQLGEIAIVSAQTASQFGIDPRVAMLSYSSGTSGSGPDVDRAVAAVEAAKKLDSSVKVDGPLQFDAACDPGVAAKKMPNSDVAGQANVFVFPDLEAGNIGYKTAQRTGGALAVGPILQGLNKPVNDLSRGATVPDIINTVAITAIQAGEK

SEQ ID NO: 1364 - protein, 452 aa, Corynebacterium striatum ATCC 6940
MSAQNSALVSVIGRGFDGLDVPSLAQDLGATFAQLNDLGTTLDQILVTVPEGDVVLQGTGVMDFDAKAAAALGIPFVLITNAPARTSDLALAHARSVGAEVLGAFTDVASVPGALSSVGEIAPVMSAELFQKQLLDQARAVGAHIVLPEGDDDRIIEAAGALIEGKVAKLTILGDEVDVAKRAERLGVDLAGVDVIDHLNSPLAEEFAADFAELRKKKGVTLEQARETMQDVSYFATMMVHKGLADGMVSGAAHTTAHTIKPSFQIIKTVPGASVVSSIFLMVMRGRLWAFGDCAVNPNPTAEQLGEIAVVSAKTAAQFGIAPRVAMLSYSTGTSGSGPDVDRAVAAVEAARALDSSVKVDGPLQFDAACDPGVAAKKAPESQVAGQANVFIFPDLEAGNIGYKTAQRTGGALAVGPILQGLNKPVNDLSRGATVPDIINTVAITAIQAGVK

SEQ ID NO: 1365 - protein, 454 aa, Corynebacterium aurimucosum ATCC 700975
MTAKSSRNSAFISVIGRGFDGLDVAAVAQELGATFAQVDDLGTTLSEVLENAPTGNLVLQGTGVMDFDAKAAAALGLPFVLISAAPARAAELALNHARSVGATVVGALTDVSSVPGAISSLEEIEPYMSAELFQKQLLDQAREIGAHIVLPEGEDDRILEAAGELIKGKVAKLTILGDGNVEKRAQELGIDLSSVDIINHLESPLAEEFAADFAELRKQKGVTLEQARETMKDVSYFATMMVHKGLADGMVSGAAHTTAHTIKPSFQIIKTKPEASVVSSIFLMVMPGRLWAFGDCAVNPNPTPEQLGEIAIVSAQTAAQFGLDPRVALLSYSTGTSGAGPDVEKVGQAVEVARGIDSSVAVDGPLQFDAACDPGVAAKKAPESDVAGKATVFVFPDLEAGNIGYKTAQRTGGALAVGPILQGLNKPVNDLSRGATVPDIINTVAITAIQAGVK

SEQ ID NO: 1366 - protein, 503 aa, Corynebacterium jeikeium K411
MSIASSTASRGTGTNAVISPIASAAARRSDILEALGEAEAVDIFDTIRPSAPDFAAALDAAYGAQASASASAGAGAVLLGTGEINFDSRLAAAAGASHYLLAGSPADATALQLASGQLVRSGRKPAGISFIDANASAGAAAANAVEAEGQAIRHIALEGIAEAAAGTNGESAAKEPVIGPELFERNLLIKAREKDAHIVLPEGDDDRILTAADQLLRAKVCRLTILGNPDEIAGRAKELGLDLSGATLTDPSEGNQLEEFATEFAELRKHKGITLEQARETMQDISYYATMMVHKGIADGMVSGAAHTTAHTIKPSFQIIKTAPGASVVSSIFLMVMDGVLWAFGDCAVNPNPTSDQLAEIAAVSAKTAAQFGIEPKVAMLSYSTGTSGAGEDVEAVAAAVKKAQEDNPDLPLDGPLQFDAAVVESVGQKKLPGSDVAGQATVFVFPDLNCGNITYKAVQRTADALAVGPILQGLNKPVNDLSRGATVPDIVNTVAITAIQAK

SEQ ID NO: 1367 - protein, 447 aa, Corynebacterium urealyticum DSM 7109
MAAAAPTFFEHIRPSHPDFPQALEFGSTTSADVLVGTGSVSFDARLAGALGASHILVAGSDADRISVQQSLGQLVRIGRVPAGIAMLEGPASTSSALECEGEAISYVDLGSVHKSETREPIVGPELFERNLIIQAREKNAHIVLPEGDDDRILQAAHQLLEHNVCRLTILGDPSAIAQRARELQLDLSGATLTNPNSGTQLEEFAQDFAELRKSKGVTLDEARETMKDISYYATMMVHKGLADGLVSGAAHTTAHTIRPSFQIIKTAPGASVVSSIFLMVMDGYLWAFGDCAVNPNPTAEQLAEIAAVSAKTAAQFGIDPKVAMLSYSTGTSGAGEDVEAVAAAVEKAKADNPELQLDGPLQFDAAAVASVGQKKMPESDVAGKANVFIFPDLNSGNITYKAVQRTANALAVGPILQGLNKPVNDLSRGATVPDIVNTVAITAIQAG

SEQ ID NO: 1368 - protein, 518 aa, Corynebacterium kroppenstedtii DSM 44385
MPCALYIDVGGAFGTSAGDALPAPLQGNVTRIISGEPGSPADPSALVAEAVEKVSQGKASEQKASPSDELQGALVATGDITVDSRIAASIGVPVVLLFLADVTPDALRVSLSISTVEGEGATVAAIVTRDGNPIDGVPSSIPVIAASDEAALDSAVSSAIGESGHLEPVIGPEVFQHNLIDQARASGARIVLPEGDDDRILRAADWLLEHHVCDLTILGNPNDIAARATELGLNLSDATIADPQGTDDESVEQAEKFAATFAELRKKKGITLDDARETMKDISYYATMMIYDGQADGMVSGAAHTTAHTIRPALQIIKTAPGSSVVSSIFLMVMRGKLWAFGDCSVNPNPTSEQLAEIAVTSADTAASFGIDPRVALLSYSTGSSGAGDDVDKVTRAVELAQAKAADTSRNGSPIAIDGPIQFDAAVEPSVGKKKMPESDVAGQATVFVFPTLDAGNIAYKAVQRTANALAVGPVLQGLNKPVNDLSRGATVPDIINTVAVTAVQVAAQTSTRDSAQS

SEQ ID NO: 1369 - protein, 508 aa, Corynebacterium amycolatum SK46
MSDKNAQASTNNSAVLITSVDRADDLQDVITALSEALGGARCLHTVGGAHGATVDQVVVDPESALDTIVSAVEADRAANEGAAVLTGSGNLDFDFRIATVAGAGVIVVAGGEGCHTEAAKARVRLALSSAAQRHSEVLAVVLTGEEAAEVARTLELDVPVVAVDDAEELRKVVSREVTAVMTPQRFQWWLLQRAKADKRHIVLPEGDDDRILEVADYLLREDICELTILGAPDAMKARAAELGFDIDAAHLWNPQTSEYVERFAEQFAEMRKAKGVTLEQARETMQDISYFATMMIHNGLVDGMVSGAAHTTAHTIRPSLQIIKTKPSASTVSSLFLMVMDNSLWGFADCAVLPKPAPEQLGEIAVVSAETAASFGIDARVAMLSYSTGASGTGEDVDRVKAGLAKAKELAPDLAVDGPLQFDAAIDPSVAAKKMPDSSVAGKATVFVFPDLDAGNIGYKIAQRCGGALAIGPILQGLNKPVNDLSRGATVPDIINTVAITAIQAGGN

SEQ ID NO: 1370 - protein, 500 aa, Neisseria flavescens NRL30031/H210
MAKILIAPVSAGLSADAAAKAFAAALNAQVFQAVDSTTEALLAQGKSDDWFDALVGKVAALNADNLVIEGITPDADKLFLAGKNVELALSVDAGVVLALKSDNTDAAAVTQQLNLAKQLYTNSPGLLEGFIIDGAAAALGAQVAEQTGLTFFGSSDKLKDVSALAKREAKRLSPAQFRYNLIDFARKADMRIVLPEGAEPRTVAAAAICHEKGIARCVLLATREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLAFADCAVNPNPTPEQLADIAIQSADSAKAFGIDPKVAMISYSTINSGSGPDVDAVIEATKLANEKRPDLAIEGPLQYDAATVPSIGQTKAPGSAVAGQATVLVFPDLNTGNCTYKAVQRSANVLSVGPLLQGLRKPVNDLSRGALIEDIVFTIALTAVQAKQMQG

SEQ ID NO: 1371 - protein, 500 aa, Neisseria sicca ATCC 29256
MAKLLVAPVSAGLDVAAASKAFAQALGAQVFQPLDASAETLLAQGKSDDWFDAVVGKAVALNTDKLVIEGIAPDADKLFLSGKNVELALSLDAGVVLALQSDSADAAEVAHRINLAKQLYTNSPGLLEGFIIEGAAASVGEEVARLTGLTFYGSSSALKDVSALAKREASRLSPAQFRYNLIDFARKADMRIVLPEGAEPRTVAAAAICHEKGIARCVLLAKREEVEAVAKERGINLPDSLEIVDPATLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTPEQLADIAIQSADTAKAFGIPPKVAMISYSTINSGSGPDVDAVIEATKLAKEKRPDLEIDGPLQYDAATVPEIGKTKAPESTVAGQATVLIFPNLNTGNCTYKAVQRSANVLSVGPLLQGLRKPVNDLSRGALVEDIVFTIALTAVQAKQMAN

SEQ ID NO: 1372 - protein, 544 aa, Neisseria meningitidis 053442
MFAIFNLRASSQTRHARHAGSRFCLYAAPSNHICRTPQHTKGYIMAKVLIVPVSAGLDASAAAQAFAKALDAQIFQAVDATAETLLAQGKSDDWFDALVGKVAALDAANLVIEGIAPDADKIYLAGKNVELALSLDAAAVFAVRSDNADADELANRLNLAKQFFAAAPGVLEGFVVDGAAASVAEAAAEKTGLTFFGSSDALKDVSVLAGREAKRLSPAQFRYNLIDFARQADKRIVLPEGAEPRTVQAAAICHEKGIARCVLLAKREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTAQQLADIAIQSADSAKAFGIDPKVAMISYSTVNSGSGPDVDTVIEATKLAREKRPDLAIDGPLQYDAATVPGVGKSKAPGSQVAGQATVLVFPDLNTGNCTYKAVQRSANVLSVGPLLQGLRKPVNDLSRGALVEDIVFTIALTAVQAKQMEG

SEQ ID NO: 1373 - protein, 492 aa, Kingella oralis ATCC 51147
MANILVLPTCAHVDAAAAAQSIAAALPDAVVFNPLADAKRAADLIAAGKADDWFDALVGEVAALGKKNVVIQGIQADAENIFLAAQNVALATSFNAQIVFAASNEAGAEQRVALAKQAFAGNTVFFAGVVGNAAAAQANELADLGASGSLKTAELAQIAAATTDRVSPAQFRYNMMDSARKANKRIVLPEGAEPRTVRAAAICHEKGIARCVLLATRAEVEAVAKEHGIALPESLEIIDPASLVEQYVAPMCELRKSKGLTEEQARSQLQDTVVLGTMMMAQNDVDGLVSGAVHTTANTIRPALQLIKTAPGESIVSSVFFMLLPGQVVVYGDCAVNPNPTAEQLADIAIQSAKSAKAFGIEPRVAMISYSTINSGSGPDVDLVVEATRLVKEKAPELAVDGPLQYDAAVVESVAKSKAPGSPVAGKANVFIFPNLTTGNCTYKAVQRNANVLSVGPMLQGLRKPVNDLSRGALVEDIVYTIALTAIQATQK

SEQ ID NO: 1374 - protein, 588 aa, Rhodospirillum rubrum ATCC 11170
MTPHADRRTLFIAATTALPGLSAVSQGLVRAFERQGLRVAFAKPVADHAAVGGDGAPSADLAGPIPARRAEAMIRAGQRDGLLEEIVERAERARGDSAVLVVEGPLPDADHPLLAELGRDLGRSLAAEVIAVVSGDRPSPTDVLETVADTLYHQGAAALSGVVITSIREGQQGDALKAALAGLNLPCPLVALFPGESERSLLGLIGGAAPGRARGLGEDDASVVWLIEHIADHVARGHLTDPSPTHRAAMPPPLFRHRLVGAARAADRRIVLPEGDEPRTLRAAAICAKKGIARCLLLGDPSRIRALAQANAICLPDTIEILDPELVRGRYVEALVEMRRAKGLTAVQATAQLEDTVVLGTVMLALGEVDGLVSGAVHTTASTVRPALQLIKTAPGASIVSSVFFMLMPDQVLVYGDCAINPNPTAEQLADIAIQSADSALAFGIEPRVAMISYSTGSSGVGDDVEKVRAATALAKLKRPGLMIDGPMQYDAASVESVGRQKAPDSPVAGRANVFVFPDLNTGNTTYKAVQRSANVVSVGPMLQGLRKPVNDLSRGALVDDIVYTIALTAIQADQGEPRTPHTLATAV

SEQ ID NO: 1375 - protein, 712 aa, Wigglesworthia glossinidia endosymbiont of Glossina brevipalpis
MYVSRTIIFVPLEKRVGLNYVFSGIIQAIKRKNIKFTVFQPFKYFNNTKKNFNIIDYTLKKYNIKGNDHKEQFSFDYIVNVLSSNKKNFLLEKIVENFYKQKKNNEIVLIPGINIYNGYEFLEKLNYELAKILDAEIVLILRLYKNFLDYIKLLSFKFGFEKKNKISGIILNELDCTKNSNQSIDCKRLLKNDNLYEIKKNNHENCSLINEKSIPIISKIPFNEDFYFVYLYKIKEHFKAKFLNKNYNYVIKSILFCEVYKENIFKNNFKQSLLVISKKQINKFCLMHLKESKYNFYSSILIIGCDKNENEIKVFCEIAEKKKISVIYNNMSFINFFYYLTKFKFNFYKKFNDIIKISNYISNYISDIWISNFSLKKKEKKFFSPEIFQYNILQLSRYTKKSIILPEGEEIRILCAANICSKKNIAHCILLGNPKNILEKARLNGITIEKNIDIINPVEIREKYISHIINLRKKKCISEISARKQINKNIVLATLMLNEGIVDGLVSGATTTTADTLRPAFQFIKTDPKHSLISSIFFMLLPEQTLIYGDCAININPNSKQLSEIAFQSHNSAIQFGIDPKIAMISYSTGYSGQGESVEKVRQATLIAKKSYPKLVIDGPLQYDAATVKSVAKSKAPFSEVAGKATVLIFPELNTGNTTYKAVQRSSNIICIGPVLQGIKKPVNDLSRGASIDDIVYTIAITAIQSIKKDQN

SEQ ID NO: 1376 - protein, 715 aa, Buchnera aphidicola str. Bp (Baizongia pistaciae)
MTRTIMLVPIGKNIGLTTISLSVISAMKRCKFNVKFLKSAIEYSNTNYNIDDTSLILKDTQSLSYINPLIVDFINQFSLKQIKQRIVDYILSKVYAKKEKYDIFLIEGFDTKSHTYVLSNDINYYISKSINVEIVFVCAVDRSSQLDINNIVYIINNVFKKNKNINIRGVIINELCQKVRNDYGNVNLFDMFKSSVKKINFGDVKYDFLFQKNGIEVLGCVPWIHKLMEPSVKILCDKYLGANIIYDRCMNSQYIKTFIIYDTNEDIKNAKKFHRSLLIIPAISNDKIKEICVQINKNKILISAILLTNFLNVHDKCTDFIDQLKIANCTICSTPNDVFTVVSLLHKFNFKLDNKNYQLNIIENDMSRHINLDWIRSLKHSYQYNSICLPSLFIYNLKHLAKKFMKNILLPEGCELRIIKAASICSKNDIAYCTLLGNPKKIKNIAESNNIVLNSNIEIIDPKLIRKNYVERLCHLRRHHGITLAHANELVKDNSILSTLILESKKVDGLVSGSIGTTSSIILPALQLIKTSPGSSLISSVFFMLLSDYVTLYADCAVNINPDATQLAEIAIQSSNTARLFGIFPKVAMLSYATGCSGFGDTVDKVKEATRIVQERSPNLIVDGPIQYDAAINRSVAKLKCPHSLVAGNATVFIFPDLNSGNITYKAVQRSANILSIGPILQGINQPVNDLSRGSSVQDIVYTIAVTVLQSSLSH

SEQ ID NO: 1377 - protein, 467 aa, Fibrobacter succinogenes subsp. succinogenes S85
MNRVYLVATAASNMEAKVQELVDAVTKAGLIATVYKPLEVFNAADSVAEIKAGKSAVLMEKICADFLKQDFDDVDAVVVEGATGMNDVIAHKFNDDLASALDAKIFADGEDAELFCPKRLLRCEKCVAGDLAAPAAERRVSQAMFRASLLSKASKCVKRIVLPEGSEPRTVQAACLAVERNIAVPVLIGKKADIEATAKSVGVKLPANIEIIEPSAELAEKYVPTLVELRKAKGMTPESARAALSDNVMLATMMLKFGEVDGLVSGAIHSTADTLRPALQIIRTAPGVKSVSSVFFMCMKDKTYIYGDCAINLNPLAEELADIALQCDDTAKAFGLPSRVAMLSYSTINSGKGPDADLVVAATAAAKAARPEMLIDGPLQYDAATVPSVGALKAPNSPVAGKATVFVFPDLSAGNIGYKAVQRSAHGTIAIGPMLQGLAKPVNDLSRGALVEDIVYTIALTAVQAQA

SEQ ID NO: 1378 - protein, 397 aa, Mycobacterium tuberculosis T17
ALVSGLRLRLPVIATRGHYDTASAAASARGLVTATSQRKIDTALELMDRHVDVAGLLAQLTIPIPTVTTPQMFTYRLLQQARSDLMRIVLPEGDDDRILKSAGRLLQRGIVDLTILGDEAKVRLRAAELGVDLDGATVIEPCASELHDQFADQYAQLRKAKGITVEHAREIMNDATYFGTMLVHNCHADGMVSGAAHTTAHTVRPALEIIKTVPGISTVSSIFLMCLPDRVLAYGDCAIIPNPTVEQLADIAICSARTAAQFGIEPRVAMLSYSTGDSGKGADVDKVRAATELVRAREPQLPVEGPIQYDAAVEPSVAATKLRDSPVAGRATVLIFPDLNTGNNTYKAVQRSAGAIAIGPVLQGLRKPVNDLSRGALVDDIVNTVAITAIQAQGVHE

SEQ ID NO: 1379 - protein, 352 aa, Capnocytophaga gingivalis ATCC 33624
MWFRRNIKKNRTIMNTSDATPDTSKKFQNYMVETAKKLQKRIVLPEGEDKRILSAAAKLAEDGLAYLTILGEEKEVLARVDELGLTWNPERIQIVSPKKNPNYEAYWKKLYEIRKEKGMTEAQAQELMLDVSYYGTMMVFMGEADGMVSGAVNSTAHTIRPSLQFVKTKKGVKTVSSVFFMILPDRVLVYGDCAVVPKPTAEQLAEIAITSAESAKAFGIEPKVALLSYSSGTSGSGEDVDKVREATEIVKAQRPDLLVEGPIQYDAAVDATVAKQKMPDSPVAGKANVLIFPDLNAGNITYKAVQRETHSIAIGPMLQGLRKPVNDLSRGATVPDIYNTVLITAIQAGMQE

SEQ ID NO: 1380 - protein, 332 aa, Candidatus Sulcia muelleri SMDSEM
MYITPQKFKKKIFFLSKNAQKHIVLPEGEEERIIIAASIFIYNKLGKLTLLGDKKKIKKKIKNLNLFWDEKQIKIINPKNSIYLNEFAETFYELRKEKGIKFEEAKVLISDFSYFGTMMVYKGITDGMVSGAVNTTAKTVRPALQIIKPKIGIKTVSSMFFMLLQKRVIIYSDCAIISTPTSEQLADIAICSAETAKLFGIKPKIAMLSYSSGNSGLGKEVEKVRKATEIVKYINPSLRIDGPIQYDAAVEKKICKKKLPNSKLEGKANIFIFPDLNSGNNTYKAVKHETKSISIGPILQGLKKPINDLSRGSTVKDIYNTIIITCIQAQKK

SEQ ID NO: 1381 - protein, 329 aa, PTA_CORGL
MSAELFENWLLKRARAEHSHIVLPEGDDDRILMAAHQLLDQDICDITILGDPVKIKERATELGLHLNTAYLVNPLTDPRLEEFAEQFAELRKSKSVTIDEAREIMKDISYFGTMMVHNGDADGMVSGAANTTAHTIKPSFQIIKTVPEASVVSSIFLMVLRGRLWAFGDCAVNPNPTAEQLGEIAVVSAKTAAQFGIDPRVAILSYSTGNSGGGSDVDRAIDALAEARRLNPELCVDGPLQFDAAVDPGVARKKMPDSDVAGQANVFIFPDLEAGNIGYKTAQRTGHALAVGPILQGLNKPVNDLSRGATVPDIVNTVAITAIQAGGRS

SEQ ID NO: 1382 - protein, 329 aa, Mobiluncus mulieris ATCC 35243
MSGFKDSFVANLAKRAAANRKRIVLPEATDERVLRAAAQVLQDGSAEVIFIGEKAEIDTKARVLGVDLSAATVVSLDDTTRLNRYVPKLVELRQHKGMTEEKARETLKDISFFATMMIVCGDADGMVSGAAHTTAHTIRPALQVIKTRPGVKLVSGAFLMVFDDHFDVYSDCAVTIAPTAEQLADIAVVSAATATQFGLEPKVAMLSYSTIDSGTGPMVDLVREATALAKAAAPEMAIDGPLQFDAAVVESVAAKKAPGSKVAGQANTFIFPDLNAGNITYKAVQRTSGALAIGPVLQGLNAPVNDLSRGATVDDIINTVVITAIQAQG

SEQ ID NO: 1383 - protein, 333 aa, Mobiluncus curtisii ATCC 43063
MELDVSDFKTLFLNGLTKKAAGSRKRIVLPESDDDRVLQAGARVLQTGAADIVFLGETEQIAQSAKRLHLDLDAAEIVSLHDDEKLARYTAKLVELRSHKGMDEATARETLKDVSFFGTMMIVCGDADGMVSGAAHTTAHTIRPALQLIKTQPGVKLVSGAFLMVFDDHFDLYADCAVTISPDAAQLADIAVVSAKTAAQFGLEPKVTMLSYSTLDSGSGPLVDLVREATAKARAAAPELSIDGPLQFDAAVVESVAAQKAPHSPVAGQTNTFIFPDLNSGNITYKAVQRTSGALAVGPILQGLNAPVNDLSRGATVDDISNTIVITAIQAQG

SEQ ID NO: 1384 - protein, 319 aa, Eubacterium hallii DSM 3353
MFKKLAEQLKANARTIVFTEGTDARILEAADKLTTEGILGVILLGKADEVKSAAKEAGFNIEKCQIIDPEQYAEIDAMVDEMVTLRKGKMTPEQVREALSKSNYFGTMLVKMGKADCLLGGATYSTADTVRPALQLIKTKPGNKIVSSCFIMVKGDKKLAMGDCAINIAPNEDELAEIAIETAKTAKIFGIDPKVAMLSYSTYGSGKGEMVTLMANATKKVKEMAPDLDIDGELQFDAAVAPEVAKVKCAGSTVAGQANTFIFPEISAGNIGYKIAARLGEYEAIGPVLQGLNAPINDLSRGCNAQEVYKMALVTAALS

SEQ ID NO: 1385 - protein, 350 aa, Eubacterium hallii DSM 3353
MLTKMIETLKKNPRTIVYTEGTDKRILESAHRLTQEGILGVVLLGKPEEVKAAAKAGNFNIDACQIIDPENYEGIDAMVAEMVKLRKGKMTDEQVRAALSKSNYFGTMLVKMGGADCLLGGATYSTADTVRPALQLIKTKPGNNIVSSCFILVRGDEKIAMGDCAINIDPSEDDLVEIAIESAKTAKIFGIDPKVAMLSYSTLGSGKGPSVTKVANATKKIKEAAPELAVEGEIQFDASVSPEVAEVKCPGSPVAGQANTFIFPDINAANIGYKIASRLGGYTAVGPVLQGLNAPINDLSRGCNAEEVYSMSIVTAALSVPEEEKVDEEGLEAIVRAVVETMLAAKKLDK

SEQ ID NO: 1386 - protein, 341 aa, Faecalibacterium prausnitzii A2-165
MADMFAPLVAQLKANPKTIVFTEGNDPRILEAASKLLAEGVLKVVMVGNEAECKAAAAAGNFDISAAEIIDPENYAGFDEMVNTMVELRKGKQTAEECTAMLKKSNYFGTMLVKMGKADCLLGGATYSTADTIRPALQLVKTKKGAHLVSSCFILDRDFGEEGLKRIAMGDCAVNIDYTDTVDKATGEVKIAASAKLAEVAVETAKTAKLFGIDPKVAVLSFSTKGSGKGGTVALSHDATIKAQEMDPELAVDGELQFDAAVAPEVAQVKCKGSKVAGQANTFIFPCIEAGNIGYKIAQRLGGYAAYGPILQGLNAPINDLSRGCNADEVYKMSLITACQS

SEQ ID NO: 1387 - protein, 329 aa, Bacteroides capillosus ATCC 29799
MIPMEMFNKLIETLKANPKRIVFTEGTDARILEASARLLTGSWLKPVLVGNVDEVKKAAAEHGFNIDGAEIVDPETYEGMEAMVEKMVELRKGKMTADECRAALKKGNYFGTMLVKMGVADCLLGGATYSTADTVRPALQLIKTKPGNKIVSSCFILVRETSTGGADVLAMGDCAINIKPSDDELVEIALETAKCAKIFGIDPKVAFLSYSTKGSGKGEDVDKMRSACEKAKAAAPDLAMDGEMQFDAAVSPTVGQLKFPGSKVAGYANTFIFPDINAGNIGYKIAQRLGGFDAYGPILLGLNAPINDLSRGCNADEVYSMAIITAALS

SEQ ID NO: 1388 - protein, 350 aa, Roseburia inulinivorans DSM 16841
MPKIVFIRYIDTVLEKKKSEENKMFGFGQLIDILKKNPKKIVFTEGNDPRILEAASRLLASNFLHPILVGNPDEIAKVAEESGFNIRGAEIIDPMKYDRFDEMVEMFCELRKSKGVTPEQARGILSQANYFGTMLVKMGVADSLLGGATYSTADTVRPALQLIKTKPGNTIVSSCFIMVRPAATGENEVLAMADCAINIHPTEDELVEIAGETAECAKIFGIDPKVAFLSYSTLGSGKGEDVDKMRNAAAKAKEKYPELPIEGEIQFDAAVSPRVARTKCKDSQVAGHANTFVFPDINAGNIGYKIAQRLGNFEAYGPILLGLNAPINDLSRGCNASEVYSMAIITAALA

SEQ ID NO: 1389 - protein, 346 aa, Roseburia intestinalis L1-82
MICAGRERQLQFIKSEELIMFGFGQLIDILKKDPKKIVFTEGDDPRILEAASRLLAGTFLHPILIGNPDKIAAEAEECGFNIRGAEIIDPTNYDRMDEMVDLFCELRKSKGVTPEQARGILSQANYFGTMLVKMGVADALLGGATYSTADTVRPALQLIKTKPGNTIVSSCFIMVRPAATGENEVLAMGDCAINIHPTEDELVEIAGETAQCAKIFGVDPKVAFLSYSTLGSGKGEDVDKMRNAAAKAKAKYPDLPIEGELQFDAAVSPRVARTKCPGNPVAGHANTFIFPEISAGNIGYKIAQRLGNFEAYGPILLGLNAPINDLSRGCNAAEVYSMAIITAALA

SEQ ID NO: 1390 - protein, 327 aa, Eubacterium rectale ATCC 33656
MFGFGQLIEILKKDPKKIVFTEGEDPRILEAASRLLASNFLHPILVGDPEKISASAEKSGFNIRGAEIIDPMNFDRMDEMVELFCELRKSKGVTPEQAKGILSSANYFGTMLVKMGIADSLLGGATYSTADTVRPALQLIKTKPGNTIVSSCFILVRPSATGENEVLAMSDCAINIHPTEDELVEIAGESAECAKIFGIDPKVAFLSYSTLGSGKGEDVDKMRNAAHKAREKYPNLPIEGEIQFDAAVAPRVARTKCPQSEVAGHANTFIFPDINAGNIGYKIAQRLGNFEAYGPILLGLNAPINDLSRGCNAGEVYSMAIITAALA

SEQ ID NO: 1391 - protein, 349 aa, Clostridium sp. L2-50
MIRINNQWRTIIVEERKNFGFGVLIDILKKNPKTIVLTEGTDPRILEASSRLLASNFLHPILVGDPDKIYEVAEESGFNIRGSEIINPRNFDRMDEMVEMFCELRKSKGVTPEQAREILYQNNYFGTMLVKMGIADSLLGGATYSTADTVRPALQLIKTRPGNTLVSSCFILVRPFATGGNEVFAMGDCGINIKPNEDELVEIAEETVRCARIFGVDPKVAFLSYSTYGSGKGEDVDKMRNAARKTKERNPDLPISGEIQFDAAVSPRVAKKKCPQSEVAGNANTFIFPDINAGNIGYKIAQRMGNFSAYGPILLGLNSPINDLSRGCTADEVYSMAIITAALADNKDA

SEQ ID NO: 1392 - protein, 328 aa, Shuttleworthia satelles DSM 14600
MGYGFGAMIDRLKANPKKIVFTEGSDERILQAASRLLAGTWLQPVLVGDPKEIHRVAEADGDNINGAAIIDPNNFDRMDEMVDLFIELRGAKAGTREQAVKTLKQANYFGTMLVRMGYADSLLGGATYSTADTVRPALQIIKAAPGNSIVSSCFILVRPSATGGNEVLCMADCAINLVPTEDQLVEICGQATKCAERFGVDPKVAFLSFSTKGSGKGESVTKMQNATAKAKVKYPDLPIEGELQFDAAVSPTVARQKAPDSQIAGHCNTFIFPDINAGNLGYKIAQRMGNFDAYGPILLGLNAPINDLSRGCNSQEVYDMAIVTASLA

SEQ ID NO: 1393 - protein, 323 aa, Eubacterium biforme DSM 3989
MIIDELEKKVQGKGVRIVFTEGWDPRVQKAAIDLKNNDVVCPVLLGTPEEIAGCAQKNSLNVEGIEQIDPNNFEHMDEMVRKMVELRRGKMDEEKVRTALKSTNYFGTMLVQMGYADGLLGGATYSTADTVRPALQLVKAAPGNKLVSSCFILIKEETQLIMGDCSININPNTDDLVEITMQTAKSARQFGVEPKVALLSYSTMGSAKGECVAKMTEASDRLRRIADFDIDGEMQFDCAVSEEVASLKAPNSKVAGHANTFIFPNLSSGNIGYKIAARLGGYEAVGPILQGLNAPINDLSRGCTSDEIYKMAIVTAAQKDMDI

SEQ ID NO: 1394 - protein, 336 aa, Eubacterium dolichum DSM 3991
MYNKAEEKVRIFFMINKLIEQIKGKGVRIVFTEGNDARIQEAAVRLHKENILVPILLGEKEELLESAKKNGFDLDGIELLDPKEYQHMELMVTRVVELRKGKLDEAQAREACLHRNFFGTMYVQLGCADGLLGGATYSTADTVRPALQLIKTRPGSSLVSSCFILQKEDQYLVMGDCSINIDPSADDLVEITLQTAHTVRQFGIEPRVGLLSYSTLGSAKGPSVSKVQEAAVRLKRMPLDFAVDGEMQFDCCVAPEVASLKAPGSTVAGNVNTFIFPDINSGNIGYKIASRLGGYEAIGPVLQGLNAPINDLSRGCNAEEVYKMAIVTAAQKFMDI

SEQ ID NO: 1395 - protein, 330 aa, Eubacterium dolichum DSM 3991
MGKTRILFAEGNDERMMEAAVHLHEEGFVEPVLFGDYNQIMTIAKQKGKQLEGIEIMDPSNISNEIKEQMVMEMIHLRKGKWDQAMCREKLEHANYFTTMALQIGLVDGLLGGSTTTTADTLRPALQLIKTNPTSSLVSSCFLMVKDEKVFLFSDCSLNINPSADELVDITLQTVESANQLGIVPKVGILSYSTLGSGKGESVDKMREVAKRLKRMMLDFEVEGEIQVDAALSKETAALKAPNSTIAGNINVLIFPSLDAGNIGYKLVARLGGYEAIGPIVQGLNKPVNDLSRGCTSEEVYKMARITAMQVSERKQQNSEESLDRLSTRV

SEQ ID NO: 1396 - protein, 328 aa, Anaerococcus hydrogenalis DSM 7454
MANDGVMELATENIRGKNRTIVFPEGDDSRVLRAAIRHNEDGLIVPILLGNKDEIQKVADQEGVKLGDIQIINPRESELLDELVDRYVELRKGKNTREDGEYLLKKDNNYFGTMLIETGKADGMVSGAAHPTGDTVRPALQLIKTRKGVNRVSGVMIMLGPNGEKLLFADTAINITLQSNELAEVAVEAARTAEEFGIEPIVAMLSFSTKGSAKHELARKVEEATKLAKEMDPDLRIDGEMQFDAAISPQVARKKIPNSDVAGRAKVFIFPDLQAANIGYKIGQRLGNYEALGPILQGLNKPVNDLSRGCNEEDVYKLTILTANQVRD

SEQ ID NO: 1397 - protein, 328 aa, Anaerococcus vaginalis ATCC 51170
MANDGVMELATENIRGKNRKIVFPEGNDSRVLRAAIRHQNDGLIVPILLGDKEEIQKVAEEEGVKLGDIQIINPRESELLDELVDKYVELRKGKNTREDGEYILKKDNNYFGTMLVQTGKADGMVSGASNPTGDTVRPALQLIKTRKSVNRVSGVMIMLGPNGEKLLFADTAINITLQSNELAEVAVEAAKTAEEFGIEPIVAMLSFSTKGSAKHELARKVEEATKLAKEMDPNLKVDGEMQFDAAISPQVARKKIPNSDVAGKAKVFIFPDLQAANIGYKIGQRLGGYEALGPILQGLNKPVNDLSRGCNEEDVYKLTILTANQVRD

SEQ ID NO: 1398 - protein, 328 aa, Anaerococcus tetradius ATCC 35098
MPKGILENAREAIEGKNLKIVFPEGSDPRILAAALRHKQEGLLIPIVLGDQGEIQKTADKLGLKLGDLKIINPQYSEDFDKLVEGFVEARRGKTSKEEAEFLLKTNVNYFGVMLIKEGFADGMVSGAIHTTGDTIRPALQIIRTKPGVNRVSGVMVMIGPKGNQLVFADTAVNITLESDELAEVAVETAKSAKSFGMDPYVALLSFSTHGSAHHDLATKVAKAKTRALEIDPDIKIEGEIQFDAAIDPETAAHKAPGSKVAGKCNVFIFPDLQAGNIGYKIAQRLGGYKALGPILQGLNAPVNDLSRGCSEEDVYEIAIITASQALNR

SEQ ID NO: 1399 - protein, 327 aa, Anaerococcus prevotii DSM 20548
MPEGILENARKTIAGKDLKIVLPEGSDPRVLAAALRHKEEGLLTPIVLGDQGEIQKTADKEGLKLGDLQIINPQYFEDFDKLVDVFVEVRRGKTSKEEAEFLLRTNVNYFGVMLVKAGYADGMVSGAVHTTGDTIRPALQIIRTKPGVNRVSGVMVMIGPDGNQLVFADTAVNITLESDELAEVAVETAKSAKSFGMDPYVALLSFSTHGSAHHDLATKVAKAKQRALEIDPELRVEGEIQFDAAIDPKTAAQKAPKSEVAGKCNVFIFPDLQAGNIGYKIAQRLGGYKALGPILQGLNAPVNDLSRGCSEEDVYEIAIITASQAVN

SEQ ID NO: 1400 - protein, 339 aa, Anaerococcus lactolyticus ATCC 51172
MARIGILEEAINIIKGKNLTIVLPEGNDPRVLEAAIRHQEEGLIKPLVLGDQGEIQKTANKLGKSISAIKILNPETFEQFEDMVDAFAEIRKGKIDRDEAEFILKRDLNYFGVMLVKLGYADGLVSGAIHTTADTIRPALQIIRTIPGRKRVSGVMVMLGPNGEQLVFADTAVNITLEADELAEVAVETAHTAKTFGLDPYVAMLSFSTHGSAHHDLATKVARATAIAKDINPDMKIVGEIQFDAAIDPETAKNKAPESDVAGKCNVFIFPDLQAGNIGYKIAQRLGGYKALGPILQGLNAPVNDLSRGCSAQDVYEIAIITAMQAAERAREAAEAANK

SEQ ID NO: 1401 - protein, 331 aa, Streptococcus pyogenes MGAS8232
MSIRSLFGGLREKILGKNMKIVFPEGNDERVVRAAARLKFEGLLEPIILGQSEEVRNLLTKLGFADQDYTIINPNEYADFDKMKETFVDIRKGKATLEDADKMLCDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIAKGLNSDLALDGELQFDAAFVPETAAIKASDSAVAGQANTFIFPDLQSGNIGYKIAQRLGMFDAIGPILQGLNKPVNDLSRGSSAEDIYKLAIITAAQAIESQG

SEQ ID NO: 1402 - protein, 331 aa, Streptococcus pyogenes M1 GAS
MSIRSLFGGLREKILGKNMKIVFPEGNDERVVRAAARLKFEGLLEPIILGQSEEVRNLLTKLGFADQDYTIINPNEYADFDKMKEAFVEVRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIATGLNPDLALDGELQFDAAFVPETAAIKAPDSAVAGQANTFVFPDLQSGNIGYKIAQRLGMFDAIGPILQGLNKPVNDLSRGSSAEDIYKLAIITAAQAIESQG

SEQ ID NO: 1403 - protein, 330 aa, Streptococcus uberis 0140J
MSIRSLFGSLKEKVVGKNVKIVFPEGNDERVVRAAARLKFEGLVEPIILGKAEDIRALLTKLGFADQDYQIINPEDYADFEKMKAEFVEIRKGKATIEDADKLLRDVNYFGVMLVKMGLADGMVSGAIHSTADTVRPALQIIKTKPGISRTSGVFLMNRENTNERYIFADCAINIDPNAQELAEIAVNTAETAAIFDIDPKIAMLSFSTKGSGKAPQVDKVAEATQIAKSLNPQLALDGELQFDAAFVPETAAIKAPDSDVAGKANTFIFPDLQSGNIGYKIAQRLGMFDAIGPILQGLNKPVNDLSRGSSAEDIYKLGIITAAQAIEAK

SEQ ID NO: 1404 - protein, 333 aa, Streptococcus equi subsp. zooepidemicus
MSIRNLFGGLREKIVGKNMKIVFPEGNDERVVRAAARLKFEGLVEPIILGQADDIRSLLTQLGFADQHYTIINPNDYADFEKMKAAFVELRKGKATLEDADRLLRDVNYFGVMLVKLGLADGMVSGAIHSTADTVRPALQIIKTKPGISRTSGVFLMNRENTEQRLVFADCAINIDPTAQELAEIAVNTADTAKIFDIDPKVAMLSFSTMGSAKAPQVEKVQEAVRIAKELRPELALDGELQFDAAFVPSTAAIKAPDSSVAGHANVFVFPDLQSGNIGYKIAQRLGMFDAIGPILQGLNKPVNDLSRGSSAEDIYKLAIITAAQALENESIN

SEQ ID NO: 1405 - protein, 331 aa, Streptococcus mutans NN2025
MGIRSLFGSLREKIVSKNVRIVFPEGNDERVVRAAARLKFEGLIEPIILGDATEVRNLLTKLGFADQDYTIINPEDYTDFEHMKQEFVEIRKGKATIEDAEQLLKDVNYFGVMLVKLGLADGMVSGAIHSTADTVRPALQIIKTKPGISRTSGVFLMNRETTDQRLIFADCAINIEPDEQELAEIAINTADTAKIFDIDPKIAMLSFSTKGSAKASQVEKVQEATRIAKELRPEITLDGELQFDAAFVPTTAKIKAPESDVAGQANVFIFPDLQSGNIGYKIAQRLGMFDAIGPILQGLNMPVNDLSRGSSAEDIYKLAIITAAQTLDNTK

SEQ ID NO: 1406 - protein, 332 aa, Streptococcus infantarius subsp. infantarius ATCC BAA-102
MGIRSLFGSLREKIVGKNLKIVFPEGNDERVLRAAARLKFEGLIEPIILGEATEVRELLAKFGFADQNYVIINPQTYDKFDEMKEAFLEIRKGKASPEDADRLLKDINYFGVMLVKLGLADGMVSGAIHSTADTVRPALQIIKTKPGISRTSGVFLMNRESTDQRFMFADCAINIDPNAQELSEIALNTAETARIFDIDPKIAMLSFSTKGSAKAPQSEKVREATQLAKGRQPELAIDGELQFDAAFVPSTAEVKAPDSDVAGQANVFIFPDLQSGNIGYKIAQRLGMFEAIGPILQGLNKPVNDLSRGSSAEDIYKLAIITAAQAVDDMNE

SEQ ID NO: 1407 - protein, 330 aa, Streptococcus agalactiae A909
MRSLFGGLREKVASDYVKIVFPEGSDERVLRAAARLKFEGLVDPVILGKADEVHDSLARLGFVDQDYSVIDPEQYEKFEEMKEAFVEIRKGKATMEDADRLLKDVNYFGVMLVKLGLADGMVSGAIHSTADTVRPALQIIKTKPGISRTSGVFLMNRENTQERYIFADCAINIDPNAQELAEIAVNTADTAKIFDIDPKIAMLSFSTKGSAKAPQAEKVQEAAKIAKDLSPELAVDGELQFDAAFVPETAEIKAPNSDVAGKANVFIFPDLQSGNIGYKIAQRLGMFEAIGPILQGLNAPVNDLSRGSSAEDIYKLAIITAAQAIDEKSK

SEQ ID NO: 1408 - protein, 327 aa, Streptococcus salivarius SK126
MRSLFGELRERIAGKGVKIVFPEGNDDRVVRAAARLKFEGLVDPIILGDPAEVHKILNDLGFADFNYTIINPETYEDFEEMKEKFVEIRKGKATIEDAEKLLRDVNYFGVMLVKLGLADGMVSGAIHSTADTVRPALQIIKTKPGISRTSGVFLMNRENTDHRLMFADCAINIEPNAQELAEIAINTAETAKVFGIDPKVAMLSFSTKGSAKSPKVDRVVQATNIAKEMRPDLAIDGELQFDAAFVPATAAIKAPDSDVAGHANVFVFPGLQAGNIGYKIAQRLGMFEAIGPILQGLNKPVNDLSRGASAEDIYNLAIITAAQALNN

SEQ ID NO: 1409 - protein, 327 aa, Streptococcus thermophilus LMG 18311
MHSLFGELREHISGKGVRIVFPEGNDDRVVRAAARLKFEELVDPIILGDPTEVHKILNDLGFVDFNCTIINPETYEGFEEMKEKFVEVRKGKATIEDADKLLRDVNYFGVMLVKLGLADGMVSGAIHSTADTVRPALQIIKTKPGISCTSGVFLMNREDTNHRLMFADCAINIEPNSQELAEIAINTAETAKVFGIDPKVAMLSFSTKGSAKSPKVDRVVQATNIAKEMRPDLAIDGELQFDAAFVPATAAIKAPDSDVAGQANVFVFPCLQAGNIGYKIAQRLGMFEAIGPILQGLNKPVNDLSRGASAEDIYNLAIITAAQALNN

SEQ ID NO: 1410 - protein, 324 aa, Streptococcus pneumoniae CCRI 1974
MEVFESLKANLVGKNARIVLPEGEEPRILQATKRLVKETEVIPVLLGNPEKIKIYLEIEGIMDGYEVIDPQHYPQFEEMVSALVERRKGKMTEEDVRKVLVEDVNYFGVMLVYLGLVDGMVSGAIHSTASTVRPALQIIKTRPNVTRTSGAFLMVRGTERYLFGDCAININPDAEALAEIAINSAITAKMFGIEPKIAMLSYSTKGSGFGESVDKVVEATKIAHDLRPDLEIDGELQFDAAFVPETAVLKAPGSTVAGQANVFIFPGIEAGNIGYKMAERLGGFAAVGPVLQGLNKPVNDLSRGCNADDVYKLTLITAAQAVHQ

SEQ ID NO: 1411 - protein, 325 aa, Streptococcus sp. 2_1_36FAA
MKIFDDIRDALQDKEVKIVLPEGEEPRILQATKRLVKETSITPVLLGNPEKIRIYLEIEGITEGYQVIDPTNCSCFEEMVEAFVERRKGKITADEARQLLKEDVNYFGVMLVYLGKVQGMVSGAIHSTAATVRPALQIIKTLPWVSRTSGAFLMVRDDERYIFSDCAINIDPDANVLAEIAINSALTAQIFDIDPKVAMLSYSTKGSGFGEKVDKVVEATKLAQEMRPDLAIDGELQFDAAFVPATAELKAPGSPVAGQATVFVFPSIEAGNIGYKLAERLGGFSAVGPILQGLNHPVNDLSRGCNADDVYKLTLITASQAVGHY

SEQ ID NO: 1412 - protein, 326 aa, Streptococcus suis 05ZYH33
MFMKIFEQLATKLEGKKVRIVLPEGEEPRILQATKRLVNESDVVPVLLGNPDRIKIYLDIEGITEGFEIIDPAHYDRYDEMVAALVERRKGKVSEEQAHELLKDVNYFGVMLVYMGVVEGMVSGAIHSTASTVRPALQIIKTEPGVSKTSGAFLMVKGEERYIFGDCAINIDPDAQTLAEIAINSARTAKMFGIDPKVAMLSYSTKGSGSGPKVDKVVEATKIAQKLRPELDLDGELQFDAAFVPATGKLKAPGSSVAGQATVFIFPGISAGNIGYKIAERMGGFAAVGPVLQGLNQPVNDLSRGCNPDDVYNLTLITAVQALEHR

SEQ ID NO: 1413 - protein, 325 aa, Lactobacillus johnsonii NCC 533
MKVFDSLKKKAEESKKVIVFPEGNDDRIIKAAVRLEKEGIVKPLLLGKPDEVIKTAQSLNVDLGSIEIINPAVYPDFEKMCQDFVELRKGKNTLAEAKEILQDVSYFGTMLVYEGKADGMVSGATHSTANTVRPALQIIKTKKGMSRVSGAMIMERGDEKYIFADCAINIDPDSETLAEIAYQSSKTAEMIGLEPKIAMLSFSTKGSAKGPMVTKVQEATELVHQKYPDLICDGELQFDAAIVPRVGEAKAPGSAVAGHANVFIFPELQSGNISYKVAERLGGFSAIGPVLQGLAAPINDLSRGCKTEDVYLLAILTAAQANMEK

SEQ ID NO: 1414 - protein, 329 aa, Lactobacillus acidophilus NCFM
MSVFSLFKEQVEQADEKKKIIFPESNDLRILTAVSNLNKDNIIDPILIGKREDIEKLAAENNLDLDGVKIYDQNNYAGLDEMAEAFVKARKKDTSIAEAKAKLAKGNYFGTMLVKMGKADGMVSGAAHSTANTVLPALQLIHAAKGMHRVSGAFVMEKGDERYIFADCAINIDPDEETLAEIGYQSAQTAKMAGIDPKVAFLSFSTKGSAEGPMVNKVHDAAAMFQKDHPEIPADGELQFDAAFVPSVGEKKAPGSKVAGHANVFVFPELQSGNIAYKMVQRLGNFTAVGPILQGLAAPVNDLSRGCSEQDIYDLAIVTAAQALAKDEK

SEQ ID NO: 1415 - protein, 329 aa, Lactobacillus ultunensis DSM 16047
MSVFSLFKKQVEEASEKKRIVFPESDDLRVLTAVSNLNKDGIIEPILIGNKDEVQKLAADHNLDIDGVKIYDQNNYDDLDEMADAFVKARRKDTSIAEAKAKLAQGNYFGTMLVQMGKADGMVSGAAHSTANTVLPALQLIHAAKGMHRVSGAFVMEKGNERYIFADCAININPDEETLAEIGYQSAQTAKMAEIDPKVAFLSFSTNGSATGPMVDKVHDAAAMFQKNHPEIPADGELQFDAAFVPAVGKKKAPDSKVAGHANVFIFPELQSGNIAYKMVQRLGGFTAVGPILQGLAAPVNDLSRGCSEQDIYDLAIVTAAQSLAKDNK

SEQ ID NO: 1416 - protein, 329 aa, Lactobacillus crispatus JV-V01
MSVFSLFKKQVEAAKDKKRIVFPEGDDLRILTAIANLKKDGIIEPILIGNPDEIAKLVKENNLDLAGVKIYDLNHYDELDQMAAEFVKARRKDTSIAEAKLKLAQGNYFGTMLVKMGKADGMVSGAAHSTANTVLPALQLIHAAKGMHRVSGAFVMEKGDERYIFADCAININPDEETLAEIGYQSALTAKMAEIDPKVAFLSFSTKGSAEGPMVDKVHDAAAMFQKDHPEIPADGELQFDAAFVPAVSEKKAPNSKVAGHANVFVFPELQSGNIGYKMVQRLGGFTAVGPILQGLAAPVNDLSRGCSEQDIYDLAIVTAAQALAKDEK

SEQ ID NO: 1417 - protein, 329 aa, Lactobacillus helveticus DSM 20075
MSVFSLFKKQVEAAKNKKRIVFPESDDLRILTAVSNLNKDGIIEPILIGNKENIAKTAEENNLDLAGVKIYDPNNYADLDEMVKVFIEARRKDTSEAEARAKLAKENYFGTMLVKMGLADGMVSGAAHSTANTVLPALQLIHAAEGMHRVSGAFVMEKGDERYIFADCAINIEPDKETLAEIGYQSALTAKMAEIDPKVAFLSFSTKGSAEGPMVDKVHDATAMFQKSHPEIPADGELQFDAAFVPTVGEKKAPGSKVAGHANVFVFPELQSGNIAYKMVQRLGGFTAVGPILQGLAAPVNDLSRGCSEQDIYDLAIVTAAQALAKDEK

SEQ ID NO: 1418 - protein, 325 aa, Lactobacillus jensenii JV-V16
MSIFDELKEKIVGQEKVIVFPEGEDERVLKAAVKLKNEGIIQPLVLGDETQIKQTAKTHELDLTGLKIINPKNDIRKDDFAKQYYELRKGKESEEQAKKQISDPNYFANMLVYNGLADGCVSGAAHSTADTVRPALKIIKTQAGMKRVSGQFIMEKGQQRYIFSDCAMNIDPDADTLVEIAYQAAQTAKMVGLEPKLAFLSFSTMGSAKGEMVSKVQDATASFKEKYPEISADGEMQFDAAFVPSVGAKKAPDSNVAGHANVFIFPELQSGNIGYKIAQRLGDFTAIGPILAGLAKPVNDLSRGCSSQDVYEAAILTAAQSLDVE

SEQ ID NO: 1419 - protein, 325 aa, Lactobacillus jensenii 269-3
MSIFDELKAKIVGHKKVIVLPEGEDERVLSAAVKLNSEGIIKPLVLGDEAQIKETAKDHKLDLTGIEIINPKTDTRKGEFAKQYFELRKGKESEEQASSQVLDPNYFANMLVYNGLADGCVSGAAHSTADTVRPALKIIKTKAGMKRVSGQFIMEKGDQRYIFSDCAMNIDPDADTLVEIAYQAAQTAKMVGLEPKLAFLSFSTMGSAKGEMVSKVQAAAASFKEKYPEISADGEMQFDAAFVPSVGAKKAPDSNVAGHANVFIFPELQSGNIGYKIAQRLGDFTAIGPVLAGLAKPVNDLSRGCSSQDVYEAAILTAAQSLDEE

SEQ ID NO: 1420 - protein, 329 aa, Lactobacillus delbrueckii subsp. bulgaricus ATCC 11842
MEVFEQLKQLIKQKDKQRIVFPEGEDPRILTAVSRLKQDDLVEPIVLGQKDQVLALAEKAGLDMTGIEIVDYQNSPDFGEMVEKFHERMAGGKHFQTMEEAEAALRDANFYGTMLVYTGQADGMVSGAAHSTADTVRPALFILKTKPGMHRISGSFIMERGEEKYVFADCAISIDPTSDQLVEFAAQSAATAKMIGIDPKVAFLSFSTHGSAKGPQVDKVAEAAKLFKEKYPDIPADGDLQFDAAFVPAVAELKAPGSAVGGRANVFIFPELQSGNIAYKITQRLGNFTAIGPVLQGIAKPVNDLSRGCSADDVYKIGILTAAQAVMEG

SEQ ID NO: 1421 - protein, 326 aa, Lactobacillus iners DSM 13335
MKVFDILKQKALSCEQSIVFPEGNDLRVLEAVCRLKSERMVNPILLGDVDEIKKLALQNHLNLADIRIINPLTYNQIDEMIDALVKRRNGKNTVQEAAEMLKHGSYFGTMLVYLHKAAGMVSGAAHSTADTVRPALQIIKTLPGMSRVSGAMIIERETEKYIFSDCAINIDPDAQTLAEIAYQSYLTAKMIGLDPKVAMLSFSTKGSAKGPMIDKVIQATKIVHETHPEVKIDGELQFDAAFVANVAAKKAPNSEVAGKANVFVFPELQSGNIGYKIAQRLGNFTAVGPVLQGLAAPINDLSRGCSANDVYLAGILTAVQAIEAKK

SEQ ID NO: 1422 - protein, 323 aa, Bacillus subtilis subsp. subtilis str. 168
MADLFSTVQEKVAGKDVKIVFPEGLDERILEAVSKLAGNKVLNPIVIGNENEIQAKAKELNLTLGGVKIYDPHTYEGMEDLVQAFVERRKGKATEEQARKALLDENYFGTMLVYKGLADGLVSGAAHSTADTVRPALQIIKTKEGVKKTSGVFIMARGEEQYVFADCAINIAPDSQDLAEIAIESANTAKMFDIEPRVAMLSFSTKGSAKSDETEKVADAVKIAKEKAPELTLDGEFQFDAAFVPSVAEKKAPDSEIKGDANVFVFPSLEAGNIGYKIAQRLGNFEAVGPILQGLNMPVNDLSRGCNAEDVYNLALITAAQAL

SEQ ID NO: 1423 - protein, 323 aa, Bacillus amyloliquefaciens FZB42
MADLFTKVQEKVAGKDVKIVFPEGLDERILVAVNNLAGNKVLKPIVVGNKEDIQAKAKELNLTLDGVDIFDPHTYEGMEELVQAFVERRKGKATEEQARKALLDENYFGTMLVYKGLADGLVSGAAHSTADTVRPALQIIKTKEGVKKTSGVFIMARGDEQYVFADCAINIAPDSQDLAEIAIESANTAQMFDIDPRVAMLSFSTKGSAKSDETDKVAEAVKIAKEKAPELTLDGEFQFDAAFVPSVAEKKAPDSDIKGDANVFVFPSLEAGNIGYKIAQRLGGFEAVGPILQGLNMPVNDLSRGCNAEDVYNLALITAAQAL

SEQ ID NO: 1424 - protein, 323 aa, Bacillus licheniformis ATCC 14580
MADLFTTVQGKVAGKGVKIVFPEGLDERILTAVNKLAGNNVLKPILVGNEQEIKDKANGLNLTLDGVDIYDPHTYEGMEDLVQAFVERRKGKATEEQARQILLDENYFGTMLVYKGLADGLVSGAAHSTADTVRPALQIIKTKEGVKKTSGVFIMARGDEQYVFADCAINIAPDSQDLAEIAIESANTAKMFDIEPRVAMLSFSTKGSAKSDETEKVANAVAIAKEKAPELTLDGEFQFDAAFVPSVAEKKAPDSVIKGDANVFVFPSLEAGNIGYKIAQRLGNFEAVGPILQGLNMPVNDLSRGCNAEDVYNLALITAAQAL

SEQ ID NO: 1425 - protein, 323 aa, Bacillus pumilus ATCC 7061
MADIFSTVQEKVAGKGVKIVFPEGMDERILTAVQKLADGKVLQPIVVGKTQEVEAKAKELGLTLDGVDVYDPHTYEGFEELVQAFVERRKGKATEEQARKALLDENYFGTMLVYKGLADGLVSGAAHSTADTVRPALQIIKTKEGVKKTSGVFIMARGEEQYVFADCAINIAPDSQDLAEIAIESANTAKMFDIEPRVAMLSFSTKGSAKSDETEKVSEAVRIAKEKAPELVLDGEFQFDAAFVPSVAAKKAPDSVIKGDASVFVFPSLEAGNIGYKIAQRLGNFEAVGPILQGLNQPVNDLSRGCNAEDVYNLALITAAQAL

SEQ ID NO: 1426 - protein, 327 aa, Anoxybacillus flavithermus WK1
MSDLFAALKQKVAGKNVTIVFPEGLDERILTAVGRLAAENVLCPIVIGEKEAVAQKAKELGLTLEKVEIINPHTYEGMNEMVAAFIERRKGRVTEEDARNILLDENYFGTMLVYMGKAHGLVSGAAHSTADTVRPALQIIKTKPGIRKTSGVFIMVRGDEKYVFADCAINIAPDSQDLAEIAVESAQTAKMFDIEPRVAMLSFSTKGSAKSPETEKVIEAVRIAKEMAPELTLDGEFQFDAAFVPSVAKKKAPDSVIQGDANVFIFPSLEAGNIGYKIAQRLGNFEAVGPILQGLNQPVNDLSRGCNAEDVYKLSLITAAQALAAMK

SEQ ID NO: 1427 - protein, 324 aa, Geobacillus sp. WCH70
MSSDLFSALKEKVVGKQRKIVFPEGLDERILTAVSRLANEQVVIPIVIGNEEAVKQKANELGLTLPNVEIIDPHQYEEMDELVKAFVERRNGKVTEEVAREMLLDENYFGTMLVYMDKAHGLVSGAAHSTADTVRPALQIIKTKPGIRKTSGVFIMVRGDEKYVFADCAINIAPDSQDLAEIAVESANTAKMFDIEPRVAMLSFSTKGSAKSPETEKVVEAVRLAKEMAPDLVLDGEFQFDAAFVPSVAKKKAPDSVIQGDANVFIFPSLEAGNIGYKIAQRLGNFEAVGPILQGLNKPVNDLSRGCNAEDVYKLTLITAAQSL

SEQ ID NO: 1428 - protein, 324 aa, Geobacillus thermodenitrificans NG80-2
MANDLFTALKEKVVGTGRKIVFPEGTDDRILTAASRLAAEQVLLPIVLGDEQAIKARAAELGLPFDGVDIINPRDYAEFDQLVSAFVERRKGKVTEEAARKLLLDENYFGTMLVYTGAADGLVSGAAHSTADTVRPALQIIKTKPGVRKTSGVFIMVRGEEKYVFADCAINIAPDSQDLAEIAIESARTAAMFGLHPRVAMLSFSTKGSASSPETEKVAEAVRLAKEMAPDLVLDGEFQFDAAFVPEVAKKKAPDSVIQGDANVFIFPSLEAGNIGYKIAQRLGGFEAVGPILQGLNKPVNDLSRGCSAEDAYKLALITAAQSL

SEQ ID NO: 1429 - protein, 326 aa, Geobacillus kaustophilus HTA426
MTTDLFTALKAKVTGTGRKIVFPEGTDDRILTAASRLATEQVLRPIVLGDEQAIRVKAAALGLPLEGVEIVNPRRYGGFDELVSAFVERRKGKVTEETARELLFDENYFGTMLVYTGAADGLVSGAAHSTADTVRPALQIIKTKPGVRKTSGVFIMVRGDEKYVFADCAINIAPNSQDLAEIAVESARTAKMFGLKPRVALLSFSTKGSASSPETEKVVEAVRLAKEMAPDLILDGEFQFDAAFVPEVAKKKAPDSVIQGDANVFIFPSLEAGNIGYKIAQRLGGFEAVGPILQGLNKPVNDLSRGCSAEDAYKLALITAAQSLGE

SEQ ID NO: 1430 - protein, 323 aa, Bacillus sp. SG-1
MSNLFETLKAKVTGKDLKIVFPEGQDERILQAASRLASDGILTPVIIGNAGNVEAKAQEVNVSLEGCEILDPADNEFMDELVQSFVDRRKGKATEEDAKKILLDENYFGTMLVYTGKAHGLVSGAAHSTADTVRPALQIIKTKEGIRKTSGVFIMVREGEKYVFADCAINIAPDSQDLAEIAIESAKTAEMFDIDPRVAMLSFSTKGSAKSPETEKVTEAVNIAKEKAPELTLDGEFQFDAAFVPSVASKKAPDSVLKGDANVFIFPSLEAGNIGYKIAQRLGNFEAVGPILQGLNAPVNDLSRGCNEEDVYKLALITAAQAL

SEQ ID NO: 1431 - protein, 323 aa, Bacillus coahuilensis m4-4
MSDLFQSLKDKVSGQNLKIVFPEGLDERILTAASRLAADKIVTPILVGAKEDVEKKAKELNVIVDGCEIYDPATYEKMPELVAAFVERRKGKASEEDAKRILQDENYFGTMLVYTKLAHGLVSGAAHSTADTVRPALQIIKTKEGVRKTSGVFIMVREEEKYVFADCAINISPDSQDLAEIAIESAKTAEMFDIDPRVAMLSFSTAGSAKSPETEKVVEAVKVAHERAPHLTLDGEFQFDAAFVPSVAAKKAPNSVIQGDANVFVFPSLEAGNIGYKIAQRLGNFEAVGPILQGLNAPVNDLSRGCNEEDVYKLALITAAQAL

SEQ ID NO: 1432 - protein, 325 aa, Bacillus sp. NRRL B-14911
MSDLFEGLRNKVSGNNLRIVFPEGTDERILTAAGRLAADKILTPILIGDIAQIEDKAKSLDVSLDSVEIYDPKNFAMMDELVAAFVERRKGKATEEDARRILLDENYFGTMLVYANKADGLVSGAAHSTADTVRPALQIIKTKEGVKKTSGVFIMVREDEKYVFADCAINIAPDSADLAEIAIESAKTARMFDIDPRVAMLSFSTKGSAKSPETEKVSQAVEEAKLREPLLIVDGEFQFDAAFVPSVAEKKAPDSPLQGDANVFVFPSLEAGNIGYKIAQRLGNFEAVGPILQGLNRPVNDLSRGCDQEDVYKLALITAAQALNQ

SEQ ID NO: 1433 - protein, 324 aa, Oceanobacillus iheyensis HTE831
MGLFEQLAEKVTAADKKIVFPEGLDERILTAASRLAEEGIMTPILIGGTQDVEAKAKDLDVSLKGCEVIDPANYDEFSDMVSAFVERRKGKATEEDAKKILLDGNYFGTMLVYLNKADGLVSGAAHSTADTVRPALQIIKTKEGVKKTSGVFIMVRDEEKYVFADCAINITPDSNDLAEIAVESAKTGALFDVDPKVAMLSFSTKGSAKSPETEKVSEALEIAKEKDPSLVIDGEFQFDAAFVPSVAEKKAPDSVLKGNANVFVFPSLEAGNIGYKIAQRLGGFEAVGPILQGLNRPVNDLSRGCSSEDVYNLALITAAQAVGE

SEQ ID NO: 1434 - protein, 323 aa, Bacillus cereus BGSC 6E1
MSNLFTTVKEKVQGKGISIVLPEGTDERILGAAERLAKEELVKPILVGNKEEISAKAASMNLTLAGVDIYDPATYEEMEAMVASFVERRKGKATEEDARKILKDENYFGTMLVYMGKAHGLVSGAAHSTADTVRPALQIIKTKPGVTKTSGVFIMVREEEKYVFADCAINIAPNSQDLAEIGIESAKTAELFGIDPRVAMLSFSTKGSAKSPETEKVVEATRIAKEMAPELTLDGEFQFDAAFVPSVAEKKAPGSTIKGDANVFVFPSLEAGNIGYKIAQRLGNFEAVGPILQGLNMPVNDLSRGCNEEEVYKLALITAAQAL

SEQ ID NO: 1435 - protein, 325 aa, Listeria monocytogenes str. 4b F2365
MSDLFTTIKGQVTGKNVRIVLPEGTDERIVGAAARLQKENIVKPILLGNKGEIEAKAKEIGVSVEGIAIHEPATDPLFDELVAAFVERRKGKATEEAARKMLVDPNYFGTMLVYTGKAEGLVSGAAHSTGDTVRPALQIIKTKPGVSKVAGAMIMVRGEERYLFSDVAINIAPVAADLAENAIVSAETAEIFGIDPRVAMLSFSTKGSAKSDETEKVVEATALAKEKAPELTLDGEFQFDAAFVPTVAEKKAPGSVIKGDANVFIFPSLEAGNIGYKIAQRLGNFEAVGPILQGLNAPVNDLSRGCNTDDVYNLTLITAAQAVNK

SEQ ID NO: 1436 - protein, 325 aa, Listeria grayi DSM 20601
MSDLFGTIKQQVTGKNVRIVLPEGEDERIIEATARLQEEGIVVPILLGNKASITEKAAALNISLENVVIRDPESDADFNELVAAFVERRKGKATEEDAKRMLKDPNYFGTMLVFTGKADGLVSGAAHSTGDTVRPALQIIKTKPGISKVAGAMIMVKEDQRYLFSDVAINIAPSAEDLAENAIVSAETASIFGIDPRVAMLSFSTKGSAKSDETEKVVAATAIAQEKAPELALDGEFQFDAAFVPSVAEKKAPGSKIKGDANVFIFPSLEAGNIGYKIAQRLGDFEAVGPILQGLNAPVNDLSRGCNAADVYHLTLITAAQAVNK

SEQ ID NO: 1437 - protein, 330 aa, Bacillus halodurans C-125
MSDLFRNIQEQVKRHQPTIVLPEGTDERILEAAANLAKDEVVKPILVGNVADIQARASELNIDLGSVEIIDPKSYGAFDDMVHAFVERRKGKETEETAREKLVDVNYFGTMLVYTGVADGLVSGAAHSTGDTVRPALQIIKTQPGIKRTSGVFIMVKEDQKLVFADCAINIAPTAEELAEIAVATAETAKVFDIDPKVAMLSFSTKGSAVSPETEKVAEATKLAQEARPDLVIDGEFQFDAAFVPAVAQKKAPESPLKGEANVFVFPSLESGNIGYKIAQRLGGYEAIGPILQGLNQPVNDLSRGCNASDVYKLSLITALQAINQKGDNN

SEQ ID NO: 1438 - protein, 331 aa, Bacillus clausii KSM-K16
MGDLFADIKRQVESHKPSIVLPEGTDERVLQAAAKLAADNVVKPIVIGDNDAILALADKLKITLEGITIYNPETYPGIDEMVDAFVARRKGKETEESARKLLQDVNYFGTMLVYMEKADGLVSGAAHSTGDTVRPALQIIKTQPGIKRTSGVFVMVKEDKKFVFGDCAINISPNEEELAEIATATADTAKLFGIEPKVAMLSFSTLGSASSQETKKVSAATKIAQESRPDLIIDGEFQFDAAFVPAVAQKKAPDSPLKGEANVFIFPSLESGNLGYKIAQRLGGYDAIGPILQGLNKPVNDLSRGCNVDDVYKLSLITGMQAITQKTGQGV

SEQ ID NO: 1439 - protein, 329 aa, Exiguobacterium sp. AT1b
MKLFETLKQKVSPVRPTIVFPEGIDERVLGAAVRLKADGMVEPIVVGAKADLEAVAAKHGFDISGLTQYDPATYEDIDVLVESFVERRKGKATAEQARELLTSDVNYFGTMLVHTGKAEGLVSGAMHATADTVRPALQIIKMQPGIKKTSGVFIMVRDDEQYVFSDCAINIAPDAADLAENAFLSAATAKTFGIDPQVALLSFSTKGSAKSPETEKVVEATRLAKEKSPNLPIDGELQFDAAFVPSVAAKKAPGSDVAGKANVFVFPSLEAGNIGYKMVQRFGGFEAIGPILQGLNKPVNDLSRGCNEEDVYKLTLITAAQAIDERNEA

SEQ ID NO: 1440 - protein, 328 aa, Exiguobacterium sibiricum 255-15
MQLFEMLETKVKAHQPTIVFPEGIDARVLGAAVRLKKDGLVTPIVIGPRGQIEETASANNIDVADLETIDPASYEGIEELVASFVERRKGKATEEQARALILKDVNTFGTMLVHTGKAEGLVSGAMHATGDTVRPALQIIKMQEGYKKTSGVFIMVRDDEQYVFADCAINIAPDANDLAENAIASAKTAKTFGIDPKVALLSFSTKGSAKSPETERVVEATCLAKERAPELSIDGELQFDAAFVPSVAKSKAPESDVAGQANVFIFPSLESGNIGYKIAQRLGGFEAIGPILQGLNKPVNDLSRGCNEEDVYKLAIITAAQAVEERQA

SEQ ID NO: 1441 - protein, 325 aa, Bacillus selenitireducens MLS10
MSDMFTAIAEKVKTVKPSIVFPEGTDERILEATVRLKKEGILEPLLVGNPDEVKAKAGEAGVNVDDLTIYDPETYDGFDALVDAFVERRKGKNTKEQAQEILKTPNYFGTMLVYTGLASGLVSGAAHATGDTVRPALQIIKTKEGVKKTSGAFVMVRNDERYIFGDCAINIAPDASDMAETAVEAAKTARVFDIDPKVAMLSFSTKGSAVSPETEKVVEATALAKEKDPNLVVDGEFQFDAAFVPSVAKKKAPDSPLNGEANTFIFPSLEAGNIGYKVAQRLGGFEAIGPILQGLNQPVNDLSRGCNVEDVYKLSLITAMQGLAD

SEQ ID NO: 1442 - protein, 329 aa, Staphylococcus epidermidis M23864:W1
MADLLNVLQDKLSGKNVKIVLPEGEDERILTAATQLQERDYVSPIVLGNVDKIKSLAEEKSLDIANIEMIDPSSSDLKPELVDAFVERRKGKATKEQAEELLENVNYFGTMLVYTGKAAGLVSGAAHSTGDTVRPALQIIKTKPGVSKTSGIFFMIKGDEQYIFGDCAINPELDAQGLAEIAVESAKSAQSFGMEPKVAMLSFSTKGSAKSDDVTKVQDALKLAQEKVEADNIENVVIDGEFQFDAAILPSVAEKKAPGAKIQGDANVFIFPSLEAGNIGYKIAQRLGGYDAVGPVLQGLNSPVNDLSRGCSIEDVYNLSIITAAQSLQ

SEQ ID NO: 1443 - protein, 329 aa, Staphylococcus capitis SK14
MADLLNVLQEKLSGKNVKIVLPEGEDERVLTAATQLQESDYVSPIVLGNEEKIKSLAEEKSLNLTNIEIIDPSSSDLKPELVDEFVERRKGKATKEQAEEMLDNVNYFGTMLVYTGKAAGLVSGAAHSTGDTVRPALQIIKTKPGVSKTSGIFFMIKDDEQYIFGDCAINPELDAQGLAEIAEESAKSALSFGMEPKVAMLSFSTKGSAKSDDVTKVQEALKLAQEKVQSDNIENVVIDGEFQFDAAIVPSVAEKKAPGAKIQGDANVFIFPSLEAGNIGYKIAQRLGGYDAVGPVLQGLNSPVNDLSRGCSTEDVYNLSIITAAQSLQ

SEQ ID NO: 1444 - protein, 329 aa, Staphylococcus warneri L37603
MANLLNVLEDKLAGKNVNIVLPEGEDERVLTAATQLQVTDYVTPIVLGNKDKIQSLAKDKGLDLANIEVIDPSTSELKSELVDAFVERRNGKATKEQAEELLDNVNYFGTMLVYTGKAAGLVSGAAHSTGDTVRPALQVIKTKPGVSKTSGIFFMMKGEEQYIFGDCAINPELDAQGLAEIAVESAKSAQSFGMEPKVAMLSFSTKGSAKSDDVTKVQDALKLAQDKVAEEQLDYVVIDGEFQFDAAIVPSVAEKKAPGAKIQGDANVFIFPSLEAGNIGYKIAQRLGGYDAVGPVLQGLNSPVNDLSRGCSIEDVYNLSIITAAQSLQ

SEQ ID NO: 1445 - protein, 329 aa, Staphylococcus epidermidis ATCC 12228
MADLLSVLQDKLSGKNVKIVLPEGEDERVLIAATQLQKTDYVSPIVLGNEDNIKSLASKHALDLTQIEIIDPATSELKDELVDAFVERRKGKATKEQAVELLDNVNYFGTMLVYTGKAEGLVSGAAHSTGDTVRPALQIIKTKPGVSRTSGIFFMIKGDEQYIFGDCAINPELDAQGLAEIAVESAKSAQSFGMDPKVAMLSFSTKGSAKSDDVTKVQEALKLAQEKAEADQLDHVVIDGEFQFDAAIVPSVAEKKAPGAKIQGDANVFVFPSLEAGNIGYKIAQRLGGYDAVGPVLQGLNSPVNDLSRGCSTEDVYNLSIITAAQALQ

SEQ ID NO: 1446 - protein, 328 aa, Staphylococcus aureus A9635
MADLLNVLKDKLSGKNVKIVLPEGEDERVLTAATQLQATDYVTPIVLGDETKVQSLAQKLNLDISNIELINPATSELKAELVQSFVERRKGKATEEQAQELLNNVNYFGTMLVYAGKADGLVSGAAHSTGDTVRPALQIIKTKPGVSRTSGIFFMIKGDEQYIFGDCAINPELDSQGLAEIAVESAKSALSFGMDPKVAMLSFSTKGSAKSDDVTKVQEAVKLAQQKAEEEKLEAIIDGEFQFDAAIVPGVAEKKAPGAKLQGDANVFVFPSLEAGNIGYKIAQRLGGYDAVGPVLQGLNSPVNDLSRGCSIEDVYNLSIITAAQALQ

SEQ ID NO: 1447 - protein, 329 aa, Staphylococcus haemolyticus JCSC1435
MSSLLDVLQEKLSGKNVKIVLPEGEDERVLTAATQLQATDYVTPVVLGDYDKINLLAKDKGLDVSDIEIINPSTSELKPELVKSFVERRKGKATEEQADELLNNVNYFGTMLVYAGHADGLVSGAAHSTGDTVRPALQIIKTKPGVSKTSGIFFMIKDDQQYVFGDCAINPTLESSDLAEIAVESAKSAKSFGMDPRVAMLSFSTKGSAKSDDVDKVANAVKLAQEKVESEGLTDVVIDGEFQFDAAIVPSVAEKKAPGAKIQGNANVFVFPSLEAGNIGYKIAQRLGGFDAVGPVLQGLNSPVNDLSRGCSTEDVYKLSIITAAQTLQ

SEQ ID NO: 1448 - protein, 329 aa, Staphylococcus hominis SK119
MSSLLDVLQEKLSGKNVRIVLPEGEDERVLTAATKLQATNYVTPLVLGNEEKVNTLAQDKGLDISNIQIIDPSKSDLKPELVKSFVERRKGKATEEQAQELLNNVNYFGTMLVYAGHAEGLVSGAAHSTGDTVRPALQIIKTKPGVSRTSGIFFMIKEDKQYIFGDCAINPTLESSDLAEIAVESAKSAKSFGMDPRVAMLSFSTKGSAKSDDVEKVANAVKLAQEKVESEGLDNVVVDGEFQFDAAIVPAVAEKKAPGAKIQGDANVFVFPSLEAGNIGYKIAQRLGGFEAIGPVLQGLNSPVNDLSRGCSTEDVYNLSIITAAQTLQ

SEQ ID NO: 1449 - protein, 328 aa, Staphylococcus xylosus
MSLLDVLQEKLSGKNVKIVLPEGEDERVLTAATQLQGTDYVTPVVLGNEANVKALANDKGLDIANLEIIDPETSELKQELVTAFVERRKGKATEEQAQEMLKNVNYFGTMLVYTGKAEGLVSGAAHSTGDTVRPALQIIKTKPGVSKTSGIFFMIKDDQQYIFGDCAINPTLEAQDLAEIAVESAKSAKSFGMSPRVAMLSFSTKGSAKSDDVEKVSNAVDMAQEKIKADNIEDVVVDGEFQFDAAIVPEVAKKKAPDAKIQGDANVFVFPSLEAGNIGYKIAQRLGGFDAVGPVLQGLNSPVNDLSRGCSIEDVYNLSIITAAQSLQ

SEQ ID NO: 1450 - protein, 328 aa, Staphylococcus saprophyticus subsp. saprophyticus ATCC 15305
MTLLDVLQEKLTGKNVKIVLPEGEDERVLEAATQLQGTDYVSPILLGNESNIKALASDKGLEISDLEIIDPETSELKQELVTAFVERRKGKATEEQAQEMLKDVNYFGTMLVYTGKAEGLVSGAAHSTGDTVRPALQIIKTKPGVSKTSGIFFMIKDDKQYIFGDCAINPTLEAQDLAEIAVESAKSAKSFGMSPRVAMLSFSTKGSAKSDDVEKVATAVNLAQEKIEADHLEDVVVDGEFQFDAAIVPEVAKKKAPDAKIQGDANVFVFPSLEAGNIGYKIAQRLGGFDAVGPVLQGLNSPVNDLSRGCSKEDVYNLSIITAAQSLQ

SEQ ID NO: 1451 - protein, 329 aa, Staphylococcus carnosus subsp. carnosus TM300
MPSLLNVLQDKLSGKNVKIVLPEGEDERVLTAAVKLHSTDYVEPIVLGDAEKVQSLADDKGLDISGIEIITPETSDLKPELVDAFVERRKGKATKEQAEDMLNNVNYFGTMLVYTGKADGLVSGAAHSTGDTVRPALQIIKTKPGVSKTSGVFFMIKGDEQYVFGDCAINPTLEAADLAEIAVESAKTAKSFGMDPRVALLSFSTKGSAKSDDVEKVESATKLAQEKTEEEGLTDVVIDGEFQFDAAIVPKVAAKKAPDAKIKGDANVFIFPSLEAGNIGYKIAQRLGGYEAIGPVLQGLNSPVNDLSRGCSTEDVYNLSIITAAQTLQ

SEQ ID NO: 1452 - protein, 329 aa, Macrococcus caseolyticus JCSC5402
MANLLEVLNEKLSGKNVKIVLPEGNDERVLQAAVELHKGDKVAPIVLGDKAEIEALAAKLGVAIDGIEIMDPATSELREDLITKFVERRKGKATEEQATEMLKDPNYFGTMLVYAGHAAGLVSGAAHSTADTVRPALQIIKTKPGVSRTSGVFFMMRGEEQYVMGDCAINPQLDSQALAEIAIESAKTAKQFGMEPKVAMLSFSTKGSAKTPETEKVTEATKLAQEKLASESDLQGVVIDGEFQFDAAFVPSVAAKKAPESPIQGDANVFVFPSLEAGNIGYKIAQRLGGFDAVGPILQGLNAPVNDLSRGCSTEDVVSLSIITAAQSL

SEQ ID NO: 1453 - protein, 324 aa, Lactobacillus fermentum ATCC 14931
MDIFEKLADQLRGQDKTIVFPEGEDPRVLGAAIRLKKDQLVEPVVLGNQEAVEKVAGENGFDLTGLQILDPATYPAEDKQAMHDALLERRNGKNTPEQVDQMLEDISYFATMLVYMGKVDGMVSGAVHATGDTVRPALQIIKTKPGSHRISGAFIMQKGEERYVFADCAINIELDAPTMAEVASQSAETAKLFGIDPKVAMLSFSTKGSAKGDMVTKVAEATKLAKEANPDLAIDGELQFDAAFVPSVGELKAPGSDVAGHANVFIFPSLEAGNIGYKIAQRFGGFEAIGPVLQGLNAPVADLSRGTDEEAVYKVALITAAQAL

SEQ ID NO: 1454 - protein, 321 aa, Lactobacillus coleohominis 101-4-CHN
MDIFEKLANDLKGQQRTIVFPEGNDERIMGAAIRLHNDGILQPILLGNEADLGQVAKDHGWNLTGIEIIDPATYDKQAMHDALLERRKGKNTPEQVDQMLEDVSYFATMLVYMGKVDGMVSGAVHATGDTVRPALQIIKTKPGTKRISGAFIMQKGAERYVFADCAINIELDAPTMAEVAMESAHTAKLFGLDPKVAMLSFSTKGSAKGEMVTKVAEATQLVHKQAPELAVDGELQFDAAFVPTVGQLKAPDSKVAGHANVFIFPSLEAGNIGYKIAQRFGGFEAVGPILQGLNAPVADLSRGTNEDEVYKVAIITAAQVD

SEQ ID NO: 1455 - protein, 324 aa, Lactobacillus vaginalis ATCC 49540
MDLFDEIAAKVKGQDKTIVFPEGADKRILGAAVRLKNDDLVEPILLGSKSEIEATANENNFDITGLQIIDPAAYPEADKKAMFDALLERRKGKNTPEQVEKMLEDVSYFGTMLVYMGKADGMVSGAVHSTGSTVRPALQIIKTKPNAHRISGAFLMQKGDQRYIFADCAINIELDADTMAEVAVQSAETAKLFGIDPKVALLSFSTKGSAKGDMVTKVAEATEKVHEMEPELPADGEMQFDAAVVPSVGELKAPGSKVAGHANVFIFPSLEAGNIGYKIAQRFGGFTAVGPILQGLNAPIADLSRGCSEDDAYKVAIITAAQAL

SEQ ID NO: 1456 - protein, 324 aa, Lactobacillus reuteri DSM 20016
MELFDEIAAKIKGQNKTIVFPEGEDKRILGAAVRLKKDNLVEPILLGDEEAIKEVASKNGFDLAGLQIIDPATYPEDDKQAMFDSLMERRKGKNTPEEIQKMLEDVSYFGTMLVYMGKADGMVSGAVHSTGATVRPALQIIKTKPGAHRISGAFLMIKGDQRYIFADCAINIELDAPTMAEVAIQSAETARLFEIDPKVALLSFSTKGSAKGEMVTKVADAAKLVHELDPDLPADGELQFDAAVVPSVGELKAPDSKVAGHANVFIFPSLEAGNIGYKIAQRFGGFTAVGPILQGLNAPIADLSRGCSEDDAYKVAMITAAQAL

SEQ ID NO: 1457 - protein, 323 aa, Lactobacillus antri DSM 16041
MELFEEIAAKVKGQNKTIVFPEGEDKRVLGAAVRLQQDGLVKPILLGKRSEIEATAKENGWDLSALTVLDPAEYPAEDKQAMFDALLERRKGKNTPEQVEKMLQDVSYFGTMLVYLGKADGMVSGAVHSTGSTVRPALQIVKTKPGSHRISGAFLMIKGDQRYIFADCAINIELDAPTMAEVAVQSAETAKLFGIDPKVALLSFSTKGSAKGEMVTKVAEATEKVHELAPDLAADGELQFDAAFVPEVGELKAPDSKVAGHANVFIFPSLEAGNIGYKIAQRFGGFTAVGPILQGLNAPIADLSRGCNEDDVYKVALITAARA

SEQ ID NO: 1458 - protein, 326 aa, Leuconostoc mesenteroides subsp. mesenteroides ATCC 8293
MELFEQLKNKITGQNKTIVFPEGEDPRIQGAAIRLAADNLIEPILLGDAQEISKTAQAHNFDLSNIETIDPASYDENELAKLNATLVERRKGKTDAETAAKWLQNVNYFGTMLVYTGKADGMVSGAVHPTGDTVRPALQIIKTAPGSSRISGAFIMQKGEERYVFADAAINIDIDSDTMAEIAIQSAHTAQVFDIEPKVAMLSFSTKGSAKSPLVDKVATATALAKKLAPELADSIDGELQFDAAFVESVAAAKAPDSKVAGKANTFIFPSLEAGNIGYKIAQRLGGFEAIGPILQGLAKPVSDLSRGANEEDVYKVAIITAAQAL

SEQ ID NO: 1459 - protein, 330 aa, Leuconostoc citreum KM20
MLVVELFEQLKGKISGQNKVIVFPEGEDVRIQGAAVRLAAEGLIKPILLGAQKAIEATAVANNYDLSDLVIIDPATYDEKALAKLNAALVDRRKGKTDAETAAKWLADVNYFGTMLVYTGQADGMVSGATHPTGDTVRPALQIIKTAPGSSRISGAFIMQKGEARYVFSDAAINIDVDAETMAEIAVQSAKTAQVFDIEPKVAMLSFSTKGSAKSPLVDKVAEATAIAKKLAPDLADSIDGELQFDAAFVASVGEAKAPNSKVAGHANTFIFPSLEAGNIGYKIAQRLGGFEAIGPILQGLAKPVSDLSRGANEEDVYKVAIITAAQALV

SEQ ID NO: 1460 - protein, 326 aa, Weissella paramesenteroides ATCC 33313
MELFEQLANKIKGQNKTLVFPEGEDARIQGAAIRLAADGLVKPILLGKQSLIDATAEKHQFDLSNITVIDPASYPEDKLNDMIHELIERRHGKTDTATAKKWVTDVNYFGTMLVYMNLADGMVSGATHPTGDTVRPALQIIKTAPGSSRISGAFVMQRDDDRYIFADAAINIDIDAQTMAEIAIQSAKTAKVFGIDPKVAMLSFSTKGSAKATQVDKVSEATKIAKELEPSLALDGELQFDAAFVPEVAKSKAPDSEIAGQANVFIFPDLQSGNIGYKIAQRLGGFEAVGPILQGLAKPVSDLSRGANEEDVYKVAIITAAQALEN

SEQ ID NO: 1461 - protein, 364 aa, Oenococcus oeni ATCC BAA-1163
MTNLFTELADKIKGKKLRLVFPEGDDSRVQGAAIRLKKDGLLTPILLGDQAAVEKTAADNHFDLSGIKLIDPLKFDEKQFNQLIDKLVTRRKGKTDPQTAAMWLQEVNYFGTMLVYTGKADAMVSGAVHPTGDTVRPALQIIKTAPGVSRISGAFIMQKNDERYLFADSAINIELDAQTMAEIAVQSAHTAKIFGIDPKVAMLSFSTKGSAKHALVDKVAQATKLAQEMAPDLADNIDGELQFDAAFVESVAKLKAPGSKVAGHANVFIFPSLEAGNIGYKIAQRLGGYEAIGPILQGLAAPVSDLSCGASQEDVYKVAIIYCCSGFKKLVIFVSFDNNRTAFRIMDSQGNFFIKSMFWFGYFS

SEQ ID NO: 1462 - protein, 329 aa, Granulicatella adiacens ATCC 49175
MELFEELSLKVKGKDVKIVFPEGDEPRIIGAAVRLLADGLCKPILLGNVDAINEVAEARGFNISHLEIIDPETYADDKYAEMVASFVARRNGKVSEEDAQKLLRDVTYFGTMMVYMGLADGLVSGAVHSTGDTVRPALQIIKTKPGVSRTSGAFIMINSDKSKKYLFSDCAININPNAQELAEIAVESAKTAELFGIEPNVAMLSFSTKGSAKSEEALKVAEATKIAQELAPNYNIDGELQFDAAFVPSVGKQKAPDSPVAGQATVFVFPEIQSGNIGYKIAQRFGNFEAIGPILQGLNKPISDLSRGCNEEDVYKLAIITANQALMEN

SEQ ID NO: 1463 - protein, 327 aa, Granulicatella elegans ATCC 700633
MELFEELSGKIKGKGLKIVFPEGSEPRILGAVVRLKADELCHPILLGKKDEIEEVAQRRGFNLHDITVIDPETYENFDAVVESFVERRKGKATPEAARELLKDVTYFGTMMVHMGLADGLVSGAVHSTGDTVRPALQIIKTKPGVSRTSGAFIMINSDKSKKYLFSDCAININPNAQELAEIAVESAKTAELFGIEPNVALLSFSTKGSAKSEEALKVAEAARIAKELAPNYNIDGELQFDAAFVPSVGKQKAPDSPVAGEATVFVFPEIQSGNIGYKIAQRFGNFEAIGPILQGLNKPISDLSRGCNEEDVYKLAIITANQALMEA

SEQ ID NO: 1464 - protein, 326 aa, Carnobacterium sp. AT7
MELIESLSSKIKGKKVRIVFPEGSEPRILGAVVRLASEDLVQPVLIGNPEVVKEAAKNRGFNVENIEIVDPANYAKIDEMVASFVERRKGKVSEEKAIELLKDENYFGTMLTYMGLVDGLVSGAIHSTGDTVRPALQIIKTKPGVSRTSGAFIMMRGRGQEKYLFSDCAINVNPNAQELAEIAVESAKTAEMFGIEPKVAMLSFSTRGSAVAEEATKVAEATKIAQELAPQYDIDGEMQFDAAFVASVAEQKAPDSNVAGQASVFVFPELQSGNIGYKIAQRFGNFEAIGPILQGLNKPISDLSRGCNEEDVYKLTIITANQTLMN

SEQ ID NO: 1465 - protein, 327 aa, Enterococcus gallinarum EG2
MELFESLKFKIVRRHIKIVFPEATDPRILGAASRLRSEELVEPVLIGNPAEIEKAAEARGINIANFEILDPENYDRWDEMVEAFVERRNGKATKEQAEEILKDVNYFGTMLTYMGITEGMVSGAIHSTGDTVRPALQIIKTKPGVSRTSGAFLMVRGRDQEKYLFSDCAINVNPSAQELAEIAVDSAKTAELFDIDPKVAMLSFSTKGSAKAPEVDKVVEATKIAQELAPEYEIDGELQFDAAYISAVAQLKAPESEVAGKATVFVFPDLQSGNIGYKIAQRFGNFEAIGPILQGLNKPISDLSRGSNEEDVYKLSIITAAQTLMDK

SEQ ID NO: 1466 - protein, 341 aa, Enterococcus faecalis TX0104
MYDGFCKYKTGGFIVELFDSLKFKVVRRNIKIVFPEATDPRILGAAARLKSDELVEPILIGDPTDIANAAMARGINTSNFIIINPNDYEKWDEMVEAFVERRNGKATKEDAEKILKDVNYFGTMLTYMGIADGMVSGAIHSTGDTVRPALQIIKTKPGVSRTSGAFLMIRGRDQERYLFSDCAINVNPTAQELAEIAVDSAKTAELFDIEPKVSLLSFSTKGSAKAPEVTKVAEATKIAQELAPEYAIDGELQFDASYVSSVAQLKAPNSKVAGEATVFVFPDLQSGNIGYKIAQRLGNFEAIGPILQGLNKPVSDLSRGANEEDVYKLSIITAAQTLMND

SEQ ID NO: 1467 - protein, 338 aa, Enterococcus faecium TX1330
MIIHIKTSGGHLVELFDSLRFKIVRRGIKIVFPEATDARILGAAARLKAEELVEPILVGNEEEIRNAAHARGIKTSSFTIISPDTYDKWDEMVDAFVERRNGKASKEQAEKILKDVNYFGTMLTYMGVADGMVSGAIHSTGDTVRPALQIIKTKPGVSRTSGAMIMVRGRDQEKYVFSDCAINVNPTAQELAEIAVDSAKTAELFDIEPKVAMMSFSTKGSAKSPEVDKVVEATKIAKKLAPQYLIDGELQFDASYVPSVAQLKAPDSEVAGQATVFVFPELQSGNIGYKIAQRFGNFEAIGPILQGLNKPVSDLSRGANEEDVYKLSIITAAQTLID

SEQ ID NO: 1468 - protein, 328 aa, Lactobacillus sakei subsp. sakei 23K
MDLFESLKAKITRHDFKIVFPEGTEPRIIGAAARLNADRILKPILIGDAADIQSIASAKGFNLTGITIIDPKAYPQADFDTMVAAFVERRKGKATAEQAQTILQDPNYFGTMMVYLDLADGMVSGAVHSTGDTVRPALQIIKTKPGIQRTSGAFIMQRGRDNERYLFSDCAININPNAQELAEIAVASARTAELFDIDPKVALLSFSTMGSARGEEVTKVQEATKIAQELAPDLDIDGELQFDAAYVPVVANQKAPDSKVAGQANVFVFPELQSGNIGYKIAQRFGNFEAIGPILQGLNKPISDLSRGSNEEDVYKLAIITAAQALQN

SEQ ID NO: 1469 - protein, 327 aa, Catonella morbi ATCC 51271
MVMFKRLANNIKGKHLKIVFPEANDKRVLGAAVRLRVDDLVEPILLGNVEEVKALAAQNSWNIDAFTIIDPETYAEYDAMVAAFVERRKGKATEEQARELLKDVSYFGTMLVYMGLADGLVSGAVHSTGDTVRPALQIIKTKPGISRTSGAFIMVPAESDGQKLVFADCAININPSAQELAEIAVESAHTAKIFDIEPRVAMLSFSTKGSAKAPEVDKVVEATKLAQELAPEVLIDGELQFDASYSEIVADQKAPGSEVAGHATVYIFPDLQSGNIGYKIAQRLGRYEAVGPILQGLNAPISDLSRGCVEEDVYKVAIITANQALAN

SEQ ID NO: 1470 - protein, 326 aa, Lactococcus lactis subsp. cremoris MG1363
MELFESLKQKISGKDLKIVFPEGTDTRILGAANRLNADGLITPVFIGNVKEVTETLISRGINPEGFEIYDPENCGRFETMTETFVERRKGKVTEEQAKEILKDPNYFGTMLVYMGIADGMVSGAIHSTADTVRPALQIIKTKPGVKSVSGAFIMVRGRDDNEKYIFGDCAINIKPDAPTLADIAVASAETARLFDIDPKIAMLSFSTKGSGKSEDVDKVVEATTLVKEGHPEVEIDGELQFDAAFVPAVARQKAPDSEVAGRANVFIFPDIQSGNIGYKIAQRLGNFEAIGPILQGLNAPVSDLSRGCNEEDVYKLAIITAAQALK

SEQ ID NO: 1471 - protein, 325 aa, Lactobacillus casei ATCC 334
MDLFESLKDKINGKNLRIVFPEGEDPRVLGAAVRLAADGLIQAIVLGNPDKIQTLAAAKSWDLSKLTVRDPANDDLHAKMVAAFVERRKGKATPEQAEKIVQDANYFGTMLVYMKEADGMVSGAVHSTADTVRPALQIIKTRPGVHLVSGAFIMQRGRDERYLFADNAINIDPDADQLAEIAVESAKTAALFDIEPPRVALLSFSTKGSAKGPQVDKVVEATKKAHELAPDLALDGELQFDAAFVPTVAKQKAPDSKVAGEANVFIFPELQSGNIGYKIAQRFGGFEAIGPILQGLNQPVSDLSRGANEEDVYKLAIITAAQTLL

SEQ ID NO: 1472 - protein, 325 aa, Lactobacillus plantarum WCFS1
MDLFESLAQKITGKDQTIVFPEGTEPRIVGAAARLAADGLVKPIVLGATDKVQAVANDLNADLTGVQVLDPATYPAEDKQAMLDALVERRKGKNTPEQAAKMLEDENYFGTMLVYMGKADGMVSGAIHPTGDTVRPALQIIKTKPGSHRISGAFIMQKGEERYVFADCAINIDPDADTLAEIATQSAATAKVFDIDPKVAMLSFSTKGSAKGEMVTKVQEATAKAQAAEPELAIDGELQFDAAFVEKVGLQKAPGSKVAGHANVFVFPELQSGNIGYKIAQRFGHFEAVGPVLQGLNKPVSDLSRGCSEEDVYKVAIITAAQGLA

SEQ ID NO: 1473 - protein, 324 aa, Lactobacillus brevis ATCC 367
MELFDSLKQKINGQNKTIVFPEGEDERVLGAASRLVADGLVKAIVLGKQSQIETTATNHAIDLSQLTILDPAQMPSDQHQAMLDALVERRKGKNTPEQAAEMLKYPNYVGTMMVYMGQADGMVSGAVHATGDTVRPALQIIKTKAGVHRISGAFIMQKGDERYVFADCAINIELDAAGMAEVAIESAHTAKVFDIDPKVAMLSFSTKGSAKGDMVTKVQEATALAHESAPDLPLDGELQFDAAFVPSVGTQKAPDSKVAGHANVFVFPELQSGNIGYKIAQRFGGFEAIGPILQGLNKPVSDLSRGCNEEDVYKVAIITAAQSL

SEQ ID NO: 1474 - protein, 325 aa, Lactobacillus hilgardii ATCC 8290
MELFESLKQKINGKNISIVFPEGNDVRVLGAASRLAKDGLIKPVILGDKNEVEQVAGDANVDLNDVQIIDYLNQPQDQIDAMVSAIVERRKGKTDEAKAREWLKDPNYFGTTLVYMDKIDGMVSGANHPTGDTVRPALQIIKTKPGVKLISGSFIMQKGDQRYLFADCAINIDLDAAGLAEVAVESAKVAKTFDIDPKVALLSFSTKGSAKGDMVTKVQEATELAKQQAPDIPIDGELQFDAAFVPSVADKKAPGSNVAGHATVFIFPELQSGNIGYKIAQRFGGFEAIGPILQGLNKPVSDLSRGSNEEDIYKVSIITAAQTLS

SEQ ID NO: 1475 - protein, 328 aa, Lactobacillus sanfranciscensis
MDLFESLKSKIKDRKIKLVFPEGEDERIISAASRLANDDLAIPVLLGNEAEIKKTADALNVSLDGIEIVDIENVPGEVRQQMVQAIVERRKGKTTADQAAQWLKDPNYFGTTMVYMDDVDGMVSGAAHPTGDTVRPALQIIKTKPGVNLISGSFVMQKGDQRYLFADCAININPNETQLAEIAVESGKTARLFDIDPRVALLSFSTNGSAKSPEVEKVHNATKLAQEMDPAMPIDGEMQFDAAFVPAVAKAKYSDSKVAGHATVFVFPELQSGNIGYKIAQRMGGFEAIGPILQGLNKPVSDLSRGCNAEDVYKVSIITATQALADKD

SEQ ID NO: 1476 - protein, 325 aa, Lactobacillus ruminis ATCC 25644
MDLFESLKNKISGKNIKIVFPEGNDERIVKAAVRLANDGMIRPIILGAKETVEDSNNGQALPESIEVIDPDKYPSEEFEKMVAAFVERRKGKNTEEQARKMLKDVNYFGTMMVYMGNADGLVSGAIHPTGDTVRPALQIIKTKPGVSRTSGAFIMSRGDERYYFADCAININPNAEELAEIAVQSAKSARLFDIDPRVALLSFSTMGSAKSDEVTKVQEATKLAKEMAPDEQIDGELQFDAAFVKSVAEKKAKDSKVAGSANVFVFPELQSGNIGYKIAQRLGNFEAVGPILQGLNAPVSDLSRGCSEEDVYKVALITAAQTLGD

SEQ ID NO: 1477 - protein, 325 aa, Lactobacillus salivarius UCC118
MDLFDNLKQKVAGANKTIVFPEGQEPRIFRAAIRLKNDGLVVPILLGKVDEIKQNAENEGVDLGDIELIDPNTYPEDKFAEMVEAFVERRKGKNTKEQAETMLRDVNYFGTMLVYMDKADGLVSGAIHSTGDTVRPALQIIKTKPGVSRTSGAFVMVKGDERYLFADCAININPGAQELAEIAVESANTAKIFDIDPQVAMLSFSTMGSAKSDEVTKVQEAVKLAKELAPNEKIDGELQFDAAFVPVVAKQKAPESEVAGHANVFVFPELQSGNIGYKIAQRLGGFEAIGPVLQGLNKPVSDLSRGSVEEDVYKVAIITAAQALM

SEQ ID NO: 1478 - protein, 326 aa, Erysipelothrix rhusiopathiae ATCC 19414
MDLFEGLKEKISGKDIKVVFPEGIDARIIGAAVRLAADGLCHPIILGNKEVILSSAQDLGFLMDKVEIIDPETYPEDKKEAMVDALVERRKGKLAKEDAYEWIKNVNYFGTMLTYMGDADAMVSGAIHSTGDTVRPALQIIKTKPGVSRTSGAFIIFKRHESYLFSDCAININPNSQELAEIAVESAKTAELFDIDPIVSLLSFSTKGSAKSDEVDKVVEATRIAQELAPEYQIDGELQFDASFVPTVAQLKAPESNVAGNARVFIFPDLQSGNIGYKIAQRLGGYEAIGPILQGLNKPVSDLSRGCVEEDVYKLAIITAAQTLIK

SEQ ID NO: 1479 - protein, 323 aa, Pediococcus pentosaceus ATCC 25745
MDLFEGLKSKIKGQNRTVVFPEGEDVRVLAAAIRLADDGLVQSILLGVEADIKATAEKHGLNLENVQIIDPSQYPEADQKEMIDKLVERRKGKNTEEQVIEMLKDVNYFGTMLVYLGKADAMVSGAVHATGDTVRPALQIIKTKPGMRRISGAFIMQRENERYVFGDAAINIDPDAETLAEIAIQSAETARLFDIDPKVAMLSFSTKGSAAGPMVDKVREATKVAQERDPKTPYDGELQFDAAFVPAVGASKAPDSEIAGHANVFIFPELQSGNIGYKIAQRLGGFEAIGPILQGLNAPVSDLSRGASEEDVYKVAIITAAQV

SEQ ID NO: 1480 - protein, 323 aa, Parvimonas micra ATCC 33270
MNIFEELTGKIKGTNKKIVFPEGEDKRVLGACVRLKKDGLVTPIILGNVEEIKKTAKELNVSVDDIEIIDPLKAEDFDELVEKFVERRKGKNTKEEAERFLKDVNYYGTMMVQVGKADGMVSGAVHSTGDTVRPALQIVKTKPNVSRTSGAMVMLGKNGERYVFADIAINITLEAKELAEIAVETAKTAELFGIDPKIAMLSFSTKGSAKHELSQKIADATQMAKELAPDLSLDGELQFDAAIVPTVGEQKAKGSKVAGHANVFIFPDLQSGNIGYKIAQRLGGFEAIGPILQGLNKPISDLSRGCNEEDVYKLAVITAAQSL

SEQ ID NO: 1481 - protein, 323 aa, Finegoldia magna ATCC 29328
MDIFESLKSKISGKNLKIVFPEGEELRILKAVARLNEEKIITPVILGDEDKIKELAKKENLNIEGVKIINPLTASDFDEKVDKFVERRKGKNTEEQARTMLKDVNYYGTMMLYCDEVDGLVSGAVHSTGDTVKPALQIIKTKPGTKLVSGAMVMIGPNGERYVFSDIAINIELSEEQLAEVGVVSAETAKLYDIDPKVAFLSFSTKGSAKHPFAEKVANATKIAQEMAPDLPIDGELQFDASIVESVGKQKAPGSNVAGNANVFVFPDLQAGNIGYKIAQRLGKFEAIGPILQGMAKPVNDLSRGCNEEDVYKLALITAAQSL

SEQ ID NO: 1482 - protein, 323 aa, Bacillus coagulans 36D1
MSTFFDGIKEKVRGHNKTIVFPESSDERVLTAVSRFAADEVLRPVLIGNKDKIQAKAQAIGVSVKGVTVYDPEDYAGFEEMVQAFVERRKGKATEEDARQILKDVNYFGTMLVYLKKADGLVSGAIHSTADTVRPALQIIKTKPGVKKVSGVFIMVRGEEKFVFADCAINISPDSQDLAETAVESAKTARTFDIEPRIAMLSFSTRGSAHSDETEKVAQAVRLAKERDPELVMDGEMQFDAAYVPAVAQKKAPDSVIQGNATVFIFPNLDAGNIGYKMAQRLGGFEAVGPILQGLNAPVNDLSRGCNAEDVYHLALISAAQSL

SEQ ID NO: 1483 - protein, 326 aa, Gemella haemolysans ATCC 10379
MANDLFVELQQKLEGKNVRIVLPEAYDERVLEAAVKLGATSYVKPVLVGKKEKVEEIAKGLSLDASNLEVIDHENYEKLEELVAKFVERRAGKVTEEKARELLKDVNYFGTMLVYTGEVEGLVSGAIHSTGDTVRPALQIIKTKPGTKRTSGAFIMSKEDKRYVFADCAINPTLDAEGLAEIAIESAKTAKSFNVDPKVAMLSFSTLGSAVTEDTTRVAEATKLVKENAPELAVEGELQFDAAVVPSVAKLKAPNSKVQGDANVFVFPSLEAGNIGYKIAQRLGGFEAVGPILQGLNAPVNDLSRGCNAEDVYKLSLITAVQALEK

SEQ ID NO: 1484 - DNA, 2100 bp, Kineococcus radiotolerans SRS30216
atggcccgcgtgctgctcgtcgtccccaccggccacggtgccggcctcacctcgacctgcctgggcctggtccgggccctcgacgcgcgcggggtcgccgtcggcttccacaagccgctggcccagcccacccgcgccaccggacccgaccgctccgtcgcgctggtccggctcaccaccgcgctggacccctccgagccgatccccgcctcccgcgtcgtcgagcgcctctcccgcggcgacatcgacgacctcatggaggaggtcgtcgccgccgccgagggggtgctcgccgcccacgacgtcgtcgtcgtcgagggcctggcgccctcggcggaccaggtgttctccgggcgggtcaaccaggcgctggccacggccctggacgccgacgtcctgctcgtcgggtccgccggcgtggacggcaccgaccccggcgcgcccgagcgcatcgccgaggacatggccgtcaccgccgggacgtaccggacgggggaggcgctgcgggtcatcggcggggtcgtctcgcgctggccggtgccggaggaccccgagaccgccgtcgcccgcgtcgcgcggctgcgcggggcgctggagcaccacggcatccccctcgtcggggcggtgcccttccgcgccgacctcgtctgggcccgggtgcgcgacctcgtccacgacctcgacgtcgaggtgctgacccacggcgaccagggccggcgcatcaaggaggtcgtcgtcgcggcgcaggccgtgccggggatgctgccgctgctgcgcgaggggcggctcatcctcgtccccggcgaccggcacgacgtcgtcatggcgacctgcctggccgcgctcaacggcaaccgcctcgccgggctgctgctgaccgccggggtcgggatggacccccgggtggcggagctgaccgcggccgccgccgcgaccggcctgcccatcctgcgctcggaccgcagcacctacgccaccgccaccgccgtcaaccgcctcgacccggaggtccccgccgacgacgccgagcgcgcgctggcggtctccacgacggtcgccgacgccctcgaccccggctggctggccaagctgcccacggcctcgcacaccccgcgcctctcgcccgcggccttccgccgccgcctgaccaccctggccgccgagcgggtgcagcggatcgtgctgcccgagggcgccgagccgcgcaccgtgcaggccgcggcgatctgcgccgagcgcggcatcgcccgccccgtcctgctggcccaccccgacgaggtcgcctccgtcgcggccgggctcgggctgaccctgcccgagggcgtggaggtgctcgacccggccgggctggtcgagcgctacgtcgacgtcctcgtcgaggcccgcaagcacaagggcatgcagcccgacgtcgcccgcgactccctcgccgacccgatctggctgggcaccacgatgctgcaggccggcgacgtcgacgggctggtggccggggcggtgcacaccaccgccgcgaccgtgcgccccgcgctgcaggtcgtgcgcaccaagccgggggcccggctggtgtccagcgtcttcttcatgtgcctgcccgacgacgtcgtcatctacggcgactgcgcggtcaaccccgacccgggggcggaggacctcgccgacatcgccctgcagtcggcggcgtcggcgcgcgccttcggcatcgaaccgcgggtggcgatgatcagcttctccaccggctcgtcggggtcgggttccagcgtggacaaggtggccgaggccacccgcatcgcccgggagcgcgacccggacctcatcatcgacgggcccctgcagtacgacgcggccgccgtcgcctcggtcgcggcgtccaaggccccggactcgccggtcgccggccgcgccacggtgttcgtgttcccggacctcaacacgggcaacacgacgtacaaggcggtgcagcgcaacgcgggggtcatctcggtgggcccgatgctgcaggggctggcgaaaccggtgaacgacctctcgcgcggggcgctcgtcgacgacatcgtctacacgatcgcgctgaccgccatccaggcctcgcggggctga

SEQ ID NO: 1485 - DNA, 2160 bp, Reinekea blandensis MED297
ttgaaatatacctactttatctcagcgactggggccggtaccggcctgacatcagtctgtctgggtctggtgcgggcgctggaacaacttggcgtccgggtcgcgttcagtaaacccatcgcgcaacagttcgggcccgatgccgaaccggaacgttccacacacctggtgaacgcgacactcggcctgaacccggccaagcccatcaagctttcacacgcgcagcaacagctcgcgctgggccaaaccgaccgtttgatggaagacatcatttccattgcgcaatcctctggtgaaggcgctgacatcctgattgtcgaaggcttggtcccggttgccgatgaaaactacattgcagaactgaaccgcaacatggcgaaggcgctggatgcggatgtgattctggtgtcggcgaaaaacaaagacagctcggcgcagttgaatgaacgcattaaaatgacggccagcctctttggtggggtgaatcataagagcgttatcggctgcattctgaacaaagtcggcgcaccagagccggcttctcagcaggtgattgctgaagaggagcccgatgaagccgatcgtcaccgcacagcgaaatcccgctccattgacgaactggaagccgtattgccggtcttccagggtgactcgtttaaactgatcggtgcagtcgcctggaatccgcttctggttgccccgcgaacgatcgatgttgctgaacacctgggtgcagacatcatcaatgccggccagatcaaggagcgtcgggtccagagcatcaccgtctgtgcccgcaccatgccaaacatgctgcacaccctgaaagcggggaccttggttgtgacaccgggtgaccgtgacgacattctgatggcgtcctcgatggcggcgctcaatggcgtaccactggccggggttattttaaccggtggtatcaaaccggaagactcggttatgcaactgtgtcactccgcctttgccaccggcctgccggtgttgacctcgaacctcaacaccttcagctcagctcagtacctgaactcaatgaacactgaagttccggccgatgacatttcccgcatggaaagcgtcatggaagccgtggcgtcatccatcaatgccaaatggctggccgaacgtgccgaagtggtgggcgaacgacgattgtcgccaccggccttccgacacctggtcgtgaaaagcgcccgtaaagccgccaaacggatcattctgccagagggtaatgagccgcgcaccattaccgcagccgccatctgccatgaaaaaggcattgcgcactgtgtgttgttgggcaacccggatgaaattcatcgcgtcgcgcaaacgcagaacatcgtgttgccgccgtccattgaaatcattgatccggaaaaagcccgacccaaatacattgagcccatggtcgagctgcgtaaacacaaaggcctgacggccccaatggcagaagcccaactcgaagacccgattgtactgggcaccatgatgttggcgcgggatgaagtggacggactggtcagtggtgcggtcaacaccaccgccaataccgttcgaccggcgctgcagttggttaaaacgcgtccggacagctcactggtctcctccgtattcttcatgctgttgccagaccaggccgttgtttatggcgattgcgccatcaaccccgacccgaacgcagaacaactggccgaaattgctatccagtcgggcgattccgcaaaagcctttggcattgaaccgcgcattgcgatgatctcgtattcgaccggacaatcgggcagcggcagcgatgtcgagaaagtacgcgaagccacccgaattgccaaagaactccgcccggatctgctgatcgacggaccgctacagtacgacgcggccagcaccccatcggttgcggccagcaaagcgccggacagcaaagttgcggggcgagccactgtctatgtgttcccggacctgaataccggcaacacgacctacaaggccgttcaacgcagtgccaatgtggtcagtatcggcccgatgctgcagggcttgcgcaaaccggtcaacgacctctcgcgtggcgccctggtggaggacattgtctacaccatcgcattgacagccatccaggctgatcagatgaccaacagctaa

SEQ ID NO: 1486 - DNA, 2154 bp, Teredinibacter turnerae T7901
atgcatagtttttatttggctccaacatcgtcgggcactggcttaacctcagtttgtttggggttggtacgcgcactcgatcagctgggggtgcgcgttgccttcttcaaaccgatcgcgcagatttacggcaccgatacgggtccgggacgatcgaataccttgattcaggaaaccgtgggcttgcagcctgcgccgtctatcagtctgtcgtacgcgcagcacaaagttgcctccggcgggctcgatgacttgatggaagaggtaatatcaaatttccaggcttcggctggcgatgccgatgtgatggttgtggaggggctggtgcctcgtccaaacgaagattacattgtacggttgaacactcgaatcgccgcgacattaggcagtgatgtcattcttgttgcagctaaaaaacattattcttctgcacaactcaatgagcggataaatatcaccgccagtatttttggtggactgaacaacccacgcttgttgggctgtatcctgaataaggttggggcgccacctaaaggcagtcatcgggtacgcgcagatgacgcggccgacgattgggaagtggcggagcaaaacattgaatttgttaagcgtaaattgccgatcttcaaccaccaggatttccgctgcctgggcattatccactggaaccccgcatttattgcaccgcgaaccttggatgttgccaagcatttgaatgcacgggtactgcatgccggtaatattgttcagcgccgggtatcttctgtcgttttgtgcgcgcgcaccgtggcgaatattgtttatgcccttaagcccggtaccttgatcgtaacgcctggcgatcgcgcagatattatgctggcggcgagccaggcatcacttaatggcgtccctctcgcgggcgttctcttcaccggcgatatggtgcctgacgaacgtgttatgaccctgtgccgcagcgcaattaacaccggcttaccaattttgtcgtcagagctggattcactggccacggtgcaactgctcgataatatgagcgaagaggttccggctgaagacgtgcagcgcatgttagaagttatggacgaagtggctcactcgctcgatacgcaatggctggcggaccgcgcttctctgccacaggatgtgcgtatgtcgccaccggcgttccgtcactatctggtgcgtcaagcgcaaagcctgagtaagcgtattgtgctacctgaaggcgatgagccgcgcacgttacaggctgcgattatttgccacagccgcggtattgcgcgttgcgtgttgttgggtaaaccggaaacaattcattcggttgccgaagtgaacggtttgcaaattccagatgggctggaaattctcgacccggaaaatattcgcaaaagttacgtgcaacccatggttgcgctgcgcgagcacaaaggcttgagtcagccgcaggctgaggtacaactggaagattccgttgttctcggtaccatgatgctggcggtcggtgaggtcgatggtctggtcagtggtgccatgcataccacgggaaataccattcgccccgcgttgcagttaattaaagcgcgtaccgaatccagcattgtttcgtcaattttctttatgctgatgccggaccaagtgctggtatacggcgattgcgctgtgaaccccaacccgactgcggaacagctggcagaaattgcgattcagtctgcagagtcggcgaaagcgtttggcatcgaccctaaagtcgcgatgatcagctattcaacgggttcgtctggtaaaggctccgatgttgacaaggtacgccaggccactgaaattgcccaggccaagcgccccgatatgattatcgacggccccttacagtacgatgcggccgcaattgccagcgttgccgccagtaaagcgccgggcagccctgtcgcgggtaaagctacggtgtttgtgttccctgatttgaataccggcaataccacctataaagccgttcagcgcagcgcgaacgtgttaagtattggcccagtattgcaggggcttaaaaagccggtgaacgatctgagccgcggcgcgctggtcgatgatatcgtttacaccatcgcgcttacagcgattcaggctgagcaggcggcgaaactgaattactactag

SEQ ID NO: 1487 - DNA, 2154 bp, Marinobacter aquaeolei VT8
atggcaaaaagtcttttcatagctccaacctctcttgactccggtctgacctccgtatgccttggtcttctgcgtgcacttgaacgggaaggtgtaagcgttggcttctacaagccattcagtcagtccgtgcacagaggcgaagcgcttcataatgatggcaaggattcctccgtggcctttgtacgtgcccgcagccacctggaaccacccgacccgattccgttgaaaaaagcccagcagctgttgaaccatggcaaagccgacctgctgatggagaacgtggtcggtgaataccagaaagtcgccaacgaagtcgacgtggtaatcattgaaggattggtgccggacagaaccgaagcctatatcgcgcgactcaacgtggaagtcgcccgcaatctcggttccgaagtgatcctggtgagcacaccgaagagctgtactgccagcgagctcgatgacgacctggatttctcctcacgcctgtttgcggcaccgtcggatccggacgtgattgctgtcattcttaacaaggtgggagaaccacagaagtccggtatggcactggatcatcccccggcaagtgaagccaccgaaatagattatcacacctcctgcaaagtgttcgcgaacggccgcttccagttgctggcgcagattccctggcaaccacaactgctggcaccccgggtctctgatgtagcgcgggagcttggtgttccggtactgcacgaagggcaaatgcactcacggcgggtgcagcgggtatcagtgtgcgccagatccatccgcaacatgaccgacaccctcaagccaggcaccctgatggtcacccctggtgatcgcgaggatatcgtagtagccacggccgtcgccgccctcaatggtgtcccgcttgccgggctgatgctgacaggcggcctgatgccggacgaacgggttatagagttgtgtcggcgggcactggacaccggtttgccagtgctgagctcggaaaccaatacctacgagagcgcccacctgttggcaaatctgtcttcagccattcccattgacgacccggagcgtattgaagaagccatggaatccgtggcccggcgaatcaatacccagtggctgcaggagcatctgaaagtccagcgccaacgccggctttcccctccggcattccgttatcagctttcggaaagagcccgggctgcggccaagcggatcgtactgccagaaggcagcgaacccagaacgattcaggcagccattatctgccatcaacgcaacctggctcattgcgcgctgatcggtgaaccacacgaaattcgctcggtggccgcttcccagggtgtggaactgccaaaagacctggaaatcatagacccgcaatcggtgcgcgagcgttacgtggcgcccatggtggagctgagaaagcacaaaggcctgacaccggatatggccgaagccatgctggaggacaacgtcgttctgggtaccatgatggtggccatggacgaagccgacgggctggtatccggcgccattcataccacggccaacacggtgcgccccgccctgcagctgatcaagacccacgacaacgcaaaggttgtatcatcggtattcttcatgttgctgccgcagcaggtgctggtatatggcgactgcgccatcaatccggatccgaacgccgaggagctggccgacatcgccatacagagcgccgagtctgctgaagcctttggtattgaacctgtggtggccatgatcagctacagcaccggcgaatccggcagcggcgaggatgtcgacaaggttcgggaagccacacgcattgcccgggaacggcgcccggatctgctcattgacggtccgctgcaatacgacgccgcggccatcgagagcgtggcaaaatccaaagccccgggcagcaaggtggccggcaaggctaccgtgtttgtgttcccggacctgaacacgggcaacaccacctacaaggcggtgcagcgcagtgccaatgtcgtcagcgtggggcccatgctccagggcttgcgaaaaccggtaaacgacctgtcccgcggggccctggtggaagacattgtcttcaccattgccctgacggcagtacaggcaaaacaggtcgcggatgcaggagccgcctga

SEQ ID NO: 1488 - DNA, 2148 bp, Hahella chejuensis KCTC 2396
gtggccaaagttctctttatcgcccccgcctccgtgtcggtaggcttgacctccgtctgccttggcttaatcagggcctacgacagcgtagggctgcgcgtcgcgttcttcaaaccattcgcacaaccccgcgataatcatcatgaaacggatcgctcaatcatattcacccgggaaaaaatgggcttaaccgtcccggacccaatgtccttgcgccacgcccacaacctgatgagccagcagcaaacgcccctgctgatggaacaaaccatcgcgctatttcacaaagtggatacggaggcggatgtcgtcatcgttgaaggcgtcgcgcccccacccggcgatgactattccgcccgtctgaatgtcgaagtggcgcgcaacctggacgccgaagtcatcctggtcgccgcccctgacggcatgcccccacaagacctggatgatcacctttctctcgcctcccgactgtttgcagacccgtccgatcctgatgtcgtcggttgcgtgcttaataaagtgcacgccccccatggcgacgagccgccctttagcgacgacgccgatgaagacaagacttcagccgaaaggcatgactatggaaaagagtgcaaagtattccgtcaatctcattttcgcctcatcgccagcattccctggcgcgccgacctggtagcgcccagaacctcagacattgttgaggagttggaagcggagtatttgaacgaaggcaaatccaagcagcgcagggtgctccatacgaccgtgtgcgcccgcaccatacccaatatggttaaccgcctgaaaccgggcgccttgatcatcacgccaggagatcgtgaagatattttcgtcaccagttgcgccgccgccctgaccggcgttcccttggcgggcctattgctgactggcggcttgaagccggacccgcgcacgctgaagttatgccagtcggccctggataccggccttcccgttctgagcacccgtaaggacacctatgtcaccgccagcatggtgtcgcgcatggataccgaagtgccgctggacgacatggagcgtatcgagtccgttatcgccagcgtgtccgcccatattgaccctgaatggctcaagcaatccgtgagcctgccgcgcaagccccgcatgtcgccggcggcgttccgctatcaattatcgaagcgggcgaaggaagccaataagaccattattcttcccgaaggaaatgaaccgcgaaccatacaggccgccaccatttgccatgaccgcggcattgcaaaatgtattctggtaggcaagcgtcaggaaattctggccgtcgctgaggctcagggcgtgcaattgccagacgccattcagatcatcgaaccggatcaagtcagggagaagtatatttctcccatggtggagttacgcaggcacaaaggattgacgccacaaatggcggaggcgcaactggaagataatgttgtgctcgccaccatgatgctggcgcttggcgaagtggacggactggtatccggcgccgtacacaccaccgccaataccgtgcgccccgccctgcaacttatcaaagcccgcaaaggatgccgtattgtctcctcggtattcttcatgtgcctgccggaacaggtgctggtttatggcgattgcgctatcaatccggacccggatgcggaagaactcgcagatattgcgctgcaatgcgcggattctgccgtcctcttcgggatcgagccccgtgtggcgatgctcagctacagtactggcgactctggaactggcagcgatgtggacaaagtccgcgcagcgaccaaactcgcccatgagaaacgcccggacttattgttggatggaccattgcagtatgacgccgccgcgatcgaagacgtcgccaaaaccaaagctcccgacagtaaagtagcgggtaaggcgacggtatttgtgttcccagatctgaataccggcaacaccacctacaaagcagtgcaacgtagcgcaaatgtcatcagtatgggcccgatgttacagggcttgaagaagcctgttaatgacttgtcccgcggcgcactggtggaggacatcgtctacactattgcgctgacggctgtgcaggcgactcagaatacggaagtgttggaaagctag

SEQ ID NO: 1489 - DNA, 2094 bp, Pseudomonas mendocina ymp
atgcataccttcttcatcgcccccaccggcttcggtgtcggtctcacttccatcagcctcggcctggtcggcgcgctggagcgcagcggcctcaaggtcggcttcttcaagcccattgcccagccgcatgccggcgacctcggcccggagcgttccagcgagctgatcgcccgcacccacggcctgcactcgcccaaaccgctgccgctcagccatgtcgaacgcatgctcggcgacggccaactggatgaattgctggaagatatcatcagcctctatcagcaggccgccgccgacaaggacgtggtcatagtcgaaggcatggtgccgacgcgccacgccagttacgccgcgcgggtcaacttccacctggccaagagcctggatgccgacgtgatcctggtcagcgcgccggaggacgagagcctcaccgaactgtccgaccgcatcgagatccaggcgcagctgttcggcggccccaaggacccgaaggtgctcggcgtgatcctcaacaaggtgcgcagcgaggacggcatcgaggccttcgccgaacgtctgcaggagttctcgccgctgctcaagaccgaggactttcgcctgctcggctgcatcccctggcaggatgaactgaatgcgccacgcaccaaggacatcgccgagctgctcggcgcccgcatcctcaacgccggcgactacgaacagcggcgcatgctcaagatcgtgctctgcgcccgcgccgtggccaacagcgtgcaactgctcaagcccggcaccctggtggtgacgccgggggaccgcgacgacatcattctctccgcctgcctggcggcgatgaacggcgtgccgttggccggtctgctcctgtgcagcgatttcgcccccgacccgcgcatcatggaactgtgcaatggcgcactggccagcggcctgccggtgatgacggtgagcaccggctcctacgacaccgccaccaacctcaaccggttgaacaaggaaatcccggtggacgaccgcgagcgcgccgagaaggtctccgacttcgtcgccgggcatatcgaccacgactggctgaccacccgctgcggcactccgcgcgagctgcgtctgtcaccaccggcgttccgctaccagctggtgcaacgggccaaggccgcggccaagcgcatcgtcctgcccgaaggcagcgaaccgcgcaccgtgcaggcagcggccatctgccaggcgcgcggcatcgcccgttgcgtgctgctggccaagccggaagacgtgcatgcagtggcccgcgcgcagggcatcgaactgccggaagggttggagattctcgacccggacctgattcgcggccgctacgtcgagccgatggtcgagctgcgcaagggcaagggcctcaacgccccgatggccgaggcacagctggaagacaccgtggtgctcggcaccatgatgctcgccctggacgaggtcgatggcctggtgtcgggcgccatccacaccaccgccaataccatccgcccggcgctgcagctgatcaagacggcacccggctacaacctggtgtcctcggtgttcttcatgctgctgccggatcaggtgctggtctacggcgactgcgcggtgaaccccgaccccaatgccgaacagctggccgaaatcgctctgcagagcgccaactcggcgcaggctttcggcatcgaaccgcgagtggccatgctcagctactccaccggcgactccggcagcggcgaggaagtggagaaggtgcgcgccgccacccgcctggcccgcgaaaaacgcccggatctgctgctcgacggtccgctgcagtacgacgccgccgccatcgagagcgtcggccggcagaaggcgccgaacagcccggtggccggccgcgccacggtgttcgtgttccccgacctgaacaccggcaacaccacctataaggcggtccagcgcagcgccgactgcatcagcgtcggccccatgctgcagggcctgcgcaagccggtgaacgacctgtcacgcggcgccctggtcgacgacatcgtctacaccatcgccctcaccgcgatccaggcggccaacctgccgagctga

(The sequence listing continues in the following parts.)

What is claimed is:

1. A recombinant host cell comprising:
(i) at least one genetic modification in an endogenous gene encoding a polypeptide having pyruvate decarboxylase activity, wherein the at least one genetic modification reduces or eliminates pyruvate decarboxylase activity;
(ii) a heterologous polynucleotide encoding a polypeptide having phosphoketolase activity; and
(iii) a pyruvate-utilizing biosynthetic pathway, wherein said pyruvate-utilizing biosynthetic pathway is an isobutanol biosynthetic pathway comprising the substrate to product conversions:
(a) pyruvate to acetolactate;
(b) acetolactate to 2,3-dihydroxyisovalerate;
(c) 2,3-dihydroxyisovalerate to 2-ketoisovalerate;
(d) 2-ketoisovalerate to isobutyraldehyde; and
(e) isobutyraldehyde to isobutanol; and
wherein said recombinant host cell produces isobutanol.

2. The recombinant host cell of claim 1, wherein said host cell further comprises:
(iii) a heterologous polynucleotide encoding a polypeptide having phosphotransacetylase activity.

3. The recombinant host cell of claim 1, wherein said host cell has a reduced requirement for an exogenous two-carbon substrate for its growth in culture compared to a recombinant eukaryotic host cell comprising (i) and not (ii).

4. The recombinant host cell of claim 1, wherein said host cell has improved growth as compared to a host cell comprising (i) and not (ii) in culture media that is not supplemented with an exogenous two-carbon substrate.

5. The recombinant host cell of claim 4, wherein said exogenous two-carbon substrate is ethanol or acetate.

6. The recombinant host cell of claim 1, wherein said endogenous gene encoding a polypeptide having pyruvate decarboxylase activity is PDC1, PDC5, PDC6, or combinations thereof; and said host cell is *S. cerevisiae.*

7. The recombinant host cell of claim 1, wherein said heterologous polynucleotide encoding a polypeptide having phosphoketolase activity is xpk1 from *Lactobacillus plantarum*, xpkA from *Lactobacillus pentosus* MD363 or 6-phosphate phosphoketolase from *B. lactis.*

8. The recombinant host cell of claim 1 wherein said polypeptide having phosphoketolase activity comprises at least 85% identity to SEQ ID NO: 481 or an active fragment thereof.

9. The recombinant host cell of claim 2, wherein said heterologous polynucleotide encoding a polypeptide having phosphotransacetylase activity is EutD from *Lactobacillus plantarum* or phosphotransacetylase from *Bacillus subtilis.*

10. The recombinant host cell of claim 2, wherein said phosphotransacetylase polypeptide comprises at least 85% identity to SEQ ID NO:1472 or an active fragment thereof.

11. The recombinant host cell of claim 1, wherein said host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Paenibacillus, Arthrobacter, Corynebacterium, Brevibacterium, Schizosaccharomyces, Kluyveromyces, Yarrowia, Pichia, Candida, Hansenula*, or *Saccharomyces.*

12. The recombinant host cell of claim 1, wherein said host cell is *Saccharomyces cerevisiae.*

13. A recombinant host cell comprising:
(i) at least one genetic modification in an endogenous gene encoding a polypeptide having pyruvate decarboxylase activity, wherein the at least one genetic modification reduces or eliminates pyruvate decarboxylase activity;
(ii) a heterologous polynucleotide encoding a polypeptide having phosphoketolase activity; and
(iii) a pyruvate-utilizing biosynthetic pathway, wherein said pyruvate-utilizing biosynthetic pathway is a 2-butanone biosynthetic pathway comprising the substrate to product conversions:
(i) pyruvate to acetolactate;
(ii) acetolactate to acetoin;
(iii) acetoin to 2,3-butanediol;
(iv) 2,3-butanediol to 2-butanone; and
wherein said recombinant host cell produces 2-butanone.

14. A recombinant host cell comprising:
(i) at least one genetic modification in an endogenous gene encoding a polypeptide having pyruvate decarboxylase activity, wherein the at least one genetic modification reduces or eliminates pyruvate decarboxylase activity;
(ii) a heterologous polynucleotide encoding a polypeptide having phosphoketolase activity; and
(iii) a pyruvate-utilizing biosynthetic pathway, wherein said pyruvate-utilizing biosynthetic pathway is a 2-butanol biosynthetic pathway comprising the substrate to product conversions:
(i) pyruvate to acetolactate;
(ii) acetolactate to acetoin;
(iii) acetoin to 2,3-butanediol;
(iv) 2,3-butanediol to 2-butanone;
(v) 2-butanone to 2-butanol; and
wherein said recombinant host cell produces 2-butanol.

15. The recombinant host cell of claim 1 wherein the phosphoketolase matches the Profile HMM given in Table 6 with an E value of less than 7.5E-242.

16. The recombinant host cell of claim 1 wherein the phosphoketolase matches the Profile HMMs given in Tables 6, 7, 8, and 9 with E values of less than 7.5E-242, 1.1E-124, 2.1E-49, and 7.8E-37, respectively.

17. The recombinant host cell of claim 1 further comprising a phosphotransacetylase which matches the Profile HMM given in Table 14 with an E value of less than 5E-34.

18. The recombinant host cell of claim 13, wherein said host cell further comprises:

(iii) a heterologous polynucleotide encoding a polypeptide having phosphotransacetylase activity.

19. The recombinant host cell of claim 13, wherein said host cell has a reduced requirement for an exogenous two-carbon substrate for its growth in culture compared to a recombinant eukaryotic host cell comprising (i) and not (ii).

20. The recombinant host cell of claim 13, wherein said host cell has improved growth as compared to a host cell comprising (i) and not (ii) in culture media that is not supplemented with an exogenous two-carbon substrate.

21. The recombinant host cell of claim 20, wherein said exogenous two-carbon substrate is ethanol or acetate.

22. The recombinant host cell of claim 13, wherein said endogenous gene encoding a polypeptide having pyruvate decarboxylase activity is PDC1, PDC5, PDC6, or combinations thereof; and said host cell is *S. cerevisiae.*

23. The recombinant host cell of claim 13, wherein said heterologous polynucleotide encoding a polypeptide having phosphoketolase activity is xpk1 from *Lactobacillus plantarum*, xpkA from *Lactobacillus pentosus* MD363 or 6-phosphate phosphoketolase from *B. lactis.*

24. The recombinant host cell of claim 13, wherein said polypeptide having phosphoketolase activity comprises at least 85% identity to SEQ ID NO: 481 or an active fragment thereof.

25. The recombinant host cell of claim 18, wherein said heterologous polynucleotide encoding a polypeptide having phosphotransacetylase activity is EutD from *Lactobacillus plantarum* or phosphotransacetylase from *Bacillus subtilis.*

26. The recombinant host cell of claim 18, wherein said phosphotransacetylase polypeptide comprises at least 85% identity to SEQ ID NO:1472 or an active fragment thereof.

27. The recombinant host cell of claim 13, wherein said host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Paenibacillus, Arthrobacter, Corynebacterium, Brevibacterium, Schizosaccharomyces, Kluyveromyces, Yarrowia, Pichia, Candida, Hansenula*, or *Saccharomyces.*

28. The recombinant host cell of claim 13, wherein said host cell is *Saccharomyces cerevisiae.*

29. The recombinant host cell of claim 14, wherein said host cell further comprises:

(iii) a heterologous polynucleotide encoding a polypeptide having phosphotransacetylase activity.

30. The recombinant host cell of claim 14, wherein said host cell has a reduced requirement for an exogenous two-carbon substrate for its growth in culture compared to a recombinant eukaryotic host cell comprising (i) and not (ii).

31. The recombinant host cell of claim 4, wherein said host cell has improved growth as compared to a host cell comprising (i) and not (ii) in culture media that is not supplemented with an exogenous two-carbon substrate.

32. The recombinant host cell of claim 31, wherein said exogenous two-carbon substrate is ethanol or acetate.

33. The recombinant host cell of claim 14, wherein said endogenous gene encoding a polypeptide having pyruvate decarboxylase activity is PDC1, PDCS, PDC6, or combinations thereof; and said host cell is *S. cerevisiae.*

34. The recombinant host cell of claim 14, wherein said heterologous polynucleotide encoding a polypeptide having phosphoketolase activity is xpk1 from *Lactobacillus plantarum*, xpkA from *Lactobacillus pentosus* MD363 or 6-phosphate phosphoketolase from *B. lactis.*

35. The recombinant host cell of claim 14, wherein said polypeptide having phosphoketolase activity comprises at least 85% identity to SEQ ID NO: 481 or an active fragment thereof.

36. The recombinant host cell of claim 29, wherein said heterologous polynucleotide encoding a polypeptide having phosphotransacetylase activity is EutD from *Lactobacillus plantarum* or phosphotransacetylase from *Bacillus subtilis.*

37. The recombinant host cell of claim 29, wherein said polypeptide having phosphotransacetylase activity comprises at least 85% identity to SEQ ID NO:1472 or an active fragment thereof.

38. The recombinant host cell of claim 14, wherein said host cell is a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Paenibacillus, Arthrobacter, Corynebacterium, Brevibacterium, Schizosaccharomyces, Kluyveromyces, Yarrowia, Pichia, Candida, Hansenula*, or *Saccharomyces.*

39. The recombinant host cell of claim 14, wherein said host cell is *Saccharomyces cerevisiae.*

40. A method for the production of 2-butanol, or 2-butanone comprising growing the recombinant host cell of claim 13 or 14 under conditions wherein the product is produced and optionally recovering the product.

41. A method for the production of isobutanol comprising growing the recombinant host cell of claim 1 under conditions wherein the product is produced and optionally recovering the product.

42. A method of producing the recombinant host cell of claim 1 comprising:

transforming a host cell comprising at least one genetic modification in an endogenous gene encoding a polypeptide having pyruvate decarboxylase activity, wherein the at least one genetic modification reduces or eliminates pyruvate decarboxylase activity, with a heterologous polynucleotide encoding a polypeptide having phosphoketolase activity.

43. The method of claim 42, wherein said method further comprises:

transforming said recombinant host cell with a heterologous polynucleotide encoding a polypeptide having phosphotransacetylase activity.

44. A method of improving the growth of a recombinant host cell comprising at least one genetic modification in an endogenous gene encoding a polypeptide having pyruvate decarboxylase activity, wherein the at least one genetic modification reduces or eliminates pyruvate decarboxylase activity, comprising:

transforming said recombinant host cell with a heterologous polynucleotide encoding a polypeptide having phosphoketolase activity, wherein the recombinant host cell comprising the heterologous polynucleotide encoding a polypeptide having phosphoketolase activity has improved growth as compared to a control recombinant host cell without the heterologous polynucleotide encoding a polypeptide having phosphoketolase activity.

45. The method of claim 44, wherein said method further comprises:

transforming said recombinant host cell with a heterologous polynucleotide encoding a polypeptide having phosphotransacetylase activity.

46. The method of claim 44, further comprising growing the recombinant host cell in media containing limited carbon substrate.

47. A method of reducing the requirement for an exogenous two-carbon substrate for the growth of a recombinant host cell comprising at least one genetic modification in an endogenous gene encoding a polypeptide having pyruvate decarboxylase activity, wherein the at least one genetic modification reduces or eliminates pyruvate decarboxylase activity, comprising: transforming said recombinant host cell with a heterologous polynucleotide encoding a polypeptide having phosphoketolase activity, wherein the recombinant host cell comprising the heterologous polynucleotide encoding a polypeptide having phosphoketolase activity has a reduced requirement for an exogenous two-carbon substrate as compared to a control recombinant host cell without the heterologous polynucleotide encoding a polypeptide having phosphoketolase activity.

48. The method of claim 47, wherein said method further comprises:

transforming said recombinant host cell with a heterologous polynucleotide encoding a polypeptide having phosphotransacetylase activity.

* * * * *